United States Patent
Adams et al.

(10) Patent No.: US 10,405,571 B2
(45) Date of Patent: Sep. 10, 2019

(54) COMPOSITIONS AND METHODS FOR PRODUCING TOBACCO PLANTS AND PRODUCTS HAVING ALTERED ALKALOID LEVELS

(71) Applicant: Altria Client Services LLC, Richmond, VA (US)

(72) Inventors: Andrew Carl Adams, Midlothian, VA (US); Marcos Fernando de Godoy Lusso, Chesterfield, VA (US); Sreepriya Pramod, Glen Allen, VA (US); Dongmei Xu, Glen Allen, VA (US)

(73) Assignee: Altria Client Services LLC, Richmond, VA (US)

( * ) Notice: Subject to any disclaimer, the term of this patent is extended or adjusted under 35 U.S.C. 154(b) by 0 days.

(21) Appl. No.: 15/192,480

(22) Filed: Jun. 24, 2016

(65) Prior Publication Data

US 2016/0374387 A1    Dec. 29, 2016

Related U.S. Application Data

(60) Provisional application No. 62/335,772, filed on May 13, 2016, provisional application No. 62/271,780, filed on Dec. 28, 2015, provisional application No. 62/186,854, filed on Jun. 30, 2015, provisional application No. 62/185,268, filed on Jun. 26, 2015.

(51) Int. Cl.
| | |
|---|---|
| *A24B 15/10* | (2006.01) |
| *A24D 1/04* | (2006.01) |
| *A24D 3/04* | (2006.01) |
| *A01H 5/12* | (2018.01) |
| *C12N 15/82* | (2006.01) |
| *A24B 3/12* | (2006.01) |
| *A24B 13/02* | (2006.01) |
| *A24B 13/00* | (2006.01) |

(52) U.S. Cl.
CPC ............... *A24B 15/10* (2013.01); *A01H 5/12* (2013.01); *A24B 3/12* (2013.01); *A24B 13/00* (2013.01); *A24B 13/02* (2013.01); *A24D 1/045* (2013.01); *A24D 3/043* (2013.01); *C12N 15/8243* (2013.01)

(58) Field of Classification Search
None
See application file for complete search history.

(56) References Cited

U.S. PATENT DOCUMENTS

| | | |
|---|---|---|
| 1,055,360 A | 3/1913 | Sartig |
| 1,304,539 A | 5/1919 | Brinkhaus |
| 1,577,768 A | 3/1926 | Smith |
| 1,620,298 A | 3/1927 | Smith |
| 1,671,259 A | 5/1928 | Schloesing |
| 1,927,180 A | 9/1933 | McConnell |
| 1,962,145 A | 6/1934 | Gross et al. |
| 2,105,446 A | 1/1938 | Wilson |
| 2,136,485 A | 11/1938 | Berka et al. |
| 2,429,567 A | 10/1947 | Sows |
| 2,760,495 A | 8/1956 | Samfield et al. |
| 3,046,997 A | 7/1962 | Hind |
| 3,139,435 A | 6/1964 | Staley et al. |
| 3,258,015 A | 6/1966 | Ellis et al. |
| 3,280,823 A | 10/1966 | Bayley et al. |
| 3,356,094 A | 12/1967 | Ellis et al. |
| 3,396,735 A | 8/1968 | von Bethmann et al. |
| 3,584,630 A | 6/1971 | Innskeep |
| 3,612,066 A | 10/1971 | Jones et al. |
| 3,861,400 A | 1/1975 | Perkins et al. |
| 4,037,609 A | 7/1977 | Newton et al. |
| 4,038,993 A | 8/1977 | Geiss et al. |
| 4,068,671 A | 1/1978 | Casey |
| 4,150,677 A | 4/1979 | Osborne, Jr. et al. |
| 4,153,063 A | 5/1979 | Roselius et al. |
| 4,155,909 A | 5/1979 | Sanders et al. |
| 4,215,706 A | 8/1980 | Larson et al. |
| 4,220,781 A | 9/1980 | Sanders et al. |
| 4,236,532 A | 12/1980 | Schweizer et al. |
| 4,321,387 A | 3/1982 | Chavdarian et al. |
| 4,332,945 A | 6/1982 | Edwards, III |

(Continued)

FOREIGN PATENT DOCUMENTS

| | | |
|---|---|---|
| AU | 2015100914 A4 | 8/2015 |
| CA | 2330782 A1 | 7/2002 |

(Continued)

OTHER PUBLICATIONS

Hibi et al., 1994, The Plant Cell 6: 723-735.*
Chaplin and Weeks, 1976, Crop Science, 16: 416-418.*
Shoji et al., 2010, The Plant Cell 22: 3390-3409.*
Notice of Observation by a Third Party in the corresponding European Application No. 16738293.6, dated Sep. 24, 2018.*
Bowman et al., "Revised North Carolina grade index for flue-cured tobacco," *Tobacco Science*, 32:39-40 (1988).
Chaplin et al., "Association Between Percent Total Alkaloids and Other Traits in Flue-cured Tobacco," *Crop Science*, 16:416-418 (1976).

(Continued)

*Primary Examiner* — Bratislav Stankovic
(74) *Attorney, Agent, or Firm* — David R. Marsh; Arnold & Porter Kaye Scholer LLP

(57) ABSTRACT

The present disclosure provides the identification of tobacco Nic1 locus. Also provided are tobacco plants with altered total alkaloid and nicotine levels and commercially acceptable leaf grade, their development via breeding or transgenic approaches, and production of tobacco products from these tobacco plants. Also provided are compositions and methods for producing tobacco plants having novel Nic1 mutations or alleles to reduce nicotine levels. Further provided are sequence polymorphisms and molecular markers for breeding tobacco with reduced nicotine or nicotine free while maintaining tobacco leaf grade and tobacco product quality.

20 Claims, 7 Drawing Sheets

Specification includes a Sequence Listing.

(56) References Cited

U.S. PATENT DOCUMENTS

| | | |
|---|---|---|
| 4,340,072 A | 7/1982 | Bolt et al. |
| 4,442,292 A | 4/1984 | Edwards, III |
| 4,452,984 A | 6/1984 | Edwards, III |
| 4,516,590 A | 5/1985 | Teng |
| 4,528,993 A | 7/1985 | Sensabaugh et al. |
| 4,557,280 A | 12/1985 | Gravely et al. |
| 4,590,278 A | 5/1986 | Edwards, III |
| 4,595,024 A | 6/1986 | Greene et al. |
| 4,660,577 A | 4/1987 | Sensabaugh et al. |
| 4,676,259 A | 6/1987 | Ellis et al. |
| 4,732,856 A | 3/1988 | Federoff |
| 4,762,785 A | 8/1988 | Comai |
| 4,821,749 A | 4/1989 | Toft et al. |
| 4,830,028 A | 5/1989 | Lawson et al. |
| 4,848,373 A | 7/1989 | Lenkey |
| 4,898,188 A | 2/1990 | Niven, Jr. et al. |
| 4,945,050 A | 7/1990 | Sanford et al. |
| 4,967,771 A | 11/1990 | Fagg et al. |
| 4,987,907 A | 1/1991 | Townend |
| 5,004,863 A | 4/1991 | Umbeck |
| 5,013,658 A | 5/1991 | Dooner et al. |
| 5,015,741 A | 5/1991 | Osdene et al. |
| 5,018,540 A | 5/1991 | Grubbs et al. |
| 5,025,812 A | 6/1991 | Fagg et al. |
| 5,031,646 A | 7/1991 | Lippiello et al. |
| 5,050,621 A | 9/1991 | Creighton et al. |
| 5,065,775 A | 11/1991 | Fagg |
| 5,104,310 A | 4/1992 | Saltin |
| 5,119,835 A | 6/1992 | Heemann et al. |
| 5,138,062 A | 8/1992 | Osdene et al. |
| 5,141,131 A | 8/1992 | Miller, Jr. et al. |
| 5,149,645 A | 9/1992 | Hoekema et al. |
| 5,159,135 A | 10/1992 | Umbeck |
| 5,177,010 A | 1/1993 | Goldman et al. |
| 5,231,019 A | 7/1993 | Paszkowski et al. |
| 5,260,205 A | 11/1993 | Nalcatani et al. |
| 5,285,798 A | 2/1994 | Banerjee et al. |
| 5,369,023 A | 11/1994 | Nakatani et al. |
| 5,372,149 A | 12/1994 | Roth et al. |
| 5,463,174 A | 10/1995 | Moloney et al. |
| 5,464,763 A | 11/1995 | Schilperoort et al. |
| 5,479,948 A | 1/1996 | Counts et al. |
| 5,491,081 A | 2/1996 | Webb |
| 5,497,792 A | 3/1996 | Prasad et al. |
| 5,563,055 A | 10/1996 | Townsend et al. |
| 5,589,367 A | 12/1996 | Donson et al. |
| 5,659,026 A | 8/1997 | Baszczynski et al. |
| 5,665,262 A | 9/1997 | Hajaligol et al. |
| 5,666,976 A | 9/1997 | Adams et al. |
| 5,666,977 A | 9/1997 | Higgins et al. |
| 5,666,987 A | 9/1997 | Combs |
| 5,668,295 A | 9/1997 | Wahab et al. |
| 5,684,241 A | 11/1997 | Nalcatani et al. |
| 5,689,035 A | 11/1997 | Webb |
| 5,713,376 A | 2/1998 | Berger |
| 5,814,618 A | 9/1998 | Bujard et al. |
| 5,866,785 A | 2/1999 | Donson et al. |
| 5,879,918 A | 3/1999 | Tomes et al. |
| 5,880,164 A | 3/1999 | Keenan |
| 5,889,190 A | 3/1999 | Donson et al. |
| 5,889,191 A | 3/1999 | Turpen |
| 5,932,782 A | 8/1999 | Bidney |
| 5,981,840 A | 11/1999 | Zhao et al. |
| 6,072,050 A | 6/2000 | Bowen et al. |
| 6,153,119 A | 11/2000 | Sung |
| 6,423,520 B1 | 7/2002 | Conkling et al. |
| 6,586,661 B1 | 7/2003 | Conkling et al. |
| 6,694,985 B1 | 2/2004 | Kim |
| 6,761,176 B2 | 8/2004 | Sun |
| 6,772,769 B2 | 8/2004 | Sun |
| 6,907,887 B2 * | 6/2005 | Conkling .............. A24B 15/10 131/270 |
| 6,911,541 B2 | 6/2005 | Conkling et al. |
| 6,959,712 B2 | 11/2005 | Bereman et al. |
| 7,025,067 B2 | 4/2006 | Chatterjee |
| 7,192,771 B2 | 3/2007 | Conkling et al. |
| 7,238,861 B2 | 7/2007 | Kasulcabe et al. |
| 7,293,564 B2 | 11/2007 | Perfetti et al. |
| 7,304,220 B2 | 12/2007 | Conkling et al. |
| 7,408,098 B2 | 8/2008 | Conkling et al. |
| 7,425,670 B2 | 9/2008 | Conkling et al. |
| 7,446,242 B2 | 11/2008 | Kasukabe et al. |
| 7,538,071 B2 | 5/2009 | Berger |
| 7,605,308 B2 | 10/2009 | Conkling et al. |
| 7,645,925 B2 | 1/2010 | Conkling et al. |
| 7,665,470 B2 | 2/2010 | Mallmann et al. |
| 7,665,471 B2 | 2/2010 | Mallmann et al. |
| 7,665,472 B2 | 2/2010 | Mallmann et al. |
| 7,667,104 B2 | 2/2010 | Mallmann et al. |
| 7,667,105 B2 | 2/2010 | Mallmann et al. |
| 7,667,106 B2 | 2/2010 | Mallmann et al. |
| 7,700,834 B2 | 4/2010 | Xu et al. |
| 7,795,503 B2 | 9/2010 | Apuya et al. |
| 7,795,509 B2 | 9/2010 | Colliding et al. |
| 7,847,163 B2 | 12/2010 | Mallmann et al. |
| 7,847,164 B2 | 12/2010 | Mallmann et al. |
| 7,847,165 B2 | 12/2010 | Mallmann et al. |
| 7,888,554 B2 | 2/2011 | Kasukabe et al. |
| 8,410,341 B2 | 4/2013 | Page et al. |
| 8,624,083 B2 | 1/2014 | Page et al. |
| 8,759,101 B2 | 6/2014 | Timko et al. |
| 8,791,329 B2 | 7/2014 | Hashimoto et al. |
| 8,822,757 B2 | 9/2014 | Page et al. |
| 8,871,999 B2 | 10/2014 | Howe et al. |
| 8,887,737 B2 | 11/2014 | Howell et al. |
| 8,895,472 B2 | 11/2014 | Yang et al. |
| 8,980,633 B2 | 3/2015 | Timko et al. |
| 8,987,555 B2 | 3/2015 | Hashimoto et al. |
| 9,004,073 B2 | 4/2015 | Tucker et al. |
| 9,004,074 B2 | 4/2015 | Nauryzbaev et al. |
| 9,022,040 B2 | 5/2015 | Murphy |
| 9,029,656 B2 | 5/2015 | Hashimoto et al. |
| 9,102,948 B2 | 8/2015 | Hashimoto et al. |
| 9,121,030 B2 | 9/2015 | Page et al. |
| 9,133,468 B2 | 9/2015 | Page et al. |
| 9,139,841 B2 | 9/2015 | Fernández et al. |
| 9,150,872 B2 | 10/2015 | Page et al. |
| 9,157,089 B2 | 10/2015 | Page et al. |
| 9,157,090 B2 | 10/2015 | Page et al. |
| 9,175,052 B2 | 11/2015 | Gemrdi et al. |
| 9,175,302 B2 | 11/2015 | Page et al. |
| 9,234,205 B2 | 1/2016 | Hatzfeld |
| 9,422,346 B2 | 8/2016 | Noguchi et al. |
| 9,422,532 B2 | 8/2016 | Page et al. |
| 9,422,533 B2 | 8/2016 | Page et al. |
| 9,439,452 B2 | 9/2016 | Albino et al. |
| 9,462,754 B2 | 10/2016 | Scott et al. |
| 9,551,003 B2 | 1/2017 | Hashimoto et al. |
| 9,554,595 B2 | 1/2017 | Buchberger |
| 9,580,722 B2 | 2/2017 | Qu et al. |
| 9,677,083 B2 | 6/2017 | Timko et al. |
| 9,701,978 B2 | 7/2017 | Timko et al. |
| 9,719,103 B2 | 8/2017 | Hashimoto et al. |
| 9,732,350 B2 | 8/2017 | Page et al. |
| 9,752,156 B2 | 9/2017 | Page et al. |
| 9,796,984 B2 | 10/2017 | Howe et al. |
| 9,814,258 B2 | 11/2017 | Pandolfino |
| 9,834,780 B2 | 12/2017 | Hashimoto et al. |
| 9,856,487 B2 | 1/2018 | Hashimoto et al. |
| 9,879,272 B2 | 1/2018 | Page et al. |
| 2002/0108151 A1 | 8/2002 | Conkling et al. |
| 2003/0018997 A1 | 1/2003 | Conkling et al. |
| 2003/0131857 A1 | 7/2003 | Kim et al. |
| 2003/0140366 A1 | 7/2003 | Conkling et al. |
| 2003/0200975 A1 | 10/2003 | Rosen et al. |
| 2004/0094170 A1 | 5/2004 | Zho et al. |
| 2004/0103454 A1 | 5/2004 | Conkling et al. |
| 2004/0118422 A1 | 6/2004 | Lundin et al. |
| 2004/0144397 A1 | 7/2004 | Conkling |
| 2004/0168211 A1 | 8/2004 | Conkling et al. |
| 2005/0000531 A1 | 1/2005 | Shi |
| 2005/0072047 A1 | 4/2005 | Conkling et al. |
| 2005/0161056 A1 | 7/2005 | Conkling |
| 2005/0178398 A1 | 8/2005 | Breslin et al. |

(56) References Cited

U.S. PATENT DOCUMENTS

| | | |
|---|---|---|
| 2005/0263165 A1 | 12/2005 | Oh et al. |
| 2005/0263166 A1 | 12/2005 | Oh et al. |
| 2006/0057723 A1 | 3/2006 | Conkling et al. |
| 2006/0060211 A1 | 3/2006 | Conkling |
| 2006/0191035 A1 | 8/2006 | Conkling et al. |
| 2006/0191036 A1 | 8/2006 | Conkling et al. |
| 2006/0191039 A1 | 8/2006 | Conkling et al. |
| 2006/0191547 A1 | 8/2006 | Conkling |
| 2006/0191548 A1 | 8/2006 | Strickland et al. |
| 2006/0191549 A1 | 8/2006 | Conkling |
| 2006/0195936 A1 | 8/2006 | Conkling et al. |
| 2006/0200872 A1 | 9/2006 | Conkling et al. |
| 2006/0225154 A1 | 10/2006 | Kasulcabe et al. |
| 2006/0236434 A1 | 10/2006 | Conkling et al. |
| 2006/0242730 A1 | 10/2006 | Conkling et al. |
| 2006/0243290 A1 | 11/2006 | Reich et al. |
| 2007/0011774 A1 | 1/2007 | Conkling et al. |
| 2007/0016975 A1 | 1/2007 | Conkling et al. |
| 2007/0034220 A1 | 2/2007 | Pandolfino |
| 2007/0240728 A1 | 10/2007 | Hashimoto et al. |
| 2008/0120737 A1 | 5/2008 | Hashimoto et al. |
| 2008/0292735 A1 | 11/2008 | Hashimoto et al. |
| 2009/0031457 A1 | 1/2009 | Howe et al. |
| 2009/0055964 A1 | 2/2009 | Gelesko et al. |
| 2009/0114235 A1 | 5/2009 | Mallmann et al. |
| 2009/0117212 A1 | 5/2009 | Mallmann et al. |
| 2009/0119788 A1 | 5/2009 | Mallmann et al. |
| 2009/0119789 A1 | 5/2009 | Mallmann et al. |
| 2009/0119790 A1 | 5/2009 | Mallmann et al. |
| 2009/0119791 A1 | 5/2009 | Mallmann et al. |
| 2009/0119806 A1 | 5/2009 | Mallmann et al. |
| 2009/0210958 A1 | 8/2009 | Page et al. |
| 2010/0132063 A1 | 5/2010 | Mallmann et al. |
| 2010/0132064 A1 | 5/2010 | Mallmann et al. |
| 2010/0138949 A1 | 6/2010 | Mallmann et al. |
| 2011/0126322 A1 | 5/2011 | Fernandez et al. |
| 2013/0048001 A1 | 2/2013 | Williams |
| 2013/0309749 A1 | 11/2013 | Page et al. |
| 2013/0318661 A1 | 11/2013 | Page et al. |
| 2014/0271733 A1 | 9/2014 | Kobal et al. |
| 2014/0298535 A1 | 10/2014 | Page et al. |
| 2015/0082484 A1 | 3/2015 | Howe et al. |
| 2015/0173319 A1 | 6/2015 | Frederick et al. |
| 2015/0203859 A1 | 7/2015 | Page et al. |
| 2015/0218575 A1 | 8/2015 | Hashimoto et al. |
| 2015/0322451 A1 | 11/2015 | Kidithipudi et al. |
| 2016/0002649 A1 | 1/2016 | Kidithipudi et al. |
| 2016/0017359 A1 | 1/2016 | Hatzfeld |
| 2016/0032299 A1 | 2/2016 | Hashimoto et al. |
| 2016/0050968 A1 | 2/2016 | Williams |
| 2016/0060645 A1 | 3/2016 | Page et al. |
| 2016/0060646 A1 | 3/2016 | Page et al. |
| 2016/0073675 A1 | 3/2016 | Page et al. |
| 2016/0032298 A1 | 4/2016 | Hashimoto et al. |
| 2016/0130601 A1 | 5/2016 | Page et al. |
| 2016/0270435 A1 | 9/2016 | Benjak et al. |
| 2016/0362702 A1 | 12/2016 | de Bont et al. |
| 2016/0374387 A1 | 12/2016 | Adams et al. |
| 2017/0009249 A1 | 1/2017 | Goossens et al. |
| 2017/0044564 A1 | 2/2017 | Page et al. |
| 2017/0055566 A1 | 3/2017 | Albino et al. |
| 2017/0079322 A1 | 3/2017 | Li et al. |
| 2017/0137835 A1 | 5/2017 | Qu et al. |
| 2017/0145432 A1 | 5/2017 | Hashimoto et al. |
| 2017/0166913 A1 | 6/2017 | Hashimoto et al. |
| 2017/0231267 A1 | 8/2017 | Shi et al. |
| 2017/0306341 A1 | 10/2017 | Timko et al. |
| 2017/0321223 A1 | 11/2017 | Page et al. |
| 2018/0049477 A1 | 2/2018 | Suzuki et al. |

FOREIGN PATENT DOCUMENTS

| | | |
|---|---|---|
| CN | 1088763 A | 7/1994 |
| CN | 1147354 A | 4/1997 |
| CN | 1214890 A | 4/1999 |
| CN | 1271550 A | 11/2000 |
| CN | 1374045 A | 10/2002 |
| CN | 1457709 | 11/2003 |
| CN | 1465300 A | 1/2004 |
| CN | 1511550 A | 7/2004 |
| CN | 1545950 A | 11/2004 |
| CN | 1676502 | 10/2005 |
| CN | 1923063 A | 3/2007 |
| CN | 101088425 A | 12/2007 |
| CN | 101116534 A | 2/2008 |
| CN | 101177669 B | 5/2008 |
| CN | 101263926 A | 9/2008 |
| CN | 101288504 A | 10/2008 |
| CN | 101422277 B | 5/2009 |
| CN | 101434926 B | 5/2009 |
| CN | 101579147 B | 11/2009 |
| CN | 101824391 B | 9/2010 |
| CN | 102266118 B | 12/2011 |
| CN | 102423132 B | 4/2012 |
| CN | 102715636 B | 10/2012 |
| CN | 102845476 B | 1/2013 |
| CN | 102986439 A | 3/2013 |
| CN | 102993286 B | 3/2013 |
| CN | 102993287 B | 3/2013 |
| CN | 103004770 A | 4/2013 |
| CN | 103012571 B | 4/2013 |
| CN | 103012572 B | 4/2013 |
| CN | 103012573 B | 4/2013 |
| CN | 103014029 A | 4/2013 |
| CN | 103357382 B | 10/2013 |
| CN | 103584279 A | 2/2014 |
| CN | 104146347 B | 11/2014 |
| CN | 104172464 A | 12/2014 |
| CN | 104770859 A | 7/2015 |
| CN | 104783321 A | 7/2015 |
| CN | 104921286 A | 9/2015 |
| CN | 105230476 A | 1/2016 |
| CN | 105595404 A | 5/2016 |
| CN | 105602961 A | 5/2016 |
| CN | 105985912 A | 10/2016 |
| CN | 106350467 A | 1/2017 |
| CN | 106490673 A | 3/2017 |
| CN | 106577771 A | 4/2017 |
| CN | 106723347 A | 5/2017 |
| CN | 206197007 U | 5/2017 |
| CN | 106867665 A | 6/2017 |
| CN | 107149161 A | 9/2017 |
| CN | 107212458 A | 9/2017 |
| CN | 107228914 A | 10/2017 |
| CN | 107287171 A | 10/2017 |
| CN | 107384816 A | 11/2017 |
| CN | 107411161 A | 12/2017 |
| CN | 107478745 A | 12/2017 |
| CN | 107485673 A | 12/2017 |
| CN | 107488223 A | 12/2017 |
| CN | 107495463 A | 12/2017 |
| CN | 107505411 A | 12/2017 |
| CN | 206808656 U | 12/2017 |
| CN | 107557437 A | 1/2018 |
| CN | 107568785 A | 1/2018 |
| CN | 107640760 A | 1/2018 |
| CN | 106551421 B | 2/2018 |
| CN | 107692302 A | 2/2018 |
| CN | 206994425 U | 2/2018 |
| CN | 107760618 A | 3/2018 |
| CN | 107812005 A | 3/2018 |
| DE | 2506100 | 8/1975 |
| DE | 19826554 A1 | 12/1999 |
| DO | P2001000244 A | 12/2002 |
| EP | 280817 | 9/1988 |
| EP | 1180335 | 2/2002 |
| EP | 1238594 B1 | 9/2002 |
| EP | 1723860 A1 | 11/2006 |
| IN | 411CHE2013 | 9/2013 |
| IN | 04740MU2015 | 12/2015 |
| JP | H11137232 A | 5/1999 |
| JP | 3061889 U | 6/1999 |
| JP | H11225734 A | 8/1999 |
| JP | 2000093149 A | 4/2000 |

(56) References Cited

FOREIGN PATENT DOCUMENTS

| | | |
|---|---|---|
| JP | 2004113148 A | 4/2004 |
| JP | 2008048715 A | 3/2008 |
| JP | 2015077071 A | 4/2015 |
| KR | 100296868 B1 | 12/1998 |
| KR | 100217828 B1 | 9/1999 |
| KR | 20000021254 U | 12/2000 |
| KR | 20030076816 A | 9/2003 |
| KR | 20030091821 A | 12/2003 |
| KR | 20040072407 A | 8/2004 |
| KR | 100700977 B1 | 2/2005 |
| KR | 100727575 | 3/2005 |
| KR | 1020080082124 | 9/2008 |
| RU | 2289991 C1 | 12/2006 |
| RU | 2289996 C1 | 12/2006 |
| RU | 2289997 C1 | 12/2006 |
| RU | 2290044 C1 | 12/2006 |
| RU | 2290046 C1 | 12/2006 |
| RU | 2326554 C1 | 6/2008 |
| RU | 2326557 C1 | 6/2008 |
| RU | 2326564 C1 | 6/2008 |
| RU | 2326565 C1 | 6/2008 |
| RU | 2326566 C1 | 6/2008 |
| RU | 2326573 C1 | 6/2008 |
| RU | 153016 U1 | 6/2015 |
| RU | 2595986 C1 | 8/2016 |
| WO | WO1994028142 | 12/1994 |
| WO | WO1998056923 | 12/1998 |
| WO | WO2000067558 | 11/2000 |
| WO | WO2002018607 | 3/2002 |
| WO | WO2002100199 | 12/2002 |
| WO | WO2003078629 | 9/2003 |
| WO | WO2003079829 | 10/2003 |
| WO | WO 2004/041006 A1 | 5/2004 |
| WO | WO2005004646 | 1/2005 |
| WO | WO2006004480 | 1/2006 |
| WO | WO2006050313 | 5/2006 |
| WO | WO2007075027 A1 | 7/2007 |
| WO | WO2008008844 | 1/2008 |
| WO | WO2008020333 | 2/2008 |
| WO | WO2009061421 | 5/2009 |
| WO | WO2009061422 | 5/2009 |
| WO | WO2009061437 | 5/2009 |
| WO | WO2009063312 | 5/2009 |
| WO | WO2010004070 | 1/2010 |
| WO | WO 2011/027315 A1 | 3/2011 |
| WO | WO 2011/088180 A1 | 7/2011 |
| WO | WO2011102394 A1 | 8/2011 |
| WO | WO2014134354 | 9/2014 |
| WO | WO2014150926 | 9/2014 |
| WO | WO2015085299 | 6/2015 |
| WO | WO2015124620 | 8/2015 |
| WO | WO2015124799 A1 | 8/2015 |
| WO | WO2015157359 A1 | 10/2015 |
| WO | WO2016004193 | 1/2016 |
| WO | WO2016179356 A1 | 11/2016 |
| WO | WO2016210303 A1 | 12/2016 |
| WO | WO2017096254 A1 | 6/2017 |
| WO | WO2017097840 A1 | 6/2017 |
| WO | WO2018045140 A1 | 3/2018 |
| WO | WO 2018/237107 A1 | 12/2018 |

OTHER PUBLICATIONS

Christensen et al., "Maize polyubiquitin genes: structure, thermal perturbation of expression and transcript splicing, and promoter activity following transfer to protoplasts by electroporation," *Plant Mal Biol.*, 18:675-689 (1992).
Christensen et al., "Sequence analysis and transcriptional regulation by heat shock of polyubiquitin transcripts from maize," *Plant Mol Biol.*, 12(6):619-632 (1989).
Christou et al., "Stable Transformation of Soybean Callus by DNA-Coated Gold Particles," *Plant Physiol.*, 87:671-674 (1988).
Collins et al., "Determination of nicotine alkaloids in tobacco using the Autoanalyzer," *Tobacco Science*, 13:79-81 (1969).

Crossway et al., "Micromanipulation techniques in plant biotechnology," BioTechniques, 4:320-334 (1986).
D'Halluin et al., "Transgenic Maize Plants by Tissue Electroporation," *The Plant Cell*, 4:1495-1505 (1992).
Davis et al., "A combined automated procedure for the determination of reducing sugars and nicotine alkaloids in tobacco products using a new reducing sugar method," *Tobacco Science*, 20:139-144 (1976).
Davis et al., "4B Seedling Production," *Tobacco: Production, Chemistry and Technology*, pp. 70-103(1999).
De Wet et al., "Exogenous gene transfer in maize (*Zea mays*) using DNA-treated pollen," *Experimental Manipulation of Ovule Tissues*, pp. 197-209 (1985).
Estruch et al., "Transgenic plants: An emerging approach to pest control," *Nature Biotechnology* 15:137-141 (1997).
Fedoroff et al., "Cloning of the bronze locus in maize by a simple and generalizable procedure using the transposable controlling element Activator (Ac)," 81:3825-3829 (1984).
Finer et al., "Transformation of soybean via particle bombardment of embryogenic suspension culture tissue, " *In Vitro Cell Dev. Biol.* 27(4):175-182 (1991).
Gaj et al., "ZFN, TALEN and CRISPR/Cas-based methods for genome Engineering," *Trends Biotechnol.*, 31(7):397-405 (2013).
Gatz et al., "Regulation of a modified CaM V35S promoter by the Tn10-encoded Tet repressor in transgenic tobacco," *Mol Gen. Genet.* 227:229-237 (1991).
Hibi et al., "Gene Expression in Tobacco Low-Nicotine Mutants," *The Plant Cell*, 6:723-735 (1994).
Hibi et al., "Putrescine N-Methyltransferase in Cultured Roots of Hyoscyamus albus1: n-Butylamine as a Potent Inhibitor of the Transferase both in Vitro and in Vivo," *Plant Physiology* 100: 826-35 (1992).
Hildering et al., "Chimeric structure of the tomato plant after seed treatment with Ems and X-rays," *Radiation Botany*, pp. 317-320 (1965).
Hoekema et al., "A binary plant vector strategy based on separation of vir- and T-region of the *Agrobacterium turnefaciens* Ti-plasmid," *Nature*, 303:171-180 (1983).
Kaeppler et al., "Silicon carbide fiber-mediated DNA delivery into plant cells," *Plant Cell Reports*, 9:415-418(1990).
Kaeppler et al., "Silicon carbide fiber-mediated stable transformation of plant cells," *Theoretical and Applied Genetics*, 84(5):560-566 (1992).
Kidd et al., "The A and B loci in tobacco regulate a network of stress response genes, few of which are associated with nicotine biosynthesis," *Plant Mol Biol.*, 60(5):699-716 (2006).
Kosambi, "The estimation of map distance from recombinant values," *Annals of Eugenics*, 12:172-175 (1944).
Last et al., "An improved promoter for gene expression in cereal cells," *Theor. Appl. Genet.*, 81:581-588 (1991).
Legg et al., "Inheritance of percent total alkaloids in *Nicotiana tabacum* L.; populations derived from crosses of low alkaloid lines with burley and flue-cured varieties," *J Hered*, 60:213-217 (1969).
Legg et al., "Registration of La Burley 21 Tobacco Germplasm1," Crop Science, 10:212 (1970).
McCabe et al., "Stable transformation of soybean (Glycine max) by particle acceleration," *Biotechnology*, 6:923-926 (1988).
McCallum et al., "Targeted screening for induced mutations," *Nat. Biotechnol.*, 18:455-457 (2000).
McNellis et al., "Glucocorticoid-inducible expression of a bacterial avirulence gene in transgenic *Arabidopsis* induces hypersensitive cell death," *Plant J.* 14(2):247-257 (1998).
Miller et al., "A grade index for type 22 and 23 fire-cured tobacco." Tobacco International 192(22):55-57 (1990). Abstract retrieved from https://www.cabdirect.org/cabdirect/abstract/19910747272.
Morita et al., "Vacuolar transport of nicotine is mediated by a multidrug and toxic compound extrusion (MATE) transporter in Nicotiana tabacum," *Proc Natl Acad Sci*, 106:2447-2452 (2009).
Odell et al., "Identification of DNA sequences required for activity of the cauliflower mosaic virus 35S promoter," *Nature*, 313:810-812 (1985).
Paszkowski et al., "Direct gene transfer to plants," *EMBO J.*, 3(12):2717-2722 (1984).

(56) References Cited

OTHER PUBLICATIONS

Porta et al., "Use of viral replicons for the expression of genes in plants," *Molecular Biotechnology*, 5:209-221 (1996).
Reed et al., "The A and B of *Nicotiana tabacum* have non-equivalent effects on the mRNA levels of four alkaloid biosynthethic genes," *Plant Science*, 167:1123-1130 (2004).
Riggs et al., "Stable transformation of tobacco by electroporation: Evidence for plasmid concatenation," *Proc. Natl. Acad. Sci.*, 83:5602-5606 (1986).
Sanford et al., "Optimizing the biolistic process for different biological applications," *Methods Enzymol.*, 217:483-509 (1993).
Saunders el al., "Nicotine Biosynthetic Enzyme Activities in *Nicotiana tabacum* L. Genotypes withDifferent Alkaloid Levels," *Plant Physiol.*, 64:236-240 (1979).
Schena et al., "A steroid-inducible gene expression system for plant cells," *Proc. Natl. Acad. Sci.*, 88:10421-10425 ( 1991).
Sears et al., "NtERF32: a non-NIC2 locus AP2/ERF transcription factor required in jasmonate-inducible nicotine biosyntehsis in tobacco," *Plant Mol Biol*, 84:49-66 (2014).
Shillito et al., "Direct gene transfer to protoplasts of dicotyledonous and monocotyledonous plants by a number of methods, including electroporation," *Methods in Enzymology*, 153:313-336 (1987).
Shoji et al., "Clustered Transcription Factor Genes Regulate Nicotine Biosynthesis in Tobacco," *The Plant Cell*, 22:3390-3409 (2010).
Singh et al., "Cytological characterization of transgenic soybean," *Theor Appl Genet.* 96:319-324 (1998).
Todd et al., "A functional genomics screen identifies diverse transcription factors that regulate alkaloid biosynthesis in *Nicotiana benthamiana*," *The Plant J.* 62:589-600(2010).
Tomes et al., "Direct DNA Transfer into Intact Plant Cells Via Microprojectile Bombardment," *Plant Cell Tissue and Organ Culture*, pp. 197-213 (1995).
Velten et al., "Isolation of a dual plant promoter fragment from the Ti plasmid of *Agrobacterium tumefaciens*," *EMBO J*, 3:2723-2730 (1984).
Verkerk, "Chimerism of the tomato plant after seed irradiation with fast neutrons," *Neth. J. Agric. Sci.*, 19:197-203 (1971).
Welting et al., "Foreign Genes in Plants: Transfer, Structure, Expression, and Applications," *Ann. Rev. Genet.*, 22:421-477 (1988).
Wernsman et al., "Tobacco," *Crop Species*, 2:669-698 (1987).
Shoji et al. "Smoking Out the Masters: Transcriptional Regulators for Nicotine Biosynthesis in Tobacco" *Plant Biotech*, 30:217-224 (2013).
U.S. Appl. No. 62/616,959, filed Jan. 12, 2018, Adams et al.
U.S. Appl. No. 62/625,878, filed Feb. 2, 2018, Adams et al.
Albrecht et al., "Activation of olfactory and trigeminal cortical areas following stimulation of the nasal mucosa with low concentrations of S(−)-nicotine vapor-an fMRI study on chemosensory perception," *Human Brain Mapping* 30(3):699-710 (2009).
"Alkaloid Reduced Tobacco (ART) Program," Philip Morris USA (1994).
Cai et al., "(R)-nicotine biosynthesis, metabolism and translocation in tobacco as determined by nicotine demethylase mutants," *Phytochemistry* 95:188-96 (2013).
Chakrabarti et al., "CYP82E4-mediated nicotine to nornicotine conversion in tobacco is regulated by a senescence-specific signaling pathway," *Plant Molecular Biology* 66(4):415-27 (2008).
Drenan et al., "In Vivo Activation of Midbrain Dopamine Neurons via Sensitized, High-Affinity α6* Nicotinic Acetylcholine Receptors," *Neuron* 60(1):123-36 (2008).
Hashimoto et al., "Tropane Alkaloid Production in Hyoscyamus Root Cultures," *Journal of Plant Physiology* 124(1-2):61-75 (1986).
Hibi et al., "Gene Expression in Tobacco Low-Nicotine Mutants," *The Plant Cell* 6(5):723-735 (1994).
Hu et al., "Characterization of Pseudooxynicotine Amine Oxidase of Pseudomonas putida S16 that Is Crucial for Nicotine Degradation," *Scientific Reports* 5:17770 (2015).
Kajikawa et al., "A model for evolution and regulation of nicotine biosynthesis regulation in tobacco," *Plant Signaling & Behavior* 12(6):e1338225 (2017).

Kajikawa et al., "Genomic Insights into the Evolution of the Nicotine Biosynthesis Pathway in Tobacco," *Plant Physiology* 174(2):999-1011 (2017).
Kajikawa et al., "Vacuole-Localized Berberine Bridge Enzyme-Like Proteins are Required for a Late Step of Nicotine Biosynthesis in Tobacco," *Plant Physiology* 155(4):2010-22 (2011).
Kato et al., "Tobacco Nicotine Uptake Permease Regulates the Expression of a Key Transcription Factor Gene in the Nicotine Biosynthesis Pathway," *Plant Physiology* 166(4):2195-204 (2014).
Kidd et al., "The A and B loci in tobacco regulate a network of stress response genes, few of which are associated with nicotine biosynthesis," *Plant Molecular Biology* 60:699-716 (2006).
Legg et al., "Inheritance of Percent Total Alkaloids in *Nicotiana tabactem* L.," *The Journal of Heredity* 213-217 (1969).
Lewis et al., "Transgenic and Mutation-Based Suppression of a Berberine Bridge Enzyme-Like (BBL) Gene Family Reduces Alkaloid Content in Field-Grown Tobacco," *PloS One* 10(2):e0117273 (2015).
Liu et al., "Physiological and Biochemical Characterization of a Novel Nicotine-Degrading Bacterium Pseudomonas geniculata N1," *PloS One* 9(1):e84399 (2014).
Ma et al., "Alternative splicing of basic chitinase gene PR3b in the low-nicotine mutants of Nicotiana tabacum L. cv. Burley 21," *Journal of Experimental Botany* 67(19):5799-809 (2016).
McKinney et al., "Cigarettes with different nicotine levels affect sensory perception and levels of biomarkers of exposure in adult smokers," *Nicotine & Tobacco Research* 16(7):948-60 (2014).
Šarčević et al., "Long-term Genetic Improvement and Genetic Diversity of Croatian Flue-cured Tobacco (*Nicotiana tabacum* L.) Cultivars," *Crop Science* 53(1):112-20 (2013).
Sato et al., "Metabolic engineering of plant alkaloid biosynthesis," *Proceedings of the National Academy of Sciences* 98(1):367-72 (2001).
Saunders et al., "Nicotine Biosynthetic Enzyme Activities in *Nicotiana tabacum* L. Genotypes with Different Alkaloid Levels," *Plant Physiol* 64:236-240 (1979).
Shoji et al., "Clustered Transcription Factor Genes Regulate Nicotine Biosynthesis in Tobacco," *The Plant Cell* 22(10):3390-409 (2010).
Shoji et al., "Smoking out the masters: transcriptional regulators for nicotine biosynthesis in tobacco," *Plant Biotechnology* 30(3):217-24 (2013).
Shulleeta et al., U.S. Appl. Entitled: "Differentially Expressed Tobacco cDNAs and Their Use in Affecting Tobacco Alkaloid Levels in Tobacco," https://www.industrydocumentslibrary.ucsf.edu/tobacco/docs/#id=xfwc0076 (1992).
Sun et al., "Comparative Analysis on Chemical Components and Sensory Quality of Aging Flue-Cured Tobacco from Four Main Tobacco Areas of China," *Agricultural Sciences in China* 10(8):1222-31 (2011).
Takizawa et al., "A virus-induced gene silencing approach for the suppression of nicotine content in Nicotiana benthamiana," *Plant Biotechnology* 24(3):295-300 (2007).
Tang et al., "Systematic Unraveling of the Unsolved Pathway of Nicotine Degradation in Pseudomonas," *PLoS Genetics* 9(10):e1003923 (2013).
Teper et al., "Nicotine-Induced Dystonic Arousal Complex in a Mouse Line Harboring a Human Autosomal-Dominant Nocturnal Frontal Lobe Epilepsy Mutation," *Journal of Neuroscience* (38):10128-42 (2007).
Todd et al., "A functional genomics screen identifies diverse transcription factors that regulate alkaloid biosynthesis in *Nicotiana benthamiana*," the *Plant Jouranl* 62:589-600 (2010).
Wang, "Factors in Nicotine Biosynthesis in Tobacco," *Dissertation* (2011).
Wang et al., "Current status and prospects for the study of *Nicotiana* genomics, genetics, and nicotine biosynthesis genes," *Mol Genet Genomics* 290:11-21 (2015).
Yang et al., "Transcriptome Profiling Identified Multiple Jasmonate ZIM-Domain Proteins Involved in the Regulation of Alkaloid Biosynthesis in Tobacco BY-2 Cells," *Plant Molecular Biology Reporter* 33(1):153-66 (2015).

(56) References Cited

OTHER PUBLICATIONS

Notice of Observations filed by a Third Party dated Sep. 24, 2018 in corresponding European Application No. 16738293.6.
Chintanakorn, "An Antisense Approach to StudV the Role of Arginine Decarboxylase and Putrescine N-Methyltransferase in Alkaloid Metabolism in *Nicotiana tabacum* L.," School of Biological Sciences, Melbourne, Australia, (2002).

* cited by examiner

COMPOSITIONS AND METHODS FOR PRODUCING TOBACCO PLANTS AND PRODUCTS HAVING ALTERED ALKALOID LEVELS

The present application claims the benefit of U.S. provisional application No. 62/185,268 filed Jun. 26, 2015 (pending), U.S. provisional application No. 62/186,854, filed Jun. 30, 2015 (pending), U.S. provisional application No. 62/271,780, filed Dec. 28, 2015, and U.S. provisional application No. 62/335,772, filed May 13, 2016 (pending), all of which are hereby incorporated by reference in their entireties.

INCORPORATION OF SEQUENCE LISTING

A sequence listing contained in the file named "P34319US04.txt" which is 3,579,889 bytes (measured in MS-Windows®) and created on Jun. 24, 2016, comprising 127 nucleotide sequences and 37 amino acid sequences, is filed electronically herewith and incorporated by reference in its entirety.

FIELD

The present disclosure provides the identification of tobacco Nic1 locus. Also provided are tobacco plants with altered total alkaloid and nicotine levels and commercially acceptable leaf grade, their development via breeding or transgenic approaches, and production of tobacco products from these tobacco plants.

BACKGROUND

Four major alkaloids are found in tobacco: nicotine, nornicotine, anabasine, and anatabine. Nicotine is the predominant alkaloid, usually accounting for more than 90% of the total alkaloids in commercial tobacco cultivars. Nicotine biosynthesis occurs predominantly in tobacco roots. Tobacco plants then transport nicotine through the vascular bundle to leaves where nicotine is then stored in the vacuoles.

A variety of factors affect tobacco alkaloid levels including genotype, environment, fertilization, and agronomic practices (for example, nicotine production is stimulated by topping, wounding, and herbivore damage). Low-alkaloid traits initially found in strains of Cuban cigar tobacco varieties were introduced into cigarette varieties through a series of backcrosses. Low-alkaloid tobacco germplasm was subsequently registered in the genetic background of cultivar Burley 21 (Legg et al., *Crop Science*, 10:212 (1970)). Genetic studies using the low alkaloid Burley 21 (LA BU21) lines indicated that two unlinked loci contribute to nicotine levels in the tobacco leaf. These two loci are referred to as Nic1 and Nic2. The nic1 and nic2 mutations in LA BU21 are semidominant. They show dose-dependent effects on nicotine levels, with the effects of nic1 about 2.4 times stronger than those of nic2. Molecular characterization of Nic2 locus has been reported. The nic2 mutation was shown to contain a deletion of a cluster of transcription factor genes from the ethylene responsive factor (ERF) family.

Reducing total alkaloid content in tobacco can have many benefits. It can increase the value of tobacco as a biomass resource. Increases in nicotinic alkaloid in tobacco plants may play an important role in protecting plants against insects and herbivores.

Consistent with alkaloids' role in insect defense, LA BU21 was reported to be extremely susceptible to insect damage (Legg et al., *Crop Science*, 10:212 (1970)). A further study comparing isogenic lines of flue-cured tobacco with low total alkaloids percentage (approximately 0.20%) with their "normal" recurring parents (total alkaloids 1.85 to 2.70%) reported that yield, grade index, total N, and reducing sugar content in the low alkaloid lines were lower than in the normal flue-cured cultivars (Chaplin and Weeks, *Crop Science*, 16(3):416-18 (1976)).

There is a need to identify novel genes that regulate tobacco nicotine levels, and to develop tobacco plants and products that contain altered nicotine levels (e.g., reduced nicotine) while maintaining (if not making superior) tobacco leaf quality.

SUMMARY

In some aspects, the present disclosure provides tobacco plants, or part thereof, comprising a mutation in Nic1 locus, a mutation in Nic2 locus, or both, wherein the tobacco plant is capable of producing leaves having a USDA grade index value of 50 or more.

In other aspects, the present disclosure provides tobacco plants, or part thereof, comprising a mutation in Nic1 locus, a mutation in Nic2 locus, or both, wherein the tobacco plant is capable of producing leaves having a USDA grade index value comparable to that of a control plant when grown in similar growth conditions, wherein the control plant shares an essentially identical genetic background with the tobacco plant except the mutation.

In some aspects, the present disclosure further provides non-transgenic tobacco plants, or part thereof, comprising a nicotine level selected from the group consisting of less than 2.0%, wherein the tobacco plants are capable of producing leaves having a USDA grade index value of 50 or more.

In other aspects, the present disclosure also provides a tobacco plant, or part thereof, comprising a non-transgenic mutation, wherein the non-transgenic mutation reduces the nicotine level of the tobacco plant to about 20% or less of the nicotine level of a control plant when grown in similar growth conditions, wherein the tobacco plant is capable of producing leaves having a USDA grade index value comparable to the USDA grade index value of the control plant, and wherein the control plant shares an essentially identical genetic background with the tobacco plant except the non-transgenic mutation.

In some aspects, the present disclosure provides tobacco plants, or part thereof, comprising a mutation in Nic1 locus, a mutation in Nic2 locus, or both, wherein the tobacco plant comprise a similar level of one or more tobacco aroma compounds selected from the group consisting of 3-methylvaleric acid, valeric acid, isovaleric acid, a labdenoid, a cembrenoid, a sugar ester, and a reducing sugar, compared to a control tobacco plant when grown in similar growth conditions.

In other aspects, the present disclosure provides tobacco plants, or part thereof, comprising a mutation in Nic1 locus, wherein the mutation is absent from LA Burley 21. In some aspects, tobacco plants provided herein comprise a shorter chromosome deletion at Nic1 locus compared to LA Burley 21. In other aspects, tobacco plants provided herein comprise no deletion of a complete gene or a complete genic coding sequence in Nic1 locus.

In some aspects, the present disclosure provides tobacco plants, or part thereof, comprising one or more mutations within one or more genes comprising a sequence having at least 80% identity to a sequence selected from the group consisting of SEQ ID NOs: 9 to 28, 75 to 82, 86 to 100, 145, and fragments thereof. In some aspects, tobacco plants provided herein comprise one or more non-naturally existing mutant alleles at Nic1 locus which reduce or eliminate one or more gene activity from Nic1 or Nic2 locus. In some aspects, these mutant alleles result in lower nicotine levels.

In other aspects, the present disclosure provides tobacco plants, or part thereof, comprising one or more mutations within one or more genes comprising a coding sequence having at least 80% identity to a sequence selected from the group consisting of SEQ ID NOs: 29 to 48, 83, 101 to 115, 146, and fragments thereof.

In some aspects, the present disclosure provides tobacco plants, or part thereof, comprising one or more mutations within one or more genes encoding a polypeptide having at least 80% identity to a sequence selected from the group consisting of SEQ ID NOs: 49 to 68, 84, 116 to 130, 147, and fragments thereof.

In other aspects, the present disclosure provides tobacco plants, or part thereof, comprising a heterologous expression cassette comprising a Nic1 inhibitory sequence of a gene comprising a sequence having at least 80% identity to a sequence selected from the group consisting of SEQ ID NOs: 9 to 28, 75 to 82, 86 to 100, 145, and fragments thereof, wherein the inhibitory sequence is operably linked to a promoter that is functional in a plant cell, and wherein the inhibitory sequence has at least 90% sequence identity to a fragment of at least 21 nucleotides of the sequence having at least 80% identity to a sequence selected from the group consisting of SEQ ID NOs: 9 to 28, 75 to 82, 86 to 100, 145, and fragments thereof.

In other aspects, the present disclosure provides recombinant DNA constructs comprising a promoter that is functional in a tobacco cell and operably linked to a polynucleotide that encodes an RNA molecule capable of binding to an RNA encoding a polypeptide having an amino acid sequence at least 80% identical to an amino acid sequence selected from the group consisting of SEQ ID NOs: 49 to 68, 84, 116 to 130, 147, and fragments thereof, and wherein the RNA molecule suppresses the expression of the polypeptide.

In some aspects, the present disclosure provides recombinant DNA constructs comprising a promoter that is functional in a tobacco cell and operably linked to a polynucleotide that encodes a polypeptide having an amino acid sequence at least 80% identical to an amino acid sequence selected from the group consisting of SEQ ID NOs: 49 to 68, 84, 116 to 130, 147, and fragments thereof.

The present disclosure further provides cured tobacco, tobacco blends, tobacco products comprising plant material from tobacco plants, lines, varieties or hybrids disclosed herein.

The present disclosure also provides methods for breeding tobacco lines, cultivars, or varieties comprising a desirable level of total alkaloid or nicotine, e.g., low nicotine or nicotine free. In some aspects, the present disclosure provides a method of introgressing a low nicotine trait into a tobacco variety, the method comprising: (a) crossing a first tobacco variety comprising a low nicotine trait with a second tobacco variety without the low nicotine trait to produce one or more progeny tobacco plants; (b) genotyping the one or more progeny tobacco plants for a polymorphic marker linked to the low nicotine trait, wherein the polymorphic marker is in a chromosomal interval flanked by any two of polymorphic loci listed in Table 3 or flanked by any two of polymorphic loci listed in Table 4; and (c) selecting a progeny tobacco plant comprising the low nicotine trait.

In some aspects, the present disclosure provides a method of introgressing a low nicotine trait into a tobacco variety, the method comprising: (a) crossing a first tobacco variety comprising a low nicotine trait with a second tobacco variety without the low nicotine trait to produce one or more progeny tobacco plants; (b) genotyping the one or more progeny tobacco plants for a polymorphic marker linked to the low nicotine trait, wherein the polymorphic marker is within 20 cM of any one of polymorphic loci listed in Tables 3, 4, 16, and 17; and (c) selecting a progeny tobacco plant comprising the low nicotine trait. In one aspect, a polymorphic marker is a SNP marker selected from the group consisting of SEQ ID Nos. 131 to 144.

In other aspects, the present disclosure provides a method of selecting a tobacco plant having a low nicotine trait, the method comprising: (a) isolating nucleic acids from a collection of tobacco germplasm; (b) assaying the nucleic acids for one or more markers closely linked to Nic1 locus; and (c) selecting a tobacco plant having a low nicotine trait based on the marker assay.

BRIEF DESCRIPTION OF THE SEQUENCES

Figure 1:
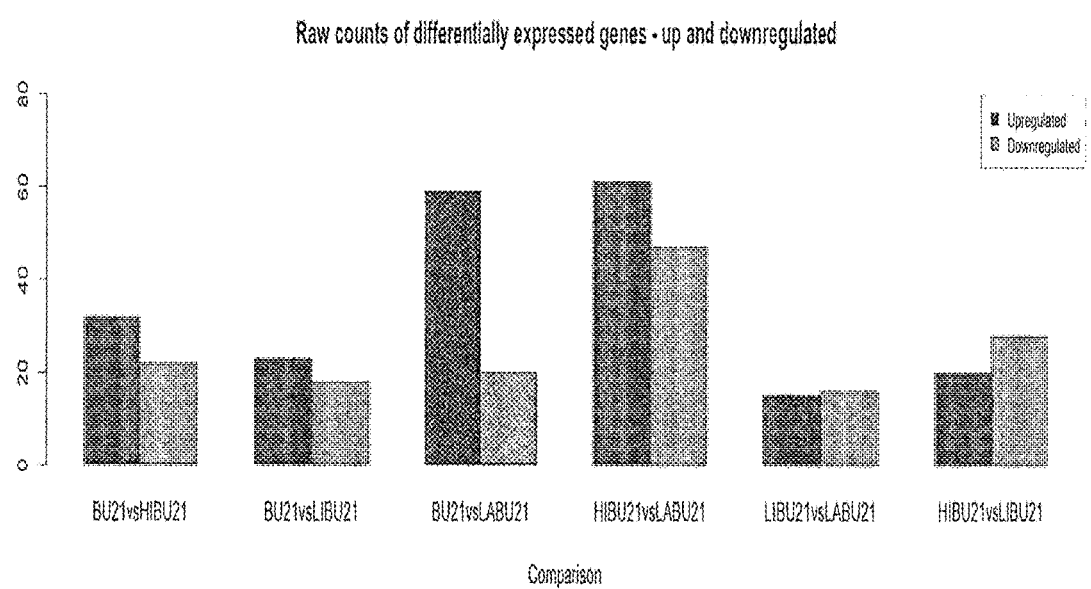
FIG. 1 shows the number of differentially regulated genes for each pairwise comparison within the group of BU21, HI BU21, LI BU21 and LA BU2.

SEQ ID No: 1 sets forth the sequence of a Nic1 associated deletion, Scaffold0002504, identified from LA BU21.

SEQ ID No: 2 sets forth the sequence of a Nic2 associated deletion, Scaffold0000549, identified from LA BU21.

SEQ ID Nos: 3 to 8 set forth primer sequences used for PCR confirmation of identified Nic1 and Nic2 deletions.

SEQ ID Nos: 9 to 28 set forth genomic sequences of 20 annotated genes in Nic1 associated deletion Scaffold0002504.

SEQ ID Nos: 29 to 48 set forth cDNA sequences of 20 annotated genes in Nic1 associated deletion Scaffold0002504.

SEQ ID Nos: 49 to 68 set forth amino acid sequences encoded by 20 annotated genes in Nic1 associated deletion Scaffold0002504.

SEQ ID Nos: 69 and 70 set forth exemplary transformation cassette sequences for suppressing g100614_Scaffold0002504 and g100631_Scaffold0002504 via RNA interference (RNAi).

SEQ ID Nos: 71 and 72 set forth reference TN90 alleles of sequence polymorphisms.

SEQ ID No: 73 sets forth the sequence of a tobacco genomic sequence assembly NT2.0-Scaffold4274 which comprises a re-sequenced segment of NT1.0-Scaffold0002504. Specifically, nucleotides 148796 to 282345 of NT2.0-Scaffold4274 correspond to and replace NT1.0-Scaffold0002504 between nucleotides 384701 to 542313 in the minus orientation.

SEQ ID No: 74 sets forth the sequence of a tobacco genomic sequence assembly NT2.0-Scaffold14415 which comprises a re-sequenced segment of NT1.0-Scaffold0002504. Specifically, nucleotides 1 to 59671 of NT2.0-Scaffold14415 correspond to and replace NT1.0-Scaffold0002504 between nucleotides 288601 to 363040 in the minus orientation.

SEQ ID Nos: 75 and 82 set forth re-sequenced and re-fined genomic sequences of eight annotated genes in Nic1 associated deletion.

SEQ ID Nos: 83 and 84 set forth further annotated cDNA and amino acid sequences of the gene in g100623_Scaffold0002504 based on re-sequencing.

SEQ ID No: 85 sets forth the genomic sequence of the complete Nic1 deletion region in LA BU21.

SEQ ID Nos: 86 to 100 set forth genomic sequences of 15 annotated genes in SEQ ID No: 85.

SEQ ID Nos: 101 to 115 set forth cDNA sequences of 15 annotated genes in SEQ ID No: 85.

SEQ ID Nos: 116 to 130 set forth protein sequences of 15 annotated genes in SEQ ID No: 85.

SEQ ID Nos: 131 to 142 set forth 12 SNP marker sequences flanking nic1 or nic2 deletion.

SEQ ID Nos: 143 and 144 set forth two SNP marker sequences associated with an ERF-39 like gene.

SEQ ID Nos: 145 to 147 set forth genomic, cDNA, and protein sequences of an ERF-39 like gene.

SEQ ID Nos: 148 to 164 set forth sequences of inverted repeat-containing RNAi cassettes targeting NDG1 to NDG15.

Various sequences disclosed herein include "N" in nucleotide sequences or "X" in amino acid sequences. "N" can be any nucleotide, e.g., A, T, G, C, or a deletion or insertion of one or more nucleotides. In some instant, a string of "N" are shown. The number of "N" does not necessarily correlate with the actual number of undetermined nucleotides at that position. The actual nucleotide sequences can be longer or shorter than the shown segment of "N". Similarly, "X" can be any amino acid residue or a deletion or insertion of one or more amino acids. Again, the number of "X" does not necessarily correlate with the actual number of undetermined amino acids at that position. The actual amino acid sequences can be longer or shorter than the shown segment of "X".

DETAILED DESCRIPTION

Unless defined otherwise, technical and scientific terms used herein have the same meaning as commonly understood by one of ordinary skill in the art. One skilled in the art will recognize many methods can be used in the practice of the present disclosure. Indeed, the present disclosure is in no way limited to the methods and materials described. For purposes of the present disclosure, the following terms are defined below.

Any references cited herein, including, e.g., all patents and publications are incorporated by reference in their entirety.

As used herein, the singular form "a," "an," and "the" include plural references unless the context clearly dictates otherwise. For example, the term "a compound" or "at least one compound" may include a plurality of compounds, including mixtures thereof.

The term "about" is used herein to mean approximately, roughly, around, or in the region of. When the term "about" is used in conjunction with a numerical range, it modifies that range by extending the boundaries above and below the numerical values set forth.

As used herein, a tobacco plant can be from any plant from the *Nicotiana* genus including, but not limited to *Nicotiana tabacum, Nicotiana amplexicaulis* PI 271989; *Nicotiana benthamiana* PI 555478; *Nicotiana bigelovii* PI 555485; *Nicotiana debneyi; Nicotiana excelsior* PI 224063; *Nicotiana glutinosa* PI 555507; *Nicotiana goodspeedii* PI 241012; *Nicotiana gossei* PI 230953; *Nicotiana hesperis* PI 271991; *Nicotiana knightiana* PI 555527; *Nicotiana maritima* PI 555535; *Nicotiana megalosiphon* PI 555536; *Nicotiana nudicaulis* PI 555540; *Nicotiana paniculata* PI 555545; *Nicotiana plumbaginifolia* PI 555548; *Nicotiana repanda* PI 555552; *Nicotiana rustica; Nicotiana suaveolens* PI 230960; *Nicotiana sylvestris* PI 555569; *Nicotiana tomentosa* PI 266379; *Nicotiana tomentosiformis*; and *Nicotiana trigonophylla* PI 555572.

In some aspects, the present disclosure provides tobacco plants, or part thereof, comprising a mutation in Nic1 locus, a mutation in Nic2 locus, or both, wherein the tobacco plant is capable of producing leaves having a USDA grade index value of 50 or more. In some aspects, tobacco plants disclosed herein are capable of producing leaves having a USDA grade index value selected from the group consisting of 55 or more, 60 or more, 65 or more, 70 or more, 75 or more, 80 or more, 85 or more, 90 or more, and 95 or more. In other aspects, tobacco plants disclosed herein are capable of producing leaves having a USDA grade index value comparable to that of a control plant when grown in similar growth conditions, wherein the control plant shares an essentially identical genetic background with the tobacco plant except the mutation. In further aspects, tobacco plants disclosed herein are capable of producing leaves having a USDA grade index value of at least about 65%, at least about 70%, at least about 75%, at least about 80%, at least about 85%, at least about 90%, at least about 95%, or at least about 98% of the USDA grade index value of a control plant when grown in similar growth conditions, wherein the control plant shares an essentially identical genetic background with the tobacco plant except the mutation. In further aspects, tobacco plants disclosed herein are capable of producing leaves having a USDA grade index value of between 65% and 130%, between 70% and 130%, between 75% and 130%, between 80% and 130%, between 85% and 130%, between 90% and 130%, between 95% and 130%, between 100% and 130%, between 105% and 130%, between 110% and 130%, between 115% and 130%, or between 120% and 130% of the USDA grade index value of the control plant. In further aspects, tobacco plants disclosed herein are capable of producing leaves having a USDA grade index value of between 70% and 125%, between 75% and 120%, between 80% and 115%, between 85% and 110%, or between 90% and 100% of the USDA grade index value of the control plant. In some aspects, tobacco plants disclosed herein comprise nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, wherein the control plant shares an essentially identical genetic background with the tobacco plant except the mutation. In other aspects, tobacco plants disclosed herein comprise a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%. In further aspects, tobacco plants disclosed herein further comprises a transgene or mutation directly suppressing the expression or activity of one or more genes encoding a product selected from the group consisting of PMT, MPO, QPT, BBL, A622, and MATE transporter.

In some aspects, the present disclosure provides tobacco plants, or part thereof, comprising a mutation in Nic1 locus, a mutation in Nic2 locus, or both, wherein the tobacco plant is capable of producing leaves having a USDA grade index value comparable to that of a control plant when grown in similar growth conditions, wherein the control plant shares an essentially identical genetic background with the tobacco plant except the mutation. In other aspects, tobacco plants disclosed herein are capable of producing leaves having a USDA grade index value selected from the group consisting of 55 or more, 60 or more, 65 or more, 70 or more, 75 or more, 80 or more, 85 or more, 90 or more, and 95 or more. In other aspects, tobacco plants disclosed herein are capable of producing leaves having a USDA grade index value selected from the group consisting of between 50 and 95, between 55 and 95, between 60 and 95, between 65 and 95, between 70 and 95, between 75 and 95, between 80 and 95, between 85 and 95, between 90 and 95, between 55 and 90, between 60 and 85, between 65 and 80, between 70 and 75, between 50 and 55, between 55 and 60, between 60 and 65, between 65 and 70, between 70 and 75, between 75 and 80, between 80 and 85, between 85 and 90, and between 90 and 95. In further aspects, tobacco plants disclosed herein are capable of producing leaves having a USDA grade index value of at least about 65%, at least about 70%, at least about 75%, at least about 80%, at least about 85%, at least about 90%, at least about 95%, or at least about 98% of the USDA grade index value of the control plant. In further aspects, tobacco plants disclosed herein are capable of producing leaves having a USDA grade index value of between 65% and 130%, between 70% and 130%, between 75% and 130%, between 80% and 130%, between 85% and 130%, between 90% and 130%, between 95% and 130%, between 100% and 130%, between 105% and 130%, between 110% and 130%, between 115% and 130%, or between 120% and 130% of the USDA grade index value of the control plant. In further aspects, tobacco plants disclosed herein are capable of producing leaves having a USDA grade index value of between 70% and 125%, between 75% and 120%, between 80% and 115%, between 85% and 110%, or between 90% and 100% of the USDA grade index value of the control plant. In other aspects, tobacco plants disclosed herein comprise nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of the control plant when grown in similar growth conditions. In other aspects, tobacco plants disclosed herein further comprises a transgene or mutation directly suppressing the expression or activity of one or more genes encoding a product selected from the group consisting of PMT, MPO, QPT, BBL, A622, and MATE transporter.

In some aspects, the present disclosure also provides a tobacco variety, cultivar, or line comprising a mutation selected from the group consisting of a nic1 mutation, a nic2 mutation, and a combination thereof, wherein the tobacco variety, cultivar, or line has a leaf grade comparable to the leaf grade of a control tobacco variety, cultivar, or line when grown in similar growth conditions, wherein the control tobacco variety shares an essentially identical genetic background with the tobacco variety, cultivar, or line except the mutation.

In some aspects, the present disclosure further provides non-transgenic tobacco plants, or part thereof, comprising a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%, wherein the tobacco plants are capable of producing leaves having a USDA grade index value of 50 or more 55 or more, 60 or more, 65 or more, 70 or more, 75 or more, 80 or more, 85 or more, 90 or more, and 95 or more. In other aspects, such non-transgenic tobacco plants comprise a nicotine level of less than 2.0% and are capable of producing leaves having a USDA grade index value of 70 or more. In furthers aspects, such non-transgenic tobacco plants comprise a nicotine level of less than 1.0% and are capable of producing leaves having a USDA grade index value of 70 or more.

In some aspects, the present disclosure also provides a tobacco plant, or part thereof, comprising a non-transgenic mutation, wherein the non-transgenic mutation reduces the nicotine level of the tobacco plant to below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, wherein the tobacco plant is capable of producing leaves having a USDA grade index value comparable to the USDA grade index value of the control plant, and wherein the control plant shares an essentially identical genetic background with the tobacco plant except the non-transgenic mutation.

In some aspects, the present disclosure provides tobacco plants, or part thereof, comprising a mutation in Nic1 locus, wherein the mutation is absent from LA Burley 21. In some aspects, tobacco plants provided herein comprise a shorter chromosome deletion at Nic1 locus compared to LA Burley 21. In other aspects, tobacco plants provided herein comprise no deletion of a complete gene or a complete genic coding sequence in Nic1 locus. In some aspects, tobacco plants provided herein are homozygous at Nic1 locus. In other aspects, tobacco plants provided herein are heterozygous at Nic1 locus. In some aspects, tobacco plants provided herein comprise a Nic1 mutation selected from the group consisting of a point mutation, a deletion, an insertion, a duplication, and an inversion. In some aspects, Nic1 mutations in the tobacco plants provided herein are introduced by an approach selected from the group consisting of random mutagenesis and targeted mutagenesis. In other aspects, Nic1 mutations in the tobacco plants provided herein are introduced by a targeted mutagenesis approach selected from the group consisting of meganuclease, zinc finger nuclease, TALEN, and CRISPR.

In some aspects, tobacco plants provided herein comprise one or more mutations within one or more genes comprising a sequence having at least 80%, at least 85%, at least 90%, at least 95%, at least 97%, at least 98%, at least 99%, or 100% identity to a sequence selected from the group consisting of SEQ ID NOs: 9 to 28, 75 to 82, 86 to 100, 145, and fragments thereof. In some aspects, one or more mutations reduce the expression or activity of one or more genes comprising a sequence having at least 80%, at least 85%, at least 90%, at least 95%, at least 97%, at least 98%, at least 99%, or 100% identity to a sequence selected from the group consisting of SEQ ID NOs: 9 to 28, 75 to 82, 86 to 100, 145, and fragments thereof.

In some aspects, tobacco plants provided herein comprise one or more mutations within one or more genes comprising a coding sequence having at least 80%, at least 85%, at least 90%, at least 95%, at least 97%, at least 98%, at least 99%, or 100% identity to a sequence selected from the group consisting of SEQ ID NOs: 29 to 48, 83, 101 to 115, 146, and fragments thereof. In some aspects, one or more mutations reduce the expression or activity of one or more genes comprising a coding sequence having at least 80%, at least 85%, at least 90%, at least 95%, at least 97%, at least 98%, at least 99%, or 100% identity to a sequence selected from the group consisting of SEQ ID NOs: 29 to 48, 83, 101 to 115, 146, and fragments thereof.

In some aspects, tobacco plants provided herein comprise one or more mutations within one or more genes encoding a polypeptide having at least 80%, at least 85%, at least 90%, at least 95%, at least 97%, at least 98%, at least 99%, or 100% identity to a sequence selected from the group consisting of SEQ ID NOs: 49 to 68, 84, 116 to 130, 147 and fragments thereof. In some aspects, one or more mutations reduce the expression or activity of one or more genes encoding a polypeptide having at least 80%, at least 85%, at least 90%, at least 95%, at least 97%, at least 98%, at least 99%, or 100% identity to a sequence selected from the group consisting of SEQ ID NOs: 49 to 68, 84, 116 to 130, 147 and fragments thereof.

In some aspects, tobacco plants provided herein comprise one or more mutations within one or more genes comprising a sequence having at least 80%, at least 85%, at least 90%, at least 95%, at least 97%, at least 98%, at least 99%, or 100% identity to a sequence selected from the group consisting of SEQ ID NOs: 13, 28, 33, 48, 82, 86, 87, 101, 102, 145, and 146, and fragments thereof. In some aspects, one or more mutations reduce the expression or activity of one or more genes comprising a sequence having at least 80%, at least 85%, at least 90%, at least 95%, at least 97%, at least 98%, at least 99%, or 100% identity to a sequence selected from the group consisting of SEQ ID NOs: 13, 28, 33, 48, 82, 86, 87, 101, 102, 145, and 146, and fragments thereof.

In some aspects, tobacco plants provided herein comprise one or more mutations within one or more genes comprising a coding sequence having at least 80%, at least 85%, at least 90%, at least 95%, at least 97%, at least 98%, at least 99%, or 100% identity to a sequence selected from the group consisting of SEQ ID NOs: 33, 48, 101, 102, and 146, and fragments thereof. In some aspects, one or more mutations reduce the expression or activity of one or more genes comprising a coding sequence having at least 80%, at least 85%, at least 90%, at least 95%, at least 97%, at least 98%, at least 99%, or 100% identity to a sequence selected from the group consisting of SEQ ID NOs: 33, 48, 101, 102, and 146, and fragments thereof.

In some aspects, tobacco plants provided herein comprise one or more mutations within one or more genes encoding a polypeptide having at least 80%, at least 85%, at least 90%, at least 95%, at least 97%, at least 98%, at least 99%, or 100% identity to a sequence selected from the group consisting of SEQ ID NOs: 53, 68, 116, 117, and 147, and fragments thereof. In some aspects, one or more mutations reduce the expression or activity of one or more genes encoding a polypeptide having at least 80%, at least 85%, at least 90%, at least 95%, at least 97%, at least 98%, at least 99%, or 100% identity to a sequence selected from the group consisting of SEQ ID NOs: 53, 68, 116, 117, and 147, and fragments thereof.

LA Burley 21 is a low total alkaloid tobacco line produced by incorporation of a low alkaloid gene(s) from a Cuban cigar variety into Burley 21 through several backcrosses (Legg et al. 1970). It has approximately 0.2% total alkaloids (dry weight) compared to the about 3.5% (dry weight) of its parent, Burley 21. LA BU21 has a leaf grade well below commercially acceptable standards.

Unless specified otherwise, measurements of alkaloid or nicotine levels or leaf grade index values mentioned herein for a tobacco plant, variety, cultivar, or line refer to average measurements, including, for example, an average of multiple leaves of a single plant or an average measurement from a population of tobacco plants from a single variety, cultivar, or line. A population of tobacco plants or a collection of tobacco leaves for determining an average measurement (e.g., alkaloid or nicotine level or leaf grading) can be of any size, for example, 5, 10, 15, 20, 25, 30, 35, 40, or 50. Industry-accepted standard protocols are followed for determining average measurements or grad index values.

As used herein, "similar growth conditions" refer to similar environmental conditions and/or agronomic practices for growing and making meaningful comparisons between two or more plant genotypes so that neither environmental conditions nor agronomic practices would contribute to or explain any difference observed between the two or more plant genotypes. Environmental conditions include, for example, light, temperature, water (humidity), and nutrition (e.g., nitrogen and phosphorus). Agronomic practices include, for example, seeding, clipping, undercutting, transplanting, topping, and suckering. See Chapters 4B and 4C of Tobacco, Production, Chemistry and Technology, Davis & Nielsen, eds., Blackwell Publishing, Oxford (1999), pp 70-103.

"Alkaloids" are complex, nitrogen-containing compounds that naturally occur in plants, and have pharmacological effects in humans and animals. "Nicotine" is the primary natural alkaloid in commercialized cigarette tobacco and accounts for about 90 percent of the alkaloid content in *Nicotiana tabacum*. Other major alkaloids in tobacco include cotinine, nornicotine, myosmine, nicotyrine, anabasine and anatabine. Minor tobacco alkaloids include nicotine-n-oxide, N-methyl anatabine, N-methyl anabasine, pseudooxynicotine, 2,3 dipyridyl and others.

In some aspects, tobacco plants provided herein comprise a lower level of total alkaloid or an individual alkaloid compared to a control tobacco plant without a Nic1 mutation when grown in similar growth conditions. In other aspects, tobacco plants provided herein comprise a lower level of one or more alkaloids selected from the group consisting of cotinine, nornicotine, myosmine, nicotyrine, anabasine and anatabine, compared to a control tobacco plant when grown in similar growth conditions. In some aspects, a lower alkaloid level refers to an alkaloid level of below 1%, below 2%, below 5%, below 8%, below 10%, below 12%, below 15%, below 20%, below 25%, below 30%, below 40%, below 50%, below 60%, below 70%, or below 80% of the alkaloid level of a control tobacco plant. In other aspects, a lower alkaloid level refers to an alkaloid level of about between 0.5% and 1%, between 1% and 2%, between 2% and 3%, between 3% and 4%, between 4% and 5%, between 5% and 6%, between 6% and 7%, between 7% and 8%, between 8% and 9%, between 9% and 10%, between 11% and 12%, between 12% and 13%, between 13% and 14%, between 14% and 15%, between 15% and 16%, between 16% and 17%, between 17% and 18%, between 18% and 19%, between 19% and 20%, between 21% and 22%, between 22% and 23%, between 23% and 24%, between 24% and 25%, between 25% and 26%, between 26% and 27%, between 27% and 28%, between 28% and 29%, or between 29% and 30% of the alkaloid level of a control tobacco plant. In further aspects, a lower alkaloid level refers to an alkaloid level of about between 0.5% and 5%, between 5% and 10%, between 10% and 20%, between 20% and 30% of the alkaloid level of a control tobacco plant.

Alkaloid levels can be assayed by methods known in the art, for example by quantification based on gas-liquid chromatography, high performance liquid chromatography, radio-immunoassays, and enzyme-linked immunosorbent assays. For example, nicotinic alkaloid levels can be measured by a GC-FID method based on CORESTA Recommended Method No. 7, 1987 and ISO Standards (ISO TC 126N 394 E. See also Hibi et al., *Plant Physiology* 100: 826-35 (1992) for a method using gas-liquid chromatography equipped with a capillary column and an FID detector.

Alternatively, tobacco total alkaloids can be measured using a segmented-flow colorimetric method developed for analysis of tobacco samples as adapted by Skalar Instrument Co (West Chester, Pa.) and described by Collins et al., *Tobacco Science* 13:79-81 (1969). In short, samples of tobacco are dried, ground, and extracted prior to analysis of total alkaloids and reducing sugars. The method then employs an acetic acid/methanol/water extraction and charcoal for decolorization. Determination of total alkaloids was based on the reaction of cyanogen chloride with nicotine alkaloids in the presence of an aromatic amine to form a colored complex which is measured at 460 nm. Unless specified otherwise, total alkaloid levels or nicotine levels shown herein are on a dry weight basis (e.g., percent total alkaloid or percent nicotine).

In some aspects, tobacco plants provided herein comprise a lower level of nicotine compared to a control tobacco plant without a Nic1 mutation when grown in similar growth conditions. In some aspects, a lower nicotine level refers to an average nicotine level of below 1%, below 2%, below 5%, below 8%, below 10%, below 12%, below 15%, below 20%, below 25%, below 30%, below 40%, below 50%, below 60%, below 70%, or below 80% of the average nicotine level of a control tobacco plant. In other aspects, a lower nicotine level refers to an average nicotine level of about between 0.5% and 1%, between 1% and 2%, between 2% and 3%, between 3% and 4%, between 4% and 5%, between 5% and 6%, between 6% and 7%, between 7% and 8%, between 8% and 9%, between 9% and 10%, between 11% and 12%, between 12% and 13%, between 13% and 14%, between 14% and 15%, between 15% and 16%, between 16% and 17%, between 17% and 18%, between 18% and 19%, between 19% and 20%, between 21% and 22%, between 22% and 23%, between 23% and 24%, between 24% and 25%, between 25% and 26%, between 26% and 27%, between 27% and 28%, between 28% and 29%, or between 29% and 30% of the average nicotine level of a control tobacco plant. In further aspects, a lower nicotine level refers to an average nicotine level of about between 0.5% and 5%, between 5% and 10%, between 10% and 20%, between 20% and 30% of the average nicotine level of a control tobacco plant.

In some aspects, tobacco plants provided herein comprise an average nicotine level selected from the group consisting of about 0.01%, 0.02%, 0.05%, 0.75%, 0.1%, 0.15%, 0.2%, 0.3%, 0.35%, 0.4%, 0.5%, 0.6%, 0.7%, 0.8%, 0.9%, 1%, 1.1%, 1.2%, 1.3%, 1.4%, 1.5%, 1.6%, 1.7%, 1.8%, 1.9%, 2%, 2.1%, 2.2%, 2.3%, 2.4%, 2.5%, 2.6%, 2.7%, 2.8%, 2.9%, 3%, 3.1%, 3.2%, 3.3%, 3.4%, 3.5%, 3.6%, 3.7%, 3.8%, 3.9%, 4%, 5%, 6%, 7%, 8%, and 9% on a dry weight basis. In other aspects, tobacco plants provided herein comprise an average nicotine level selected from the group consisting of about between 0.01% and 0.02%, between 0.02% and 0.05%, between 0.05% and 0.75%, between 0.75% and 0.1%, between 0.1% and 0.15%, between 0.15% and 0.2%, between 0.2% and 0.3%, between 0.3% and 0.35%, between 0.35% and 0.4%, between 0.4% and 0.5%, between 0.5% and 0.6%, between 0.6% and 0.7%, between 0.7% and 0.8%, between 0.8% and 0.9%, between 0.9% and 1%, between 1% and 1.1%, between 1.1% and 1.2%, between 1.2% and 1.3%, between 1.3% and 1.4%, between 1.4% and 1.5%, between 1.5% and 1.6%, between 1.6% and 1.7%, between 1.7% and 1.8%, between 1.8% and 1.9%, between 1.9% and 2%, between 2% and 2.1%, between 2.1% and 2.2%, between 2.2% and 2.3%, between 2.3% and 2.4%, between 2.4% and 2.5%, between 2.5% and 2.6%, between 2.6% and 2.7%, between 2.7% and 2.8%, between 2.8% and 2.9%, between 2.9% and 3%, between 3% and 3.1%, between 3.1% and 3.2%, between 3.2% and 3.3%, between 3.3% and 3.4%, between 3.4% and 3.5%, and between 3.5% and 3.6% on a dry weight basis. In further aspects, tobacco plants provided herein comprise an average nicotine level selected from the group consisting of about between 0.01% and 0.1%, between 0.02% and 0.2%, between 0.03% and 0.3%, between 0.04% and 0.4%, between 0.05% and 0.5%, between 0.75% and 1%, between 0.1% and 1.5%, between 0.15% and 2%, between 0.2% and 3%, and between 0.3% and 3.5% on a dry weight basis.

The present disclosure also provides tobacco plants having altered nicotine levels without negative impacts over other tobacco traits, e.g., leaf grade index value. In one aspect, a low-nicotine or nicotine-free tobacco variety disclosed herein provides cured tobacco of commercially acceptable grade. Tobacco grades are evaluated based on factors including, but not limited to, the leaf stalk position, leaf size, leaf color, leaf uniformity and integrity, ripeness, texture, elasticity, sheen (related with the intensity and the depth of coloration of the leaf as well as the shine), hygroscopicity (the faculty of the tobacco leaves to absorb and to retain the ambient moisture), and green nuance or cast. Leaf grade can be determined, for example, using an Official Standard Grade published by the Agricultural Marketing Service of the US Department of Agriculture (7 U.S.C. § 511). See, e.g., Official Standard Grades for Burley Tobacco (U.S. Type 31 and Foreign Type 93), effective Nov. 5, 1990 (55 F.R. 40645); Official Standard Grades for Flue-Cured Tobacco (U.S. Types 11, 12, 13, 14 and Foreign Type 92), effective Mar. 27, 1989 (54 F.R. 7925); Official Standard Grades for Pennsylvania Seedleaf Tobacco (U.S. Type 41), effective Jan. 8, 1965 (29 F.R. 16854); Official Standard Grades for Ohio Cigar-Leaf Tobacco (U.S. Types 42, 43, and 44), effective Dec. 8, 1963 (28 F.R. 11719 and 28 F.R. 11926); Official Standard Grades for Wisconsin Cigar-Binder Tobacco (U.S. Types 54 and 55), effective Nov. 20, 1969 (34 F.R. 17061); Official Standard Grades for Wisconsin Cigar-Binder Tobacco (U.S. Types 54 and 55), effective Nov. 20, 1969 (34 F.R. 17061); Official Standard Grades for Georgia and Florida Shade-Grown Cigar-Wrapper Tobacco (U.S. Type 62), Effective April 1971. A USDA grade index value can be determined according to an industry accepted grade index. See, e.g., Bowman et al, *Tobacco Science,* 32:39-40(1988); Legacy Tobacco Document Library (Bates Document #523267826-523267833, Jul. 1, 1988, Memorandum on the Proposed Burley Tobacco Grade Index); and Miller et al., 1990, *Tobacco Intern.,* 192:55-57 (all foregoing references are incorporated by inference in their entirety). In one aspect, a USDA grade index is a 0-100 numerical representation of federal grade received and is a weighted average of all stalk positions. A higher grade index indicates higher quality. Alternatively, leaf grade can be determined via hyper-spectral imaging. See e.g., WO 2011/027315 (published on Mar. 10, 2011, and incorporated by inference in its entirety).

In some aspects, tobacco plants provided herein comprise a similar level of one or more tobacco aroma compounds selected from the group consisting of 3-methylvaleric acid, valeric acid, isovaleric acid, a labdenoid, a cembrenoid, a sugar ester, and a reducing sugar, compared to control tobacco plants when grown in similar growth conditions. In other aspects, tobacco plants provided herein comprise a Nic1 mutation, a Nic2 mutation, or a combination thereof having no impact over the level of one or more tobacco aroma compounds selected from the group consisting of 3-methylvaleric acid, valeric acid, isovaleric acid, a labdenoid, a cembrenoid, a sugar ester, and a reducing sugar.

As used herein, tobacco aroma compounds are compounds associated with the flavor and aroma of tobacco smoke. These compounds include, but are not limited to, 3-methylvaleric acid, valeric acid, isovaleric acid, cembrenoid and labdenoid diterpenes, and sugar esters. Concentrations of tobacco aroma compounds can be measured by any known metabolite profiling methods in the art including, without limitation, gas chromatography mass spectrometry (GC-MS), Nuclear Magnetic Resonance Spectroscopy, liquid chromatography-linked mass spectrometry. See The Handbook of Plant Metabolomics, edited by Weckwerth and Kahl, (Wiley-Blackwell) (May 28, 2013).

As used herein, "reducing sugar(s)" are any sugar (monosaccharide or polysaccharide) that has a free or potentially free aldehyde or ketone group. Glucose and fructose act as nicotine buffers in cigarette smoke by reducing smoke pH and effectively reducing the amount of "free" unprotonated nicotine. Reducing sugars balances smoke flavor, for example, by modifying the sensory impact of nicotine and other tobacco alkaloids. An inverse relationship between sugar content and alkaloid content has been reported across tobacco varieties, within the same variety, and within the same plant line caused by planting conditions. Reducing sugar levels can be measured using a segmented-flow colorimetric method developed for analysis of tobacco samples as adapted by Skalar Instrument Co (West Chester, Pa.) and described by Davis, *Tobacco Science* 20:139-144 (1976). For example, a sample is dialyzed against a sodium carbonate solution. Copper neocuproin is added to the sample and the solution is heated. The copper neocuproin chelate is reduced in the presence of sugars resulting in a colored complex which is measured at 460 nm.

In some aspects, tobacco plants provided herein comprise one or more non-naturally existing mutant alleles at Nic1 or Nic2 locus which reduce or eliminate one or more gene activity from Nic1 or Nic2 locus. In some aspects, these mutant alleles result in lower nicotine levels. Mutant Nic1 or Nic2 alleles can be introduced by any method known in the art including random or targeted mutagenesis approaches.

Such mutagenesis methods include, without limitation, treatment of seeds with ethyl methylsulfate (EMS) (Hildering and Verkerk, In, The use of induced mutations in plant breeding. Pergamon press, pp 317-320, 1965) or UV-irradiation, X-rays, and fast neutron irradiation (see, for example, Verkerk, *Neth. J. Agric. Sci.* 19:197-203, 1971; and Poehlman, Breeding Field Crops, Van Nostrand Reinhold, New York (3.sup.rd ed), 1987), transposon tagging (Fedoroff et al., 1984; U.S. Pat. Nos. 4,732,856 and 5,013,658), as well as T-DNA insertion methodologies (Hoekema et al., 1983; U.S. Pat. No. 5,149,645). EMS-induced mutagenesis consists of chemically inducing random point mutations over the length of the genome. Fast neutron mutagenesis consists of exposing seeds to neutron bombardment which causes large deletions through double stranded DNA breakage. Transposon tagging comprises inserting a transposon within an endogenous gene to reduce or eliminate expression of the gene. The types of mutations that may be present in a tobacco gene include, for example, point mutations, deletions, insertions, duplications, and inversions. Such mutations desirably are present in the coding region of a tobacco gene; however mutations in the promoter region, and intron, or an untranslated region of a tobacco gene may also be desirable.

In addition, a fast and automatable method for screening for chemically induced mutations, TILLING (Targeting Induced Local Lesions In Genomes), using denaturing HPLC or selective endonuclease digestion of selected PCR products is also applicable to the present disclosure. See, McCallum et al. (2000) *Nat. Biotechnol.* 18:455-457. Mutations that impact gene expression or that interfere with the function of genes disclosed herein can be determined using methods that are well known in the art. Insertional mutations in gene exons usually result in null-mutants. Mutations in conserved residues can be particularly effective in inhibiting the function of a protein. In some aspects, tobacco plants disclosed herein comprise a nonsense (e.g., stop codon) mutation is one or more Nic1 genes described herein.

Is some aspects, the present disclosure also provides tobacco lines with altered nicotine levels while maintaining commercially acceptable leaf quality. These lines can be produced by introducing mutations into one or more genes at Nic1 or Nic2 locus via precise genome engineering technologies, for example, Transcription activator-like effector nucleases (TALENs), meganuclease, zinc finger nuclease, and CRISPR-cas9 system. See, e.g., Gaj et al., *Trends in Biotechnology,* 31(7):397-405 (2013).

The screening and selection of mutagenized tobacco plants can be through any methodologies known to those having ordinary skill in the art. Examples of screening and selection methodologies include, but are not limited to, Southern analysis, PCR amplification for detection of a polynucleotide, Northern blots, RNase protection, primer-extension, RT-PCR amplification for detecting RNA transcripts, enzymatic assays for detecting enzyme or ribozyme activity of polypeptides and polynucleotides, and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

The present disclosure also provides compositions and methods for inhibiting the expression or function of one or more polypeptides from Nic1 locus in a plant, particularly plants of the *Nicotiana* genus, including tobacco plants of the various commercial varieties.

In some aspects, the present disclosure provides tobacco plants, or part thereof, comprising a heterologous expression cassette comprising a Nic1 inhibitory sequence of a gene comprising a sequence having at least 80%, at least 85%, at least 90%, at least 95%, at least 97%, at least 98%, at least 99%, or 100% identity to a sequence selected from the group consisting of SEQ ID NOs: 9 to 28, 75 to 82, 86 to 100, 145, and fragments thereof, wherein the inhibitory sequence is operably linked to a promoter that is functional in a plant cell, and wherein the inhibitory sequence has at least 90% sequence identity to a fragment of at least 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides of the sequence having at least 80%, at least 85%, at least 90%, at least 95%, at least 97%, at least 98%, at least 99%, or 100% identity to a sequence selected from the group consisting of SEQ ID NOs: 9 to 28, 75 to 82, 86 to 100, 145, and fragments thereof. In other aspects, the present disclosure provides tobacco plants, or part thereof, comprising a heterologous expression cassette comprising a Nic1 inhibitory sequence of a gene comprising a sequence having at least 80%, at least 85%, at least 90%, at least 95%, at least 97%, at least 98%, at least 99%, or 100% identity to a sequence selected from the group consisting of SEQ ID NOs: 13, 28, 33, 48, 82, 86, 87, 101, 102, 145, and 146, and fragments thereof, wherein the inhibitory sequence is operably linked to a promoter that is functional in a plant cell, and wherein the inhibitory sequence has at least 90% sequence identity to a fragment of at least 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides of the sequence having at least 80%, at least 85%, at least 90%, at least 95%, at least 97%, at least 98%, at least 99%, or 100% identity to a sequence selected from the group consisting of SEQ ID NOs: 13, 28, 33, 48, 82, 86, 87, 101, 102, 145, and 146, and fragments thereof. In some aspects, a Nic1 inhibitory sequence is capable of being transcribed as an inhibitory polynucleotide selected from the group consisting of a single-stranded RNA polynucleotide, a double-stranded RNA polynucleotide, and a combination thereof.

As used herein, the terms "inhibit," "inhibition," and "inhibiting" are defined as any method known in the art or described herein that decreases the expression or function of a gene product of interest (e.g., a target gene product). "Inhibition" can be in the context of a comparison between two plants, for example, a genetically altered plant versus a wild-type plant. Alternatively, inhibition of expression or function of a target gene product can be in the context of a comparison between plant cells, organelles, organs, tissues, or plant parts within the same plant or between different plants, and includes comparisons between developmental or temporal stages within the same plant or plant part or between plants or plant parts. "Inhibition" includes any relative decrement of function or production of a gene product of interest, up to and including complete elimination of function or production of that gene product. The term "inhibition" encompasses any method or composition that down-regulates translation and/or transcription of the target gene product or functional activity of the target gene product. In some aspects, the mRNA or protein level of one or more genes from Nic1 locus in a modified plant disclosed herein is less than 95%, less than 90%, less than 80%, less than 70%, less than 60%, less than 50%, less than 40%, less than 30%, less than 20%, less than 10%, less than 5%, less than 4%, less than 3%, less than 2%, or less than 1% of the protein level of the same gene in a plant that is not a mutant or that has not been genetically modified to inhibit the expression of that gene.

The term "inhibitory sequence" encompasses any polynucleotide or polypeptide sequence capable of inhibiting the expression or function of a gene involved in nicotine biosynthesis regulation from Nic1 locus in a plant, such as full-length polynucleotide or polypeptide sequences, truncated polynucleotide or polypeptide sequences, fragments of polynucleotide or polypeptide sequences, variants of polynucleotide or polypeptide sequences, sense-oriented nucleotide sequences, antisense-oriented nucleotide sequences, the complement of a sense- or antisense-oriented nucleotide sequence, inverted regions of nucleotide sequences, hairpins of nucleotide sequences, double-stranded nucleotide sequences, single-stranded nucleotide sequences, combinations thereof, and the like. The term "polynucleotide sequence" includes sequences of RNA, DNA, chemically modified nucleic acids, nucleic acid analogs, combinations thereof, and the like.

Inhibitory sequences are designated herein by the name of the target gene product. Thus, a "Nic1 inhibitory sequence" refers to an inhibitory sequence that is capable of inhibiting the expression of a gene involved in nicotine biosynthesis regulation from Nic1 locus in a plant, for example, at the level of transcription and/or translation, or which is capable of inhibiting the function of a gene product. When the phrase "capable of inhibiting" is used in the context of a polynucleotide inhibitory sequence, it is intended to mean that the inhibitory sequence itself exerts the inhibitory effect; or, where the inhibitory sequence encodes an inhibitory nucleotide molecule (for example, hairpin RNA, miRNA, or double-stranded RNA polynucleotides), or encodes an inhibitory polypeptide (e.g., a polypeptide that inhibits expression or function of the target gene product), following its transcription (for example, in the case of an inhibitory sequence encoding a hairpin RNA, miRNA, or double-stranded RNA polynucleotide) or its transcription and translation (in the case of an inhibitory sequence encoding an inhibitory polypeptide), the transcribed or translated product, respectively, exerts the inhibitory effect on the target gene product (e.g., inhibits expression or function of the target gene product).

A Nic1 inhibitory sequence disclosed herein can be a sequence triggering gene silencing via any silencing pathway or mechanism known in the art, including, but not limited to, sense suppression/cosuppression, antisense suppression, double-stranded RNA (dsRNA) interference, hairpin RNA interference and intron-containing hairpin RNA interference, amplicon-mediated interference, ribozymes, small interfering RNA, artificial or synthetic microRNA, and artificial trans-acting siRNA. A Nic1 inhibitory sequence may range from at least about 20 nucleotides, about 50 nucleotides, about 70 nucleotides, about 100 nucleotides, about 150 nucleotides, about 200 nucleotides, about 250 nucleotides, about 300 nucleotides, about 350 nucleotides, about 400 nucleotides, and up to the full-length polynucleotide encoding the proteins of the present disclosure, depending upon the desired outcome. In one aspect, a Nic1 inhibitory sequence can be a fragment of between about 50 and about 400 nucleotides, between about 70 and about 350 nucleotides, between about 90 and about 325 nucleotides, between about 90 and about 300 nucleotides, between about 90 and about 275 nucleotides, between about 100 and about 400 nucleotides, between about 100 and about 350 nucleotides, between about 100 and about 325 nucleotides, between about 100 and about 300 nucleotides, between about 125 and about 300 nucleotides, or between about 125 and about 275 nucleotides in length. In some embodiments, a fragment of a cytochrome P450 polynucleotide is about 50, about 60, about 70, about 80, about 90, about 100, about 125, about 150, about 175, about 200, about 225, about 250, about 275, about 300, about 325, about 350, about 400 nucleotides in length, and other such values between about 70 and about 400 nucleotides.

The use of the term "polynucleotide" is not intended to limit the present disclosure to polynucleotides comprising DNA. Those of ordinary skill in the art will recognize that polynucleotides can comprise ribonucleotides and combinations of ribonucleotides and deoxyribonucleotides. Such deoxyribonucleotides and ribonucleotides include both naturally occurring molecules and synthetic analogues. The polynucleotides of the present disclosure also encompass all forms of sequences including, but not limited to, single-stranded forms, double-stranded forms, hairpins, stem-and-loop structures, and the like.

In some aspects, the present disclosure provides recombinant DNA constructs comprising a promoter that is functional in a tobacco cell and operably linked to a polynucleotide that encodes an RNA molecule capable of binding to an RNA encoding a polypeptide having an amino acid sequence at least 80%, at least 85%, at least 90%, at least 95%, at least 97%, at least 98%, at least 99% identical to an amino acid sequence selected from the group consisting of SEQ ID NOs: 49 to 68, 84, 116 to 130, 147, and fragments thereof, and wherein the RNA molecule suppresses the expression of the polypeptide. In some aspects, the RNA molecule is selected from the group consisting of a microRNA, an siRNA, and a trans-acting siRNA. In other aspects, the recombinant DNA construct encodes a double stranded RNA. Also provided are transgenic tobacco plants or part thereof, cured tobacco material, or tobacco products comprising these recombinant DNA constructs. In some aspects, these transgenic plants, cured tobacco material, or tobacco products comprise a lower level of nicotine compared to a control tobacco plant without the recombinant DNA construct. Further provided are methods of reducing the nicotine level of a tobacco plant, the method comprising transforming a tobacco plant with any of these recombinant DNA constructs.

As used herein, "operably linked" refers to a functional linkage between two or more elements. For example, an operable linkage between a polynucleotide of interest and a regulatory sequence (e.g., a promoter) is a functional link that allows for expression of the polynucleotide of interest. Operably linked elements may be contiguous or non-contiguous.

As used herein and when used in reference to a sequence, "heterologous" refers to a sequence that originates from a foreign species, or, if from the same species, is substantially modified from its native form in composition and/or genomic locus by deliberate human intervention. The term also is applicable to nucleic acid constructs, also referred to herein as "polynucleotide constructs" or "nucleotide constructs." In this manner, a "heterologous" nucleic acid construct is intended to mean a construct that originates from a foreign species, or, if from the same species, is substantially modified from its native form in composition and/or genomic locus by deliberate human intervention.

Heterologous nucleic acid constructs include, but are not limited to, recombinant nucleotide constructs that have been introduced into a plant or plant part thereof, for example, via transformation methods or subsequent breeding of a transgenic plant with another plant of interest.

As used herein, "gene expression" refers to the biosynthesis or production of a gene product, including the transcription and/or translation of the gene product.

Also provided herein are compositions and methods for overexpressing one or more polypeptides from Nic1 locus in a plant, particularly plants of the *Nicotiana* genus, including tobacco plants of the various commercial varieties.

In some aspects, the present disclosure provides recombinant DNA constructs comprising a promoter that is functional in a tobacco cell and operably linked to a polynucleotide that encodes a polypeptide having an amino acid sequence at least 80%, at least 85%, at least 90%, at least 95%, at least 97%, at least 98%, at least 99%, or 100% identical to an amino acid sequence selected from the group consisting of SEQ ID NOs: 49 to 68, 84, 116 to 130, 147, and fragments thereof. Also provided are transgenic tobacco plants or part thereof, cured tobacco material, or tobacco products comprising these recombinant DNA constructs. In some aspects, these transgenic plants, cured tobacco material, or tobacco products comprise an increased level of nicotine compared to a control tobacco plant without the recombinant DNA construct. Further provided are methods of increasing the nicotine level of a tobacco plant, the method comprising transforming a tobacco plant with any of these recombinant DNA constructs.

In some aspects, recombinant DNA constructs or expression cassettes disclosed herein can also comprise a selectable marker gene for the selection of transgenic cells. Selectable marker genes include, but are not limited to, genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers include phenotypic markers such as β-galactosidase and fluorescent proteins such as green fluorescent protein (GFP).

In some aspects, recombinant DNA constructs or expression cassettes disclosed herein comprise a promoter selected from the group consisting of a constitutive promoter, an inducible promoter, and a tissue-preferred promoter (for example, a leaf-specific or root-specific promoter). Exemplary constitutive promoters include the core promoter of the Rsyn7 promoter and other constitutive promoters disclosed in U.S. Pat. No. 6,072,050; the core CaMV 35S promoter (Odell et al. (1985) Nature 313:810-812); ubiquitin (Christensen et al. (1989) Plant Mol. Biol. 12:619-632 and Christensen et al. (1992) Plant Mol. Biol. 18:675-689); pEMU (Last et al. (1991) Theor. Appl. Genet. 81:581-588); MAS (Velten et al. (1984) EMBO J 3:2723-2730); ALS promoter (U.S. Pat. No. 5,659,026), and the like. Exemplary chemical-inducible promoters include the tobacco PR-1a promoter, which is activated by salicylic acid. Other chemical-inducible promoters of interest include steroid-responsive promoters (see, for example, the glucocorticoid-inducible promoter in Schena et al. (1991) Proc. Natl. Acad. Sci. USA 88:10421-10425 and McNellis et al. (1998) Plant J. 14(2): 247-257) and tetracycline-inducible promoters (see, for example, Gatz et al. (1991) Mol. Gen. Genet. 227:229-237, and U.S. Pat. Nos. 5,814,618 and 5,789,156). Additional exemplary promoters that can be used herein are those responsible for heat-regulated gene expression, light-regulated gene expression (for example, the pea rbcS-3A; the maize rbcS promoter; the chlorophyll alb-binding protein gene found in pea; or the Arabssu promoter), hormone-regulated gene expression (for example, the abscisic acid (ABA) responsive sequences from the Em gene of wheat; the ABA-inducible HVA1 and HVA22, and rd29A promoters of barley and *Arabidopsis*; and wound-induced gene expression (for example, of wunl), organ specific gene expression (for example, of the tuber-specific storage protein gene; the 23-kDa zein gene from maize described by; or the French bean (β-phaseolin gene), or pathogen-inducible promoters (for example, the PR-1, prp-1, or (β-1,3 glucanase promoters, the fungal-inducible wirla promoter of wheat, and the nematode-inducible promoters, TobRB7-5A and Hmg-1, of tobacco arid parsley, respectively).

In some aspects, tobacco plants provided herein further comprise increased or reduced expression of activity of genes involved in nicotine biosynthesis or transport. Genes involved in nicotine biosynthesis include, but are not limited to, arginine decarboxylase (ADC), methylputrescine oxidase (MPO), NADH dehydrogenase, ornithine decarboxylase (ODC), phosphoribosylanthranilate isomerase (PRAI), putrescine N-methyltransferase (PMT), quinolate phosphoribosyl transferase (QPT), and S-adenosyl-methionine synthetase (SAMS). Nicotine Synthase, which catalyzes the condensation step between a nicotinic acid derivative and methylpyrrolinium cation, has not been elucidated although two candidate genes (A622 and NBB1) have been proposed. See US 2007/0240728 A1 and US 2008/0120737A1. A622 encodes an isoflavone reductase-like protein. In addition, several transporters may be involved in the translocation of nicotine. A transporter gene, named MATE, has been cloned and characterized (Morita et al., *PNAS* 106:2447-52 (2009)).

In some aspects, tobacco plants provided herein further comprise an increased or reduced level of mRNA, protein, or both of one or more genes encoding a product selected from the group consisting of PMT, MPO, QPT, ADC, ODC, PRAI, SAMS, BBL, MATE, A622, and NBB1, compared to a control tobacco plant. In other aspects, tobacco plants provided herein further comprise a transgene directly suppressing the expression of one or more genes encoding a product selected from the group consisting of PMT, MPO, QPT, ADC, ODC, PRAI, SAMS, BBL, MATE, A622, and NBB1. In other aspects, tobacco plants provided herein further comprise a transgene or mutation suppressing the expression or activity of one or more genes encoding a product selected from the group consisting of PMT, MPO, QPT, ADC, ODC, PRAI, SAMS, BBL, MATE, A622, and NBB1. In other aspects, tobacco plants provided herein further comprise a transgene overexpressing one or more genes encoding a product selected from the group consisting of PMT, MPO, QPT, ADC, ODC, PRAI, SAMS, BBL, MATE, A622, and NBB1.

Also disclosed herein are the transformation of tobacco plants with recombinant constructs or expression cassettes described herein using any suitable transformation methods known in the art. Methods for introducing polynucleotide sequences into tobacco plants are known in the art and include, but are not limited to, stable transformation methods, transient transformation methods, and virus-mediated methods. "Stable transformation" refers to transformation where the nucleotide construct of interest introduced into a plant integrates into the genome of the plant and is capable of being inherited by the progeny thereof "Transient transformation" is intended to mean that a sequence is introduced into the plant and is only temporally expressed or is only transiently present in the plant.

Suitable methods of introducing polynucleotides into plant cells of the present disclosure include microinjection (Crossway et al. (1986) *Biotechniques* 4:320-334), electroporation (Shillito et al. (1987) *Meth. Enzymol.* 153:313-336; Riggs et al. (1986) *Proc. Natl. Acad. Sci. USA* 83:5602-5606), *Agrobacterium*-mediated transformation (U.S. Pat. Nos. 5,104,310, 5,149,645, 5,177,010, 5,231,019, 5,463,174, 5,464,763, 5,469,976, 4,762,785, 5,004,863, 5,159,135, 5,563,055, and 5,981,840), direct gene transfer (Paszkowski et al. (1984) *EMBO J.* 3:2717-2722), and ballistic particle acceleration (see, for example, U.S. Pat. Nos. 4,945,050, 5,141,131, 5,886,244, 5,879,918, and 5,932,782; Tomes et al. (1995) in *Plant Cell, Tissue, and Organ Culture Fundamental Methods*, ed. Gamborg and Phillips (Springer-Verlag, Berlin); McCabe et al. (1988) *Biotechnology* 6:923-926). Also see Weissinger et al. (1988) *Ann. Rev. Genet.* 22:421-477; Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P: 175-182 (soybean); Singh et al. (1998) *Theor. Appl. Genet.* 96:319-324 (soybean); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation).

In other aspects, recombinant constructs or expression cassettes disclosed herein may be introduced into plants by contacting plants with a virus or viral nucleic acids. Generally, such methods involve incorporating an expression cassette of the present disclosure within a viral DNA or RNA molecule. It is recognized that promoters for use in the expression cassettes disclosed herein also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931, and Porta et al. (1996) *Molecular Biotechnology* 5:209-221.

Any plant tissue that can be subsequently propagated using clonal methods, whether by organogenesis or embryogenesis, may be transformed with a recombinant construct or an expression cassette disclosed herein. By "organogenesis" in intended the process by which shoots and roots are developed sequentially from meristematic centers. By "embryogenesis" is intended the process by which shoots and roots develop together in a concerted fashion (not sequentially), whether from somatic cells or gametes. Exemplary tissues that are suitable for various transformation protocols described herein include, but are not limited to, callus tissue, existing meristematic tissue (e.g., apical meristems, axillary buds, and root meristems) and induced meristem tissue (e.g., cotyledon meristem and hypocotyl meristem), hypocotyls, cotyledons, leaf disks, pollen, embryos, and the like.

In some aspects, tobacco plants provided herein are from a tobacco type selected from the group consisting of flue-cured tobacco, air-cured tobacco, dark air-cured tobacco, dark fire-cured tobacco, *Galpao* tobacco, and Oriental tobacco. In other aspects, tobacco plants provided herein are from a tobacco type selected from the group consisting of Burley tobacco, Maryland tobacco, and dark tobacco.

Flue-cured tobaccos (also called Virginia or bright tobaccos) amount to approximately 40% of world tobacco production. Flue-cured tobaccos are often also referred to as "bright tobacco" because of the golden-yellow to deep-orange color it reaches during curing. Flue-cured tobaccos have a light, bright aroma and taste. Flue-cured tobaccos are generally high in sugar and low in oils. Major flue-cured tobacco growing countries are Argentina, Brazil, China, India, Tanzania and the U.S. In some aspects, low-alkaloid or low-nicotine tobacco plants or seeds provided herein are in a flue-cured tobacco background selected from the group consisting of CC 13, CC 27, CC 33, CC 37, CC 65, CC 67, CC 700, GF 318, GL 338, GL 368, GL 939, K 346, K 399, K326, NC 102, NC 196, NC 291, NC 297, NC 299, NC 471, NC 55, NC 606, NC 71, NC 72, NC 92, PVH 1118, PVH 1452, PVH 2110, SPEIGHT 168, SPEIGHT 220, SPEIGHT 225, SPEIGHT 227, SPEIGHT 236, and any variety essentially derived from any one of the foregoing varieties. In other aspects, low-alkaloid or low-nicotine tobacco plants or seeds provided herein are in a flue-cured tobacco background selected from the group consisting of Coker 48, Coker 176, Coker 371-Gold, Coker 319, Coker 347, GL 939, K 149, K326, K 340, K 346, K 358, K 394, K 399, K 730, NC 27NF, NC 37NF, NC 55, NC 60, NC 71, NC 72, NC 82, NC 95, NC 297, NC 606, NC 729, NC 2326, McNair 373, McNair 944, Ox 207, Ox 414 NF, Reams 126, Reams 713, Reams 744, RG 8, RG 11, RG 13, RG 17, RG 22, RG 81, RG H4, RG H51, Speight H-20, Speight G-28, Speight G-58, Speight G-70, Speight G-108, Speight G-111, Speight G-117, Speight 168, Speight 179, Speight NF-3, Va 116, Va 182, and any variety essentially derived from any one of the foregoing varieties. See WO 2004/041006 A1. In further aspects, low-alkaloid or low-nicotine tobacco plants, seeds, hybrids, varieties, or lines disclosed herein are in any flue cured background selected from the group consisting of K326, K346, and NC196.

Air-cured tobaccos include Burley, Maryland, and dark tobaccos. The common factor is that curing is primarily without artificial sources of heat and humidity. Burley tobaccos are light to dark brown in color, high in oil, and low in sugar. Burley tobaccos are air-cured in barns. Major Burley growing countries are Argentina, Brazil, Italy, Malawi, and the U.S. Maryland tobaccos are extremely fluffy, have good burning properties, low nicotine and a neutral aroma. Major Maryland growing countries include the U.S. and Italy. In some aspects, low-alkaloid or low-nicotine tobacco plants or seeds provided herein are in a Burley tobacco background selected from the group consisting of Clay 402, Clay 403, Clay 502, Ky 14, Ky 907, Ky 910, Ky 8959, NC 2, NC 3, NC 4, NC 5, NC 2000, TN 86, TN 90, TN 97, R 610, R 630, R 711, R 712, NCBH 129, Bu 21×Ky 10, HB04P, Ky 14×L 8, Kt 200, Newton 98, Pedigo 561, Pf561 and Va 509. In further aspects, low-alkaloid or low-nicotine tobacco plants, seeds, hybrids, varieties, or lines disclosed herein are in any Burley background selected from the group consisting of TN 90, KT 209, KT 206, KT212, and HB 4488. In other aspects, low-alkaloid or low-nicotine tobacco plants or seeds provided herein are in a Maryland tobacco background selected from the group consisting of Md 10, Md 40, Md 201, Md 609, Md 872 and Md 341.

Dark air-cured tobaccos are distinguished from other types primarily by its curing process which gives dark air-cured tobacco its medium- to dark-brown color and distinct aroma. Dark air-cured tobaccos are mainly used in the production of chewing tobacco and snuff. In some aspects, low-alkaloid or low-nicotine tobacco plants or seeds provided herein are in a dark air-cured tobacco background selected from the group consisting of Sumatra, Jatim, Dominican Cubano, Besuki, One sucker, Green River, Virginia sun-cured, and Paraguan Passado.

Dark fire-cured tobaccos are generally cured with low-burning wood fires on the floors of closed curing barns. Their leaves have low sugar content but high nicotine content. Dark fire-cured tobaccos are used for making pipe blends, cigarettes, chewing tobacco, snuff and strong-tasting cigars. Major growing regions for dark fire-cured tobaccos are Tennessee, Kentucky, and Virginia, USA. In some aspects, low-alkaloid or low-nicotine tobacco plants or seeds provided herein are in a dark fire-cured tobacco background selected from the group consisting of Narrow Leaf Madole, Improved Madole, Tom Rosson Madole, Newton's VH Madole, Little Crittenden, Green Wood, Little Wood, Small Stalk Black Mammoth, DT 508, DT 518, DT 592, KY 171, DF 911, DF 485, TN D94, TN D950, VA 309, and VA 359.

Oriental tobaccos are also referred to as Greek, aroma and Turkish tobaccos due to the fact that they are typically grown in eastern Mediterranean regions such as Turkey, Greece, Bulgaria, Macedonia, Syria, Lebanon, Italy, and Romania. The small plant and leaf size, characteristic of today's Oriental varieties, as well as its unique aroma properties are a result of the plant's adaptation to the poor soil and stressful climatic conditions in which it develop over many past centuries. In some aspects, low-alkaloid or low-nicotine tobacco plants or seeds provided herein are in a Oriental tobacco background selected from the group consisting of Izmir, Katerini, Samsun, Basma and Krumovgrad, Trabzon, Thesalian, Tasova, Sinop, Izmit, Hendek, Edirne, Semdinli, Adiyanman, Yayladag, Iskenderun, Duzce, Macedonian, Mavra, Prilep, Bafra, Bursa, Bucak, Bitlis, Balikesir, and any variety essentially derived from any one of the foregoing varieties.

In some aspects, low-alkaloid or low-nicotine tobacco plants, seeds, hybrids, varieties, or lines disclosed herein are essentially derived from or in the genetic background of BU 64, CC 101, CC 200, CC 27, CC 301, CC 400, CC 500, CC 600, CC 700, CC 800, CC 900, Coker 176, Coker 319, Coker 371 Gold, Coker 48, CU 263, DF911, *Galpao* tobacco, GL 26H, GL 350, GL 600, GL 737, GL 939, GL 973, HB 04P, K 149, K 326, K 346, K 358, K394, K 399, K 730, KDH 959, KT 200, KT204LC, KY 10, KY 14, KY 160, KY 17, KY 171, KY 907, KY907LC, KTY14×L8 LC, Little Crittenden, McNair 373, McNair 944, msKY 14×L8, Narrow Leaf Madole, NC 100, NC 102, NC 2000, NC 291, NC 297, NC 299, NC 3, NC 4, NC 5, NC 6, NC7, NC 606, NC 71, NC 72, NC 810, NC BH 129, NC 2002, Neal Smith Madole, OXFORD 207, 'Perique' tobacco, PVH03, PVH09, PVH19, PVH50, PVH51, R 610, R 630, R 7-11, R 7-12, RG 17, RG 81, RG H51, RGH 4, RGH 51, RS 1410, Speight 168, Speight 172, Speight 179, Speight 210, Speight 220, Speight 225, Speight 227, Speight 234, Speight G-28, Speight G-70, Speight H-6, Speight H20, Speight NF3, TI 1406, TI 1269, TN 86, TN86LC, TN 90, TN 97, TN97LC, TN D94, TN D950, TR (Tom Rosson) Madole, VA 309, or VA359, Maryland 609, HB3307PLC, HB4488PLC, KT206LC, KT209LC, KT210LC, KT212LC, R610LC, PVH2310, NC196, KTD14LC, KTD6LC, KTD8LC, PD7302LC, PD7305LC, PD7309LC, PD7318LC, PD7319LC, PD7312LC, ShireyLC, or any commercial tobacco variety according to standard tobacco breeding techniques known in the art.

All foregoing mentioned specific varieties of dark air-cured, Burley, Maryland, dark fire-cured, or Oriental type are only listed for exemplary purposes. Any additional dark air-cured, Burley, Maryland, dark fire-cured, Oriental varieties are also contemplated in the present application.

Also provided herein are populations of tobacco plants described herein. In one aspect, a population of tobacco plants disclosed herein has a planting density of between about 5,000 and about 8000, between about 5,000 and about 7,600, between about 5,000 and about 7,200, between about 5,000 and about 6,800, between about 5,000 and about 6,400, between about 5,000 and about 6,000, between about 5,000 and about 5,600, between about 5,000 and about 5,200, between about 5,200 and about 8,000, between about 5,600 and about 8,000, between about 6,000 and about 8,000, between about 6,400 and about 8,000, between about 6,800 and about 8,000, between about 7,200 and about 8,000, or between about 7,600 and about 8,000 plants per acre. In another aspect, a population of tobacco plants disclosed herein is in a soil type with low to medium fertility.

Also provided herein are containers of seeds from tobacco plants described herein. A container of tobacco seeds of the present disclosure may contain any number, weight, or volume of seeds. For example, a container can contain at least, or greater than, about 100, 200, 300, 400, 500, 600, 700, 800, 900, 1000, 1500, 2000, 2500, 3000, 3500, 4000 or more seeds. Alternatively, the container can contain at least, or greater than, about 1 ounce, 5 ounces, 10 ounces, 1 pound, 2 pounds, 3 pounds, 4 pounds, 5 pounds or more seeds. Containers of tobacco seeds may be any container available in the art. By way of non-limiting example, a container may be a box, a bag, a packet, a pouch, a tape roll, a tube, or a bottle.

Also provided herein is cured tobacco material made from low-alkaloid or low-nicotine tobacco plants described herein. Further provided is cured tobacco material made from tobacco plants described herein with higher levels of total alkaloid or nicotine.

"Curing" is the aging process that reduces moisture and brings about the destruction of chlorophyll giving tobacco leaves a golden color and by which starch is converted to sugar. Cured tobacco therefore has a higher reducing sugar content and a lower starch content compared to harvested green leaf. In some aspects, green leaf tobacco provided herein can be cured using conventional means, e.g., flue-cured, barn-cured, fire-cured, air-cured or sun-cured. See, for example, Tso (1999, Chapter 1 in Tobacco, Production, Chemistry and Technology, Davis & Nielsen, eds., Blackwell Publishing, Oxford) for a description of different types of curing methods. Cured tobacco is usually aged in a wooden drum (e.g., a hogshead) or cardboard cartons in compressed conditions for several years (e.g., two to five years), at a moisture content ranging from 10% to about 25%. See, U.S. Pat. Nos. 4,516,590 and 5,372,149. Cured and aged tobacco then can be further processed. Further processing includes conditioning the tobacco under vacuum with or without the introduction of steam at various temperatures, pasteurization, and fermentation. Fermentation typically is characterized by high initial moisture content, heat generation, and a 10 to 20% loss of dry weight. See, e.g., U.S. Pat. Nos. 4,528,993, 4,660,577, 4,848,373, 5,372,149; U.S. Publication No. 2005/0178398; and Tso (1999, Chapter 1 in Tobacco, Production, Chemistry and Technology, Davis & Nielsen, eds., Blackwell Publishing, Oxford). Cure, aged, and fermented tobacco can be further processed (e.g., cut, shredded, expanded, or blended). See, for example, U.S. Pat. Nos. 4,528,993; 4,660,577; and 4,987,907. In one aspect, the cured tobacco material of the present disclosure is sun-cured. In another aspect, the cured tobacco material of the present disclosure is flue-cured, air-cured, or fire-cured.

Tobacco material obtained from the tobacco lines, varieties or hybrids of the present disclosure can be used to make tobacco products. As used herein, "tobacco product" is defined as any product made or derived from tobacco that is intended for human use or consumption.

Tobacco products provided herein include, without limitation, cigarette products (e.g., cigarettes and bidi cigarettes), cigar products (e.g., cigar wrapping tobacco and cigarillos), pipe tobacco products, products derived from tobacco, tobacco-derived nicotine products, smokeless tobacco products (e.g., moist snuff, dry snuff, and chewing tobacco), films, chewables, tabs, shaped parts, gels, consumable units, insoluble matrices, hollow shapes, reconstituted tobacco, expanded tobacco, and the like. See, e.g., U.S. Patent Publication No. US 2006/0191548.

As used herein, "cigarette" refers a tobacco product having a "rod" and "filler". The cigarette "rod" includes the cigarette paper, filter, plug wrap (used to contain filtration materials), tipping paper that holds the cigarette paper (including the filler) to the filter, and all glues that hold these components together. The "filler" includes (1) all tobaccos, including but not limited to reconstituted and expanded tobacco, (2) non-tobacco substitutes (including but not limited to herbs, non-tobacco plant materials and other spices that may accompany tobaccos rolled within the cigarette paper), (3) casings, (4) flavorings, and (5) all other additives (that are mixed into tobaccos and substitutes and rolled into the cigarette).

As used herein, "reconstituted tobacco" refers to a part of tobacco filler made from tobacco dust and other tobacco scrap material, processed into sheet form and cut into strips to resemble tobacco. In addition to the cost savings, reconstituted tobacco is very important for its contribution to cigarette taste from processing flavor development using reactions between ammonia and sugars.

As used herein, "expanded tobacco" refers to a part of tobacco filler which is processed through expansion of suitable gases so that the tobacco is "puffed" resulting in reduced density and greater filling capacity. It reduces the weight of tobacco used in cigarettes.

Tobacco products derived from plants of the present disclosure also include cigarettes and other smoking articles, particularly those smoking articles including filter elements, wherein the rod of smokable material includes cured tobacco within a tobacco blend. In an aspect, a tobacco product of the present disclosure is selected from the group consisting of a cigarillo, a non-ventilated recess filter cigarette, a vented recess filter cigarette, a cigar, snuff, pipe tobacco, cigar tobacco, cigarette tobacco, chewing tobacco, leaf tobacco, hookah tobacco, shredded tobacco, and cut tobacco. In another aspect, a tobacco product of the present disclosure is a smokeless tobacco product. Smokeless tobacco products are not combusted and include, but not limited to, chewing tobacco, moist smokeless tobacco, snus, and dry snuff Chewing tobacco is coarsely divided tobacco leaf that is typically packaged in a large pouch-like package and used in a plug or twist. Moist smokeless tobacco is a moist, more finely divided tobacco that is provided in loose form or in pouch form and is typically packaged in round cans and used as a pinch or in a pouch placed between an adult tobacco consumer's cheek and gum. Snus is a heat treated smokeless tobacco. Dry snuff is finely ground tobacco that is placed in the mouth or used nasally. In a further aspect, a tobacco product of the present disclosure is selected from the group consisting of loose leaf chewing tobacco, plug chewing tobacco, moist snuff, and nasal snuff. In yet another aspect, a tobacco product of the present disclosure is selected from the group consisting of an electronically heated cigarette, an e-cigarette, an electronic vaporing device.

In an aspect, a tobacco product of the present disclosure can be a blended tobacco product. In another aspect, a tobacco product of the present disclosure can be a low nicotine tobacco product. In a further aspect, a tobacco product of the present disclosure may comprise nornicotine at a level of less than about 3 mg/g. For example, the nornicotine content in such a product can be 3.0 mg/g, 2.5 mg/g, 2.0 mg/g, 1.5 mg/g, 1.0 mg/g, 750 µg/g, 500 pg/g, 250 pg/g, 100 pg/g, 75 pg/g, 50 pg/g, 25 pg/g, 10 pg/g, 7.0 pg/g, 5.0 pg/g, 4.0 pg/g, 2.0 pg/g, 1.0 pg/g, 0.5 pg/g, 0.4 pg/g, 0.2 pg/g, 0.1 pg/g, 0.05 pg/g, 0.01 pg/g, or undetectable.

In some aspects, cured tobacco material or tobacco products provided herein comprise an average nicotine level selected from the group consisting of about 0.01%, 0.02%, 0.05%, 0.75%, 0.1%, 0.15%, 0.2%, 0.3%, 0.35%, 0.4%, 0.5%, 0.6%, 0.7%, 0.8%, 0.9%, 1%, 1.1%, 1.2%, 1.3%, 1.4%, 1.5%, 1.6%, 1.7%, 1.8%, 1.9%, 2%, 2.1%, 2.2%, 2.3%, 2.4%, 2.5%, 2.6%, 2.7%, 2.8%, 2.9%, 3%, 3.1%, 3.2%, 3.3%, 3.4%, 3.5%, 3.6%, 3.7%, 3.8%, 3.9%, 4%, 5%, 6%, 7%, 8%, and 9% on a dry weight basis. In other aspects, cured tobacco material or tobacco products provided herein comprise an average nicotine level selected from the group consisting of about between 0.01% and 0.02%, between 0.02% and 0.05%, between 0.05% and 0.75%, between 0.75% and 0.1%, between 0.1% and 0.15%, between 0.15% and 0.2%, between 0.2% and 0.3%, between 0.3% and 0.35%, between 0.35% and 0.4%, between 0.4% and 0.5%, between 0.5% and 0.6%, between 0.6% and 0.7%, between 0.7% and 0.8%, between 0.8% and 0.9%, between 0.9% and 1%, between 1% and 1.1%, between 1.1% and 1.2%, between 1.2% and 1.3%, between 1.3% and 1.4%, between 1.4% and 1.5%, between 1.5% and 1.6%, between 1.6% and 1.7%, between 1.7% and 1.8%, between 1.8% and 1.9%, between 1.9% and 2%, between 2% and 2.1%, between 2.1% and 2.2%, between 2.2% and 2.3%, between 2.3% and 2.4%, between 2.4% and 2.5%, between 2.5% and 2.6%, between 2.6% and 2.7%, between 2.7% and 2.8%, between 2.8% and 2.9%, between 2.9% and 3%, between 3% and 3.1%, between 3.1% and 3.2%, between 3.2% and 3.3%, between 3.3% and 3.4%, between 3.4% and 3.5%, and between 3.5% and 3.6% on a dry weight basis. In further aspects, cured tobacco material or tobacco products provided herein comprise an average nicotine level selected from the group consisting of about between 0.01% and 0.1%, between 0.02% and 0.2%, between 0.03% and 0.3%, between 0.04% and 0.4%, between 0.05% and 0.5%, between 0.75% and 1%, between 0.1% and 1.5%, between 0.15% and 2%, between 0.2% and 3%, and between 0.3% and 3.5% on a dry weight basis.

The present disclosure also provides methods for breeding tobacco lines, cultivars, or varieties comprising a desirable level of total alkaloid or nicotine, e.g., low nicotine or nicotine free. Breeding can be carried out via any known procedures. DNA fingerprinting, SNP mapping, haplotype mapping or similar technologies may be used in a marker-assisted selection (MAS) breeding program to transfer or breed a desirable trait or allele into a tobacco plant. For example, a breeder can create segregating populations in a $F_2$ or backcross generation using F1 hybrid plants disclosed herein or further crossing the F1 hybrid plants with other donor plants with an agronomically desirable genotype. Plants in the $F_2$ or backcross generations can be screened for a desired agronomic trait or a desirable chemical profile using one of the techniques known in the art or listed herein. Depending on the expected inheritance pattern or the MAS technology used, self-pollination of selected plants before each cycle of backcrossing to aid identification of the desired individual plants can be performed. Backcrossing or other breeding procedure can be repeated until the desired phenotype of the recurrent parent is recovered. A recurrent parent in the present disclosure can be a flue-cured variety, a Burley variety, a dark air-cured variety, a dark fire-cured variety, or an Oriental variety. Other breeding techniques can be found, for example, in Wernsman, E. A., and Rufty, R. C. 1987. Chapter Seventeen. Tobacco. Pages 669-698 In: Cultivar Development. Crop Species. W. H. Fehr (ed.), MacMillan Publishing Go., Inc., New York, N.Y., incorporated herein by reference in their entirety.

Results of a plant breeding program using the tobacco plants described herein includes useful lines, cultivars, varieties, progeny, inbreds, and hybrids of the present disclosure. As used herein, the term "variety" refers to a population of plants that share constant characteristics which separate them from other plants of the same species. A variety is often, although not always, sold commercially. While possessing one or more distinctive traits, a variety is further characterized by a very small overall variation between individuals within that variety. A "pure line" variety may be created by several generations of self-pollination and selection, or vegetative propagation from a single parent using tissue or cell culture techniques. A variety can be essentially derived from another line or variety. As defined by the International Convention for the Protection of New Varieties of Plants (Dec. 2, 1961, as revised at Geneva on Nov. 10, 1972; on Oct. 23, 1978; and on Mar. 19, 1991), a variety is "essentially derived" from an initial variety if: a) it is predominantly derived from the initial variety, or from a variety that is predominantly derived from the initial variety, while retaining the expression of the essential characteristics that result from the genotype or combination of genotypes of the initial variety; b) it is clearly distinguishable from the initial variety; and c) except for the differences which result from the act of derivation, it conforms to the initial variety in the expression of the essential characteristics that result from the genotype or combination of genotypes of the initial variety. Essentially derived varieties can be obtained, for example, by the selection of a natural or induced mutant, a somaclonal variant, a variant individual from plants of the initial variety, backcrossing, or transformation. A first tobacco variety and a second tobacco variety from which the first variety is essentially derived, are considered as having essentially identical genetic background. A "line" as distinguished from a variety most often denotes a group of plants used non-commercially, for example in plant research. A line typically displays little overall variation between individuals for one or more traits of interest, although there may be some variation between individuals for other traits.

In some aspects, the present disclosure provides a method of introgressing a low nicotine trait into a tobacco variety, the method comprising: (a) crossing a first tobacco variety comprising a low nicotine trait with a second tobacco variety without the low nicotine trait to produce one or more progeny tobacco plants; (b) genotyping the one or more progeny tobacco plants for a polymorphic marker linked to the low nicotine trait, wherein the polymorphic marker is in a chromosomal interval flanked by any two of polymorphic loci listed in Table 3 or flanked by any two of polymorphic loci listed in Table 4; and (c) selecting a progeny tobacco plant comprising the low nicotine trait. In other aspects, these methods further comprise backcrossing the selected progeny tobacco plant with the second tobacco variety. In further aspects, these methods further comprise: (d) crossing the selected progeny plant with itself or with the second tobacco variety to produce one or more further progeny tobacco plants; and (e) selecting a further progeny tobacco plant comprising the low nicotine trait. In some aspects, the step (e) of selecting comprises marker-assisted selection. In some aspects, these methods produce a single gene conversion comprising a low nicotine trait. In some aspects, these methods produce a single gene conversion comprising a Nic1 introgression. In some aspects, the second second tobacco variety is an elite variety. In other aspects, the genotyping step of these methods involve one or more molecular marker assays. In other aspects, the polymorphic marker used this method comprises a polymorphism selected from the group consisting of single nucleotide polymorphisms (SNPs), insertions or deletions in DNA sequence (Indels), simple sequence repeats of DNA sequence (SSRs), a restriction fragment length polymorphism (RFLP), and a tag SNP. In other aspects, the selected progeny tobacco plant comprises a shorter chromosome deletion at Nic1 locus compared to LA Burley 21.

In other aspects, the present disclosure provides a method of introgressing a low nicotine trait into a tobacco variety, the method comprising: (a) crossing a first tobacco variety comprising a low nicotine trait with a second tobacco variety without the low nicotine trait to produce one or more progeny tobacco plants; (b) genotyping the one or more progeny tobacco plants for a polymorphic marker linked to the low nicotine trait, wherein the polymorphic marker is within 20 cM of any one of polymorphic loci listed in Table 3 and Table 4; and (c) selecting a progeny tobacco plant comprising the low nicotine trait. In some aspects, this method comprises selecting simultaneously or concurrently for one or more molecular markers associated with or closely linked to Nic1 locus as well as one or more molecular markers associated with or closely linked to Nic2 locus.

In some aspects, the present disclosure provides a method of selecting a tobacco plant having a low nicotine trait, the method comprising: (a) isolating nucleic acids from a collection of tobacco germplasm; (b) assaying the nucleic acids for one or more markers closely linked to Nic1 locus; and (c) selecting a tobacco plant having a low nicotine trait based on the marker assay. In some aspects, the assayed one or more markers closely linked to Nic1 locus are within about 20 cM, 10 cM, 5 cM, 4 cM, 3 cM, 2 cM, 1 cM, 0.5 cM, or less than 0.5 cM of any one of polymorphic loci listed in Table 3. In other aspects, this method further comprising assaying for one or more markers closely linked to Nic2 locus. In some aspects, the assayed one or more markers closely linked to Nic2 locus are within about 20 cM, 10 cM, 5 cM, 4 cM, 3 cM, 2 cM, 1 cM, 0.5 cM, or less than 0.5 cM of any one of polymorphic loci listed in Table 4. In some aspects, this method further comprises determining the nicotine level of the selected plant to confirm the low nicotine trait.

Also disclosed herein is a method of introgressing a low nicotine trait into a tobacco variety, the method comprising: (a) crossing a first tobacco variety comprising a low nicotine trait with a second tobacco variety without the low nicotine trait to produce one or more progeny tobacco plants; (b) genotyping the one or more progeny tobacco plants for a polymorphic marker linked to the low nicotine trait, wherein the polymorphic marker is in a chromosomal interval flanked by any two of polymorphic loci listed in Table 4; and (c) selecting a progeny tobacco plant comprising the low nicotine trait. In some aspects, these methods produce a single gene conversion comprising a low nicotine trait. In some aspects, these methods produce a single gene conversion comprising a Nic2 introgression. In some aspects, the second tobacco variety is an elite variety. In other aspects, the genotyping step of these methods involve one or more molecular marker assays. In other aspects, the polymorphic marker used this method comprises a polymorphism selected from the group consisting of single nucleotide polymorphisms (SNPs), insertions or deletions in DNA sequence (Indels), simple sequence repeats of DNA sequence (SSRs), a restriction fragment length polymorphism (RFLP), and a tag SNP. In other aspects, the selected progeny tobacco plant comprises a shorter chromosome deletion at Nic2 locus compared to LA Burley 21.

As used herein, "locus" is a chromosome region where a polymorphic nucleic acid, trait determinant, gene, or marker is located. The loci of this disclosure comprise one or more polymorphisms in a population; e.g., alternative alleles are present in some individuals. As used herein, "allele" refers to an alternative nucleic acid sequence at a particular locus. The length of an allele can be as small as 1 nucleotide base, but is typically larger. For example, a first allele can occur on one chromosome, while a second allele occurs on a second homologous chromosome, e.g., as occurs for different chromosomes of a heterozygous individual, or between different homozygous or heterozygous individuals in a population. As used herein, the term "chromosome interval" designates a contiguous linear span of genomic DNA that resides on a single chromosome.

As used herein, a centimorgan ("cM") is a unit of measure of recombination frequency. One cM is equal to a 1% chance that a marker at one genetic locus will be separated from a marker at, a second locus due to crossing over in a single generation. Genetic distances referred herein can be calculated from recombination values using the Kosambi function (Kosambi, The estimation of map distances from recombination values. Annals of Eugenics, 12:172-75 (1944)).

As used herein, "closely linked to" or "associated with" means that the marker or locus is within about 20 cM, 10 cM, 5 cM, 1 cM, 0.5 cM, or less than 0.5 cM of another marker or locus. For example, 20 cM means that recombination between the marker and the locus with a frequency of equal to or less than about 20%.

As used herein, "introgression" or "introgress" refers to the transmission of a desired allele of a genetic locus from one genetic background to another.

As used herein, "crossed" or "cross" means to produce progeny via fertilization (e.g. cells, seeds or plants) and includes crosses between plants (sexual) and self fertilization (selfing).

As used herein, "backcross" and "backcrossing" refer to the process whereby a progeny plant is repeatedly crossed back to one of its parents. In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. The initial cross gives rise to the F1 generation. The term "BC1" refers to the second use of the recurrent parent, "BC2" refers to the third use of the recurrent parent, and so on. In some aspects, a backcross is performed repeatedly, with a progeny individual of each successive backcross generation being itself backcrossed to the same parental genotype.

As used herein, "single gene converted" or "single gene conversion" refers to plants that are developed using a plant breeding technique known as backcrossing, or via genetic engineering, wherein essentially all of the desired morphological and physiological characteristics of a variety are recovered in addition to the single gene transferred into the variety via the backcrossing technique or via genetic engineering.

As used herein, "elite variety" means any variety that has resulted from breeding and selection for superior agronomic performance.

As used herein, "selecting" or "selection" in the context of marker-assisted selection or breeding refer to the act of picking or choosing desired individuals, normally from a population, based on certain pre-determined criteria.

As used herein, the term "trait" refers to one or more detectable characteristics of a cell or organism which can be influenced by genotype. The phenotype can be observable to the naked eye, or by any other means of evaluation known in the art, e.g., microscopy, biochemical analysis, genomic analysis, an assay for a particular disease tolerance, etc. In some cases, a phenotype is directly controlled by a single gene or genetic locus, e.g., a "single gene trait." In other cases, a phenotype is the result of several genes.

As used herein, "marker assay" means a method for detecting a polymorphism at a particular locus using a particular method, e.g., measurement of at least one phenotype (such as seed color, flower color, or other visually detectable trait), restriction fragment length polymorphism (RFLP), single base extension, electrophoresis, sequence alignment, allelic specific oligonucleotide hybridization (ASO), random amplified polymorphic DNA (RAPD), microarray-based technologies, and nucleic acid sequencing technologies, etc.

As used herein, "marker assisted selection" (MAS) is a process by which phenotypes are selected based on marker genotypes. "Marker assisted selection breeding" refers to the process of selecting a desired trait or traits in a plant or plants by detecting one or more nucleic acids from the plant, where the nucleic acid is linked to the desired trait, and then selecting the plant or germplasm possessing those one or more nucleic acids.

As used herein, "polymorphism" means the presence of one or more variations in a population. A polymorphism may manifest as a variation in the nucleotide sequence of a nucleic acid or as a variation in the amino acid sequence of a protein. Polymorphisms include the presence of one or more variations of a nucleic acid sequence or nucleic acid feature at one or more loci in a population of one or more individuals. The variation may comprise but is not limited to one or more nucleotide base changes, the insertion of one or more nucleotides or the deletion of one or more nucleotides. A polymorphism may arise from random processes in nucleic acid replication, through mutagenesis, as a result of mobile genomic elements, from copy number variation and during the process of meiosis, such as unequal crossing over, genome duplication and chromosome breaks and fusions. The variation can be commonly found or may exist at low frequency within a population, the former having greater utility in general plant breeding and the latter may be associated with rare but important phenotypic variation. Useful polymorphisms may include single nucleotide polymorphisms (SNPs), insertions or deletions in DNA sequence (Indels), simple sequence repeats of DNA sequence (SSRs), a restriction fragment length polymorphism (RFLP), and a tag SNP. A genetic marker, a gene, a DNA-derived sequence, a RNA-derived sequence, a promoter, a 5' untranslated region of a gene, a 3' untranslated region of a gene, microRNA, siRNA, a tolerance locus, a satellite marker, a transgene, mRNA, ds mRNA, a transcriptional profile, and a methylation pattern may also comprise polymorphisms. In addition, the presence, absence, or variation in copy number of the preceding may comprise polymorphisms.

As used herein, "SNP" or "single nucleotide polymorphism" means a sequence variation that occurs when a single nucleotide (A, T, C, or G) in the genome sequence is altered or variable. "SNP markers" exist when SNPs are mapped to sites on the genome.

As used herein, "marker" or "molecular marker" or "marker locus" is a term used to denote a nucleic acid or amino acid sequence that is sufficiently unique to characterize a specific locus on the genome. Any detectable polymorphic trait can be used as a marker so long as it is inherited differentially and exhibits linkage disequilibrium with a phenotypic trait of interest. Each marker is therefore an indicator of a specific segment of DNA, having a unique nucleotide sequence. The map positions provide a measure of the relative positions of particular markers with respect to one another. When a trait is stated to be linked to a given marker it will be understood that the actual DNA segment whose sequence affects the trait generally co-segregates with the marker. More precise and definite localization of a trait can be obtained if markers are identified on both sides of the trait. By measuring the appearance of the marker(s) in progeny of crosses, the existence of the trait can be detected by relatively simple molecular tests without actually evaluating the appearance of the trait itself, which can be difficult and time-consuming because the actual evaluation of the trait requires growing plants to a stage and/or under environmental conditions where the trait can be expressed. In some aspects, markers used herein exhibit LOD scores of 2 or greater, 3 or greater, 4 or greater, 5 or greater, 6 or greater, 7 or greater, 8 or greater, or 9 or greater with Nic1 or Nic2 loci disclosed herein, measuring using a method known in the art such as Qgene Version 2.23 (1996) and default parameters.

In one aspect, the present disclosure provides a tobacco plant, or part thereof, comprising a first chromosomal deletion flanked by and not comprising any two of Nic1 Marker Nos. 1 to 207, a second chromosomal deletion flanked by and not comprising any two of Nic2 Marker Nos. 1 to 340, or both said first and said second chromosomal deletions, wherein said tobacco plant is capable of producing leaves having a USDA grade index value of 50 or more, 55 or more, 60 or more, 65 or more, 70 or more, 75 or more, 80 or more, 85 or more, 90 or more, or 95 or more. In another aspect, a tobacco plant comprises a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%. In one aspect, further provided are a population of the tobacco plants in this paragraph, cured tobacco material made therefrom, a tobacco blend comprising said cured tobacco material, and a tobacco product comprising the cured tobacco material.

In another aspect, the present disclosure provides a tobacco plant, or part thereof, comprising a mutation selected from the group consisting of a first chromosomal deletion flanked by and not comprising any two of Nic1 Marker Nos. 1 to 207, a second chromosomal deletion flanked by and not comprising any two of Nic2 Marker Nos. 1 to 340, and both said first and said second chromosomal deletions, wherein said tobacco plant is capable of producing leaves having a USDA grade index value comparable to that of a control plant when grown in similar growth conditions, wherein said control plant shares an essentially identical genetic background with said tobacco plant except said mutation. In one aspect, a tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of said control plant when grown in similar growth conditions. In one aspect, further provided are a population of the tobacco plants in this paragraph, cured tobacco material made therefrom, a tobacco blend comprising said cured tobacco material, and a tobacco product comprising the cured tobacco material.

In one aspect, a first chromosomal deletion is flanked by and not comprising any two of Nic1 Marker Nos. 1 to 20, 21 to 40, 41 to 60, 61 to 80, 81 to 100, 101 to 120, 121 to 140, 141 to 160, 161 to 180, 181 to 200, or 201 to 207. In another aspect, a first chromosomal deletion is flanked by and not comprising any two of Nic1 Marker Nos. 1 to 10, 11 to 20, 21 to 30, 31 to 40, 41 to 50, 51 to 60, 61 to 70, 71 to 80, 81 to 90, 91 to 100, 101 to 110, 111 to 120, 121 to 130, 131 to 140, 141 to 150, 151 to 160, 161 to 170, 171 to 180, 181 to 190, 191 to 200, or 201 to 207.

In one aspect, a second chromosomal deletion is flanked by and not comprising any two of Nic2 Marker Nos. 1 to 20, 21 to 40, 41 to 60, 61 to 80, 81 to 100, 101 to 120, 121 to 140, 141 to 160, 161 to 180, 181 to 200, 201 to 220, 221 to 240, 241 to 260, 261 to 280, 281 to 300, 301 to 320, or 321 to 340. In another aspect, a second chromosomal deletion is flanked by and not comprising any two of Nic2 Marker Nos. 1 to 10, 11 to 20, 21 to 30, 31 to 40, 41 to 50, 51 to 60, 61 to 70, 71 to 80, 81 to 90, 91 to 100, 101 to 110, 111 to 120, 121 to 130, 131 to 140, 141 to 150, 151 to 160, 161 to 170, 171 to 180, 181 to 190, 191 to 200, 201 to 210, 211 to 220, 221 to 230, 231 to 240, 241 to 250, 251 to 260, 261 to 270, 271 to 280, 281 to 290, 291 to 300, 301 to 310, 311 to 320, 321 to 330, or 331 to 340.

It is understood that any tobacco plant of the present disclosure can further comprise additional agronomically desirable traits, for example, by transformation with a genetic construct or transgene using a technique known in the art. Without limitation, an example of a desired trait is herbicide resistance, pest resistance, disease resistance; high yield; high grade index value; curability; curing quality; mechanical harvestability; holding ability; leaf quality; height, plant maturation (e.g., early maturing, early to medium maturing, medium maturing, medium to late maturing, or late maturing); stalk size (e.g., a small, medium, or a large stalk); or leaf number per plant (e.g., a small (e.g., 5-10 leaves), medium (e.g., 11-15 leaves), or large (e.g., 16-21) number of leaves), or any combination. In some aspects, low-nicotine or nicotine-free tobacco plants or seeds disclosed herein comprise one or more transgenes expressing one or more insecticidal proteins, such as, for example, a crystal protein of *Bacillus thuringiensis* or a vegetative insecticidal protein from *Bacillus cereus*, such as VIP3 (see, for example, Estruch et al. (1997) *Nat. Biotechnol.* 15:137). In other aspects, tobacco plants disclosed herein further comprise an introgressed trait conferring resistance to brown stem rot (U.S. Pat. No. 5,689,035) or resistance to cyst nematodes (U.S. Pat. No. 5,491,081).

The present disclosure also provides tobacco plants comprising an altered nicotine level but having a yield comparable to the yield of corresponding initial tobacco plants without such a nicotine level alternation. In one aspect, a low-nicotine or nicotine-free tobacco variety disclosed herein provides a yield selected from the group consisting of about between 1200 and 3500, between 1300 and 3400, between 1400 and 3300, between 1500 and 3200, between 1600 and 3100, between 1700 and 3000, between 1800 and 2900, between 1900 and 2800, between 2000 and 2700, between 2100 and 2600, between 2200 and 2500, and between 2300 and 2400 lbs/acre. In another aspect, a low-nicotine or nicotine-free tobacco variety disclosed herein provides a yield selected from the group consisting of about between 1200 and 3500, between 1300 and 3500, between 1400 and 3500, between 1500 and 3500, between 1600 and 3500, between 1700 and 3500, between 1800 and 3500, between 1900 and 3500, between 2000 and 3500, between 2100 and 3500, between 2200 and 3500, between 2300 and 3500, between 2400 and 3500, between 2500 and 3500, between 2600 and 3500, between 2700 and 3500, between 2800 and 3500, between 2900 and 3500, between 3000 and 3500, and between 3100 and 3500 lbs/acre. In further aspects, low-nicotine or nicotine-free tobacco plants disclosed herein provide a yield between 65% and 130%, between 70% and 130%, between 75% and 130%, between 80% and 130%, between 85% and 130%, between 90% and 130%, between 95% and 130%, between 100% and 130%, between 105% and 130%, between 110% and 130%, between 115% and 130%, or between 120% and 130% of the yield of a control plant having essentially identical genetic background except a Nic1 mutation, a Nic2 mutation, a Nic1 transgene, a Nic2 transgene, or combinations thereof. In further aspects, low-nicotine or nicotine-free tobacco plants disclosed herein provide a yield between 70% and 125%, between 75% and 120%, between 80% and 115%, between 85% and 110%, or between 90% and 100% of the yield of a control plant having essentially identical genetic background except a Nic1 mutation, a Nic2 mutation, a Nic1 transgene, a Nic2 transgene, or combinations thereof In one aspect, a low-nicotine or nicotine-free tobacco variety disclosed herein is adapted for machine harvesting. In another aspect, a low-nicotine or nicotine-free tobacco variety disclosed herein is harvested mechanically.

In some aspects, tobacco plants provided herein are hybrid plants. Hybrids can be produced by preventing self-pollination of female parent plants (e.g., seed parents) of a first variety, permitting pollen from male parent plants of a second variety to fertilize the female parent plants, and allowing F1 hybrid seeds to form on the female plants. Self-pollination of female plants can be prevented by emasculating the flowers at an early stage of flower development. Alternatively, pollen formation can be prevented on the female parent plants using a form of male sterility. For example, male sterility can be produced by male sterility (MS), or transgenic male sterility wherein a transgene inhibits microsporogenesis and/or pollen formation, or self-incompatibility. Female parent plants containing MS are particularly useful. In aspects in which the female parent plants are MS, pollen may be harvested from male fertile plants and applied manually to the stigmas of MS female parent plants, and the resulting F1 seed is harvested.

Plants can be used to form single-cross tobacco F1 hybrids. Pollen from a male parent plant is manually transferred to an emasculated female parent plant or a female parent plant that is male sterile to form F1 seed. Alternatively, three-way crosses can be carried out wherein a single-cross F1 hybrid is used as a female parent and is crossed with a different male parent. As another alternative, double-cross hybrids can be created wherein the F1 progeny of two different single-crosses are themselves crossed. Self-incompatibility can be used to particular advantage to prevent self-pollination of female parents when forming a double-cross hybrid.

In one aspect, a low-nicotine or nicotine-free tobacco variety disclosed herein is male sterile. In another aspect, a low-nicotine or nicotine-free tobacco variety disclosed herein is cytoplasmic male sterile. Male sterile tobacco plants may be produced by any method known in the art. Methods of producing male sterile tobacco are described in Wernsman, E. A., and Rufty, R. C. 1987. Chapter Seventeen. Tobacco. Pages 669-698 In: Cultivar Development. Crop Species. W. H. Fehr (ed.), MacMillan Publishing Go., Inc., New York, N.Y. 761 pp.

In further aspects, tobacco parts provided herein include, but are not limited to, a leaf, a stem, a root, a seed, a flower, pollen, an anther, an ovule, a pedicel, a fruit, a meristem, a cotyledon, a hypocotyl, a pod, an embryo, endosperm, an explant, a callus, a tissue culture, a shoot, a cell, and a protoplast. In one aspect, tobacco part provided herein does not include seed. In one aspect, this disclosure provides tobacco plant cells, tissues, and organs that are not reproductive material and do not mediate the natural reproduction of the plant. In another aspect, this disclosure also provides tobacco plant cells, tissues, and organs that are reproductive material and mediate the natural reproduction of the plant. In another aspect, this disclosure provides tobacco plant cells, tissues, and organs that cannot maintain themselves via photosynthesis. In another aspect, this disclosure provides somatic tobacco plant cells. Somatic cells, contrary to germline cells, do not mediate plant reproduction.

The provided cells, tissues and organs may be from seed, fruit, leaf, cotyledon, hypocotyl, meristem, embryos, endosperm, root, shoot, stem, pod, flower, inflorescence, stalk, pedicel, style, stigma, receptacle, petal, sepal, pollen, anther, filament, ovary, ovule, pericarp, phloem, vascular tissue. In another aspect, this disclosure provides a tobacco plant chloroplast. In a further aspect, this disclosure provides epidermal cells, stomata cell, leaf or root hairs, a storage root, or a tuber. In another aspect, this disclosure provides a tobacco protoplast.

Skilled artisans understand that tobacco plants naturally reproduce via seeds, not via asexual reproduction or vegetative propagation. In one aspect, this disclosure provides tobacco endosperm. In another aspect, this disclosure provides tobacco endosperm cells. In a further aspect, this disclosure provides a male or female sterile tobacco plant, which cannot reproduce without human intervention.

In some aspects, the present disclosure provides a nucleic acid molecule comprising at least about 40%, 45%, 50%, 55%, 60%, 65%, 70%, 75%, 80%, 85%, 90%, 91%, 92%, 93%, 94%, 95%, 96%, 97%, 98%, 99%, or 100% identity to a sequence selected from the group consisting of SEQ ID NOs: 9 to 48, 75 to 82, 86 to 115, and 131 to 146, and fragments thereof. In other aspects, the present disclosure provides a nucleic acid molecule comprising at least about 40%, 45%, 50%, 55%, 60%, 65%, 70%, 75%, 80%, 85%, 90%, 91%, 92%, 93%, 94%, 95%, 96%, 97%, 98%, 99%, or 100% identity to a sequence selected from the group consisting of SEQ ID NOs: 13, 28, 33, 48, 82, 86, 87, 101, 102, 145, 146, and fragments thereof. In some aspects, the present disclosure provides a polypeptide or protein comprising at least about 40%, 45%, 50%, 55%, 60%, 65%, 70%, 75%, 80%, 85%, 90%, 91%, 92%, 93%, 94%, 95%, 96%, 97%, 98%, 99%, or 100% identity to an amino acid sequence selected from the group consisting of SEQ ID NOs: 49 to 68, 116 to 130, and 147. In other aspects, the present disclosure provides a polypeptide or protein comprising at least about 40%, 45%, 50%, 55%, 60%, 65%, 70%, 75%, 80%, 85%, 90%, 91%, 92%, 93%, 94%, 95%, 96%, 97%, 98%, 99%, or 100% sequence similarity to an amino acid sequence selected from the group consisting of SEQ ID NOs: 49 to 68, 116 to 130, and 147. In other aspects, the present disclosure provides a biologically active variant of a protein having an amino acid sequence selected from the group consisting of SEQ ID NOs: 49 to 68, 116 to 130, and 147. A biologically active variant of a protein of the present disclosure may differ from that protein by as few as 1-15 amino acid residues, as few as 10, as few as 9, as few as 8, as few as 7, as few as 6, as few as 5, as few as 4, as few as 3, as few as 2, or as few as 1 amino acid residue. Also provided herein are orthologous genes or proteins of genes or proteins from Nic1 locus. "Orthologs" are genes derived from a common ancestral gene and which are found in different species as a result of speciation. Orthologs may share at least 60%, 70%, 75%, 80%, 85%, 90%, 91%, 92%, 93%, 94%, 95%, 96%, 97%, 98%, 99%, or greater sequence identity or similarity at the nucleotide sequence and/or the protein sequence level. Functions of orthologs are often highly conserved among species.

As used herein, the term "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity."

Nucleic acid molecules, polypeptides, or proteins provided herein can be isolated or substantially purified. An "isolated" or "purified" nucleic acid molecule, polypeptide, protein, or biologically active portion thereof, is substantially or essentially free from components that normally accompany or interact with the polynucleotide or protein as found in its naturally occurring environment. For example, an isolated or purified polynucleotide or protein is substantially free of other cellular material, or culture medium when produced by recombinant techniques, or substantially free of chemical precursors or other chemicals when chemically synthesized.

The present disclosure further provides a method manufacturing a tobacco product comprising tobacco material from tobacco plants disclosed herein. In some aspects, methods disclosed herein comprise conditioning aged tobacco material made from tobacco plants disclosed herein to increase its moisture content from between about 12.5% and about 13.5% to about 21%, blending the conditioned tobacco material to produce a desirable blend. In one aspect, the method of manufacturing a tobacco product disclosed herein further comprises casing or flavoring the blend. Generally, during the casing process, casing or sauce materials are added to blends to enhance their quality by balancing the chemical composition and to develop certain desired flavor characteristics. Further details for the casing process can be found in *Tobacco Production, Chemistry and Technology*, Edited by L. Davis and M. Nielsen, Blackwell Science, 1999.

Tobacco material provided herein can be also processed using methods including, but not limited to, heat treatment (e.g., cooking, toasting), flavoring, enzyme treatment, expansion and/or curing. Both fermented and non-fermented tobaccos can be processed using these techniques. Examples of suitable processed tobaccos include dark air-cured, dark fire cured, burley, flue cured, and cigar filler or wrapper, as well as the products from the whole leaf stemming operation. In some aspects, tobacco fibers include up to 70% dark tobacco on a fresh weight basis. For example, tobacco can be conditioned by heating, sweating and/or pasteurizing steps as described in U.S. Publication Nos. 2004/0118422 or 2005/0178398.

Tobacco material provided herein can be subject to fermentation. Fermenting typically is characterized by high initial moisture content, heat generation, and a 10 to 20% loss of dry weight. See, e.g., U.S. Pat. Nos. 4,528,993; 4,660,577; 4,848,373; and 5,372,149. In addition to modifying the aroma of the leaf, fermentation can change either or both the color and texture of a leaf. Also during the fermentation process, evolution gases can be produced, oxygen can be taken up, the pH can change, and the amount of water retained can change. See, for example, U.S. Publication No. 2005/0178398 and Tso (1999, Chapter 1 in Tobacco, Production, Chemistry and Technology, Davis & Nielsen, eds., Blackwell Publishing, Oxford). Cured, or cured and fermented tobacco can be further processed (e.g., cut, expanded, blended, milled or comminuted) prior to incorporation into the oral product. The tobacco, in some cases, is long cut fermented cured moist tobacco having an oven volatiles content of between 48 and 50 weight percent prior to mixing with the copolymer and optionally flavorants and other additives.

In some aspects, tobacco material provided herein can be processed to a desired size. In certain aspects, tobacco fibers can be processed to have an average fiber size of less than 200 micrometers. In some aspects, tobacco fibers are between 75 and 125 micrometers. In other aspects, tobacco fibers are processed to have a size of 75 micrometers or less. In some aspects, tobacco fibers include long cut tobacco, which can be cut or shredded into widths of about 10 cuts/inch up to about 110 cuts/inch and lengths of about 0.1 inches up to about 1 inch. Double cut tobacco fibers can have a range of particle sizes such that about 70% of the double cut tobacco fibers falls between the mesh sizes of −20 mesh and 80 mesh.

Tobacco material provided herein can be processed to have a total oven volatiles content of about 10% by weight or greater; about 20% by weight or greater; about 40% by weight or greater; about 15% by weight to about 25% by weight; about 20% by weight to about 30% by weight; about 30% by weight to about 50% by weight; about 45% by weight to about 65% by weight; or about 50% by weight to about 60% by weight. Those of skill in the art will appreciate that "moist" tobacco typically refers to tobacco that has an oven volatiles content of between about 40% by weight and about 60% by weight (e.g., about 45% by weight to about 55% by weight, or about 50% by weight). As used herein, "oven volatiles" are determined by calculating the percentage of weight loss for a sample after drying the sample in a pre-warmed forced draft oven at 110° C. for 3.25 hours. The oral product can have a different overall oven volatiles content than the oven volatiles content of the tobacco fibers used to make the oral product. The processing steps described herein can reduce or increase the oven volatiles content.

The following paragraphs provide a list of exemplary embodiments.

Embodiment 1

A tobacco plant, or part thereof, comprising a mutation in Nic1 locus, a mutation in Nic2 locus, or both, wherein said tobacco plant is capable of producing leaves having a USDA grade index value of 50 or more.

Embodiment 2

The tobacco plant, or part thereof, of Embodiment 1, wherein said tobacco plant is capable of producing leaves having a USDA grade index value selected from the group consisting of 55 or more, 60 or more, 65 or more, 70 or more, 75 or more, 80 or more, 85 or more, 90 or more, and 95 or more.

Embodiment 3

The tobacco plant, or part thereof, of Embodiment 1, wherein said tobacco plant is capable of producing leaves having a USDA grade index value comparable to that of a control plant when grown in similar growth conditions, wherein said control plant shares an essentially identical genetic background with said tobacco plant except said mutation.

Embodiment 4

The tobacco plant, or part thereof, of Embodiment 1, wherein said tobacco plant is capable of producing leaves having a USDA grade index value of at least about 65%, at least about 70%, at least about 75%, at least about 80%, at least about 85%, at least about 90%, at least about 95%, or at least about 98% of the USDA grade index value of a control plant when grown in similar growth conditions, wherein said control plant shares an essentially identical genetic background with said tobacco plant except said mutation.

Embodiment 6

The tobacco plant, or part thereof, of Embodiment 1, wherein said tobacco plant comprises a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%.

Embodiment 7

The tobacco plant, or part thereof, of Embodiment 1, wherein said tobacco plant further comprises a transgene or mutation directly suppressing the expression or activity of one or more genes encoding a product selected from the group consisting of PMT, MPO, QPT, BBL, A622, and MATE transporter.

Embodiment 8

A tobacco plant, or part thereof, comprising a mutation in Nic1 locus, a mutation in Nic2 locus, or both, wherein said tobacco plant is capable of producing leaves having a USDA grade index value comparable to that of a control plant when grown in similar growth conditions, wherein said control plant shares an essentially identical genetic background with said tobacco plant except said mutation.

Embodiment 9

The tobacco plant, or part thereof, of Embodiment 8, wherein said tobacco plant is capable of producing leaves having a USDA grade index value selected from the group consisting of 55 or more, 60 or more, 65 or more, 70 or more, 75 or more, 80 or more, 85 or more, 90 or more, and 95 or more.

Embodiment 10

The tobacco plant, or part thereof, of Embodiment 8, wherein said tobacco plant is capable of producing leaves having a USDA grade index value of at least about 65%, at least about 70%, at least about 75%, at least about 80%, at least about 85%, at least about 90%, at least about 95%, or at least about 98% of the grading index of said control plant.

Embodiment 11

The tobacco plant, or part thereof, of Embodiment 8, wherein said tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of said control plant when grown in similar growth conditions.

Embodiment 12

The tobacco plant, or part thereof, of Embodiment 8, wherein said tobacco plant further comprises a transgene or mutation directly suppressing the expression or activity of one or more genes encoding a product selected from the group consisting of PMT, MPO, QPT, BBL, A622, and MATE transporter.

Embodiment 13

A plant of a tobacco variety comprising a mutation selected from the group consisting of a nic1 mutation, a nic2 mutation, and a combination thereof, wherein said tobacco variety has a leaf grading index comparable to the leaf grading index of a control tobacco variety when grown in similar growth conditions, wherein said control tobacco variety shares an essentially identical genetic background with said tobacco variety except said mutation.

Embodiment 14

A non-transgenic tobacco plant, or part thereof, comprising a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%, wherein said tobacco plant is capable of producing leaves having a USDA grade index value of 50 or more 55 or more, 60 or more, 65 or more, 70 or more, 75 or more, 80 or more, 85 or more, 90 or more, and 95 or more.

Embodiment 15

The non-transgenic tobacco plant, or part thereof, of claim 14, wherein said non-transgenic tobacco plant comprises a nicotine level of less than 2.0% and is capable of producing leaves having a USDA grade index value of 70 or more.

Embodiment 16

The non-transgenic tobacco plant, or part thereof, of claim 14, wherein said non-transgenic tobacco plant comprises a nicotine level of less than 1.0% and is capable of producing leaves having a USDA grade index value of 70 or more.

Embodiment 17

A tobacco plant, or part thereof, comprising a non-transgenic mutation, wherein said non-transgenic mutation reduces the nicotine level of said tobacco plant to below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, wherein said tobacco plant is capable of producing leaves having a USDA grade index value comparable to the USDA grade index value of said control plant, and wherein said control plant shares an essentially identical genetic background with said tobacco plant except said non-transgenic mutation.

Embodiment 18

A population of the tobacco plants of any one of Embodiments 1 to 17.

Embodiment 19

Cured tobacco material from the tobacco plant of any one of claims 1 to 17.

Embodiment 20

The cured tobacco material of Embodiment 19, wherein said cured tobacco material is made by a curing process selected from the group consisting of flue curing, air curing, fire curing, and sun curing.

Embodiment 21

A tobacco blend comprising the cured tobacco material of claim 19.

Embodiment 22

The tobacco blend of Embodiment 21, wherein the cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in said tobacco blend by weight.

Embodiment 23

The tobacco blend of Embodiment 21, wherein the cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in said tobacco blend by volume.

Embodiment 24

A tobacco product comprising the cured tobacco material of claim 19.

Embodiment 25

The tobacco product of Embodiment 24, wherein the tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.

Embodiment 26

The tobacco product of Embodiment 24, wherein the tobacco product is a smokeless tobacco product.

Embodiment 27

The tobacco product of Embodiment 26, wherein the smokeless tobacco product is selected from the group consisting of loose leaf chewing tobacco, plug chewing tobacco, moist snuff, and nasal snuff.

Embodiment 28

A reconstituted tobacco comprising the cured tobacco material of claim 19.

Embodiment 29

A tobacco plant, or part thereof, comprising a mutation in Nic1 locus, wherein said mutation is absent from a LA Burley 21 variety.

Embodiment 30

The tobacco plant, or part thereof, of Embodiment 29, wherein said tobacco plant comprises a shorter chromosome deletion at Nic1 locus compared to said LA Burley 21 variety.

Embodiment 31

The tobacco plant, or part thereof, of Embodiment 29, wherein said tobacco plant comprises a lower level of nicotine compared to a control tobacco plant without said mutation when grown in similar growth conditions.

Embodiment 32

The tobacco plant, or part thereof, of Embodiment 29, wherein said tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level in a control tobacco plant without said mutation when grown in similar growth conditions.

Embodiment 33

The tobacco plant, or part thereof, of Embodiment 29, wherein said tobacco plant comprises a lower level of total alkaloid compared to a control tobacco plant without said mutation when grown in similar growth conditions.

Embodiment 34

The tobacco plant, or part thereof, of Embodiment 29, wherein said tobacco plant comprises a lower level of one or more alkaloid selected from the group consisting of nicotine, nornicotine, anabasine, and anatabine, compared to a control tobacco plant without said mutation when grown in similar growth conditions.

Embodiment 35

The tobacco plant, or part thereof, of Embodiment 29, wherein said tobacco plant comprises a similar level of one or more compounds selected from the group consisting of 3-methylvaleric acid, valeric acid, isovaleric acid, a labdenoid, a cembrenoid, a sugar ester, and a reducing sugar, compared to a control tobacco plant without said mutation when grown in similar growth conditions.

Embodiment 36

The tobacco plant, or part thereof, of Embodiment 29, wherein said mutation is homozygous.

Embodiment 37

The tobacco plant, or part thereof, of Embodiment 29, wherein said mutation is heterozygous.

Embodiment 38

The tobacco plant, or part thereof, of Embodiment 29, wherein said mutation is selected from the group consisting of a point mutation, a deletion, an insertion, a duplication, and an inversion.

Embodiment 39

The tobacco plant, or part thereof, of Embodiment 29, wherein said mutation is introduced by an approach selected from the group consisting of random mutagenesis and targeted mutagenesis.

Embodiment 40

The tobacco plant, or part thereof, of Embodiment 39, wherein said targeted mutagenesis is mediated by meganuclease, zinc finger nuclease, TALEN, or CRISPR.

Embodiment 41

The tobacco plant, or part thereof, of Embodiment 29, wherein said tobacco plant further comprises a mutation in Nic2 locus.

Embodiment 42

The tobacco plant, or part thereof, of Embodiment 29, wherein said mutation is located within a gene comprising a sequence having at least 80%, at least 85%, at least 90%, at least 95%, at least 97%, at least 98%, at least 99% identity to a sequence selected from the group consisting of SEQ ID NOs: 9 to 28, 75 to 82, 86 to 100, 145, and fragments thereof.

Embodiment 43

The tobacco plant, or part thereof, of Embodiment 29, wherein said mutation reduces the expression or activity of said gene.

Embodiment 44

The tobacco plant, or part thereof, of Embodiment 29, wherein said mutation is located within a gene comprising a sequence having at least 80%, at least 85%, at least 90%, at least 95%, at least 97%, at least 98%, at least 99% identity to a sequence selected from the group consisting of SEQ ID NOs: 13, 28, 33, 48, 82, 86, 87, 101, 102, 145, and 146, and fragments thereof.

Embodiment 45

The tobacco plant, or part thereof, of Embodiment 29, wherein said mutation is located within a sequence having at least 80%, at least 85%, at least 90%, at least 95%, at least 97%, at least 98%, at least 99% identity to a sequence selected from the group consisting of SEQ ID NOs: 13, 28, 33, 48, 82, 86, 87, 101, 102, 145, and 146, and fragments thereof.

Embodiment 46

The tobacco plant, or part thereof, of Embodiment 29, wherein said mutation is located within a gene comprising a coding sequence having at least 80%, at least 85%, at least 90%, at least 95%, at least 97%, at least 98%, at least 99% identity to a sequence selected from the group consisting of SEQ ID NOs: 33, 48, 101, 102, and 146, and fragments thereof.

Embodiment 47

The tobacco plant, or part thereof, of Embodiment 29, wherein said mutation is located within a sequence having at least 80%, at least 85%, at least 90%, at least 95%, at least 97%, at least 98%, at least 99% identity to a sequence selected from the group consisting of SEQ ID NOs: 33, 48, 101, 102, and 146, and fragments thereof.

Embodiment 48

The tobacco plant, or part thereof, of Embodiment 29, wherein said mutation is located within a gene encoding a polypeptide having at least 80%, at least 85%, at least 90%, at least 95%, at least 97%, at least 98%, at least 99% identity to a sequence selected from the group consisting of SEQ ID NOs: 53, 68, 116, 117, 147, and fragments thereof.

Embodiment 49

The tobacco plant, or part thereof, of Embodiment 29, wherein said plant further comprises a reduced level of mRNA, protein, or both of one or more genes encoding a product selected from the group consisting of PMT, MPO, QPT, BBL, MATE, and A622, compared to a tobacco plant without said mutation when grown in similar growth conditions.

Embodiment 50

The tobacco plant, or part thereof, of Embodiment 29, wherein said plant further comprises a transgene or mutation suppressing the expression or activity of one or more genes encoding a product selected from the group consisting of PMT, MPO, QPT, BBL, A622, and MATE transporter.

Embodiment 51

The tobacco plant, or part thereof, of Embodiment 29, wherein said tobacco plant is a hybrid.

Embodiment 52

The tobacco plant, or part thereof, of Embodiment 29, wherein said part is selected from the group consisting of a leaf, a stem, a root, a seed, a flower, pollen, an anther, an ovule, a pedicel, a fruit, a meristem, a cotyledon, a hypocotyl, a pod, an embryo, endosperm, an explant, a callus, a tissue culture, a shoot, a cell, and a protoplast.

Embodiment 53

The tobacco plant, or part thereof, of Embodiment 29, wherein said tobacco plant is from a variety selected from the group consisting of flue-cured tobacco, air-cured tobacco, dark fire-cured tobacco, and *Galpao* tobacco, and Oriental tobacco.

Embodiment 54

The tobacco plant, or part thereof, of Embodiment 29, wherein said tobacco plant is from a variety selected from the group consisting of Burley tobacco, Maryland tobacco, and dark air-cured tobacco.

Embodiment 55
A population of the tobacco plants of Embodiment 29.

Embodiment 56
Cured tobacco material from the tobacco plant of Embodiment 29.

Embodiment 57
The cured tobacco material of Embodiment 56, wherein said cured tobacco material comprises a lower level of nicotine compared to cured tobacco material from a control tobacco plant without said mutation.

Embodiment 58
The cured tobacco material of Embodiment 56, wherein said tobacco plant comprises nicotine at a level between 0.2% and 0.6%.

Embodiment 59
The cured tobacco material of Embodiment 56, wherein said tobacco plant comprises nicotine at a level between 1.0% and 3.0%.

Embodiment 60
The cured tobacco material of Embodiment 56, wherein said cured tobacco material is made by a curing process selected from the group consisting of flue curing, air curing, fire curing, and sun curing.

Embodiment 61
A tobacco blend comprising the cured tobacco material of claim 56.

Embodiment 62
A tobacco product comprising the cured tobacco material of claim 56.

Embodiment 63
The tobacco product of Embodiment 62, wherein the tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.

Embodiment 64
The tobacco product of Embodiment 62, wherein the tobacco product is a smokeless tobacco product.

Embodiment 65
The tobacco product of Embodiment 64, wherein the smokeless tobacco product is selected from the group consisting of loose leaf chewing tobacco, plug chewing tobacco, moist snuff, and nasal snuff.

Embodiment 66
A reconstituted tobacco comprising the cured tobacco material of claim 56.

Embodiment 67
A recombinant DNA construct comprising a promoter that is functional in a tobacco cell and operably linked to a polynucleotide that encodes a polypeptide having an amino acid sequence at least 80%, at least 85%, at least 90%, at least 95%, at least 97%, at least 98%, at least 99% identical to an amino acid sequence selected from the group consisting of SEQ ID NOs: 49 to 68, 84, 116 to 130, 147, and fragments thereof.

Embodiment 68
A tobacco plant, or part thereof, comprising the recombinant DNA construct of claim 67.

Embodiment 69
A tobacco plant, or part thereof, of Embodiment 68, wherein said tobacco plant comprises a higher level of nicotine compared to a control tobacco plant without said recombinant DNA construct.

Embodiment 70
Cured tobacco material from the tobacco plant of Embodiment 68.

Embodiment 71
A tobacco product comprising the cured tobacco material of claim 70.

Embodiment 72
A method of increasing the nicotine level of a tobacco plant, said method comprising transforming a tobacco plant with the recombinant DNA construct of claim 67.

Embodiment 73
A recombinant DNA construct comprising a promoter that is functional in a tobacco cell and operably linked to a polynucleotide that encodes an RNA molecule capable of binding to an RNA encoding a polypeptide having an amino acid sequence at least 80%, at least 85%, at least 90%, at least 95%, at least 97%, at least 98%, at least 99% identical to an amino acid sequence selected from the group consisting of SEQ ID NO: 49 to 68, 84, 116 to 130, 147, and fragments thereof, and wherein said RNA molecule suppresses the expression of said polypeptide.

Embodiment 74
A tobacco plant, or part thereof, comprising the recombinant DNA construct of claim 73.

Embodiment 75
The tobacco plant, or part thereof, of Embodiment 74, wherein said RNA molecule is selected from the group consisting of a microRNA, an siRNA, and a trans-acting siRNA.

Embodiment 76
The tobacco plant, or part thereof, of Embodiment 74, wherein said polynucleotide encodes a double stranded RNA.

Embodiment 77
The tobacco plant, or part thereof, of Embodiment 74, wherein said tobacco plant comprises a lower level of nicotine compared to a control tobacco plant without said recombinant DNA construct.

Embodiment 78
Cured tobacco material from the tobacco plant of Embodiment 74.

Embodiment 79
A tobacco product comprising the cured tobacco material of claim 78.

Embodiment 80
A method of reducing the nicotine level of a tobacco plant, said method comprising transforming a tobacco plant with the recombinant DNA construct of claim 73.

Embodiment 81
A tobacco plant, or part thereof, comprising a heterologous expression cassette comprising a Nic1 inhibitory sequence of a gene comprising a sequence selected from the group consisting of SEQ ID NOs: 9 to 28, 75 to 82, 86 to 100, 145, and fragments thereof, wherein said inhibitory sequence is operably linked to a promoter that is functional in a plant cell, and wherein said inhibitory sequence has at least 90% sequence identity to a fragment of at least 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides of sequence selected from the group consisting of SEQ ID NOs: 9 to 28, 75 to 82, 86 to 100, 145, and fragments thereof.

Embodiment 82
The tobacco plant, or part thereof, of Embodiment 81, wherein said Nic1 inhibitory sequence is capable of being transcribed as an inhibitory polynucleotide selected from the group consisting of a single-stranded RNA polynucleotide, a double-stranded RNA polynucleotide, and a combination thereof.

Embodiment 83

The tobacco plant, or part thereof, of Embodiment 81, wherein said promoter is selected from the group consisting of a constitutive promoter, an inducible promoter, and a tissue-preferred promoter.

Embodiment 84

The tobacco plant, or part thereof, of Embodiment 81, wherein said promoter is a root-specific promoter.

Embodiment 85

A tobacco plant, or part thereof, comprising a heterologous expression cassette comprising a Nic1 inhibitory sequence of a gene comprising a sequence selected from the group consisting of SEQ ID NOs: 13, 28, 33, 48, 82, 86, 87, 101, 102, 145, and 146, and fragments thereof, wherein said inhibitory sequence is operably linked to a promoter that is functional in a plant cell, and wherein said inhibitory sequence has at least 90% sequence identity to a fragment of at least 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides of sequence selected from the group consisting of SEQ ID NOs: 13, 28, 33, 48, 82, 86, 87, 101, 102, 145, and 146, and fragments thereof.

Embodiment 86

A method of introgressing a low nicotine trait into a tobacco variety, said method comprising:
 a. crossing a first tobacco variety comprising a low nicotine trait with a second tobacco variety without said low nicotine trait to produce one or more progeny tobacco plants;
 b. genotyping the one or more progeny tobacco plants for a polymorphic marker linked to said low nicotine trait, wherein said polymorphic marker is in a chromosomal interval flanked by any two of polymorphic loci listed in Table 3 or flanked by any two of polymorphic loci listed in Table 4; and
 c. selecting a progeny tobacco plant comprising the low nicotine trait.

Embodiment 87

The method of Embodiment 86, wherein the method further comprises backcrossing said selected progeny tobacco plant with said second tobacco variety.

Embodiment 88

The method of Embodiment 86, wherein the method further comprises:
 d. crossing the selected progeny plant with itself or with the second tobacco variety to produce one or more further progeny tobacco plants; and
 e. selecting a further progeny tobacco plant comprising the low nicotine trait.

Embodiment 89

The method of Embodiment 88, wherein the step (e) of selecting comprises marker-assisted selection.

Embodiment 90

The method of Embodiment 86, wherein the method produces a single gene conversion comprising said low nicotine trait.

Embodiment 91

The method of Embodiment 86, wherein the second tobacco variety is an elite variety.

Embodiment 92

The method of Embodiment 86, wherein the genotyping involves one or more molecular marker assays.

Embodiment 93

The method of Embodiment 86, wherein the polymorphic marker comprises a polymorphism selected from the group consisting of single nucleotide polymorphisms (SNPs), insertions or deletions in DNA sequence (Indels), simple sequence repeats of DNA sequence (SSRs), a restriction fragment length polymorphism (RFLP), and a tag SNP.

Embodiment 94

The method of Embodiment 86, wherein the genotyping comprises assaying for the presence or absence of a nucleic acid sequence located within a sequence having at least 80%, at least 85%, at least 90%, at least 95%, at least 97%, at least 98%, at least 99% identity to a sequence selected from the group consisting of SEQ ID NOs: 9 to 28, 75 to 82, 86 to 100, 145, and fragments thereof.

Embodiment 95

The method of Embodiment 86, wherein the genotyping comprises assaying for the presence or absence of a nucleic acid sequence located within a sequence having at least 80%, at least 85%, at least 90%, at least 95%, at least 97%, at least 98%, at least 99% identity to a sequence selected from the group consisting of SEQ ID Nos: 13, 28, 33, 48, 82, 86, 87, 101, 102, 145, and 146, and fragments thereof.

Embodiment 96

The method of Embodiment 86, wherein the first tobacco variety is LA Burley 21.

Embodiment 97

The method of Embodiment 86, wherein the selected progeny tobacco plant comprises a shorter chromosome deletion at Nic1 locus compared to LA Burley 21.

Embodiment 98

A method of introgressing a low nicotine trait into a tobacco variety, said method comprising:
a. crossing a first tobacco variety comprising a low nicotine trait with a second tobacco variety without said low nicotine trait to produce one or more progeny tobacco plants;
b. genotyping the one or more progeny tobacco plants for a polymorphic marker linked to said low nicotine trait, wherein said polymorphic marker is within 20 cM of any one of polymorphic loci listed in Table 3 and Table 4, or is any one of SEQ ID Nos. 131 to 144; and
c. selecting a progeny tobacco plant comprising the low nicotine trait.

Embodiment 99

The method of Embodiment 98, wherein the genotyping comprises assaying for the presence or absence of a nucleic acid sequence located within a sequence having at least 80%, at least 85%, at least 90%, at least 95%, at least 97%, at least 98%, at least 99% identity to a sequence selected from the group consisting of SEQ ID NOs: 9 to 28, 75 to 82, 86 to 100, 145, and fragments thereof.

Embodiment 100

The method of Embodiment 98, wherein the genotyping comprises assaying for the presence or absence of a nucleic acid sequence located within a sequence having at least 80%, at least 85%, at least 90%, at least 95%, at least 97%, at least 98%, at least 99% identity to a sequence selected from the group consisting of SEQ ID NOs: 13, 28, 33, 48, 82, 86, 87, 101, 102, 145, and 146, and fragments thereof.

Embodiment 101

A method of selecting a tobacco plant having a low nicotine trait, said method comprising:
a. isolating nucleic acids from a collection of tobacco germplasm;
b. assaying the nucleic acids for one or more markers closely linked to Nic1 locus or Nic2 locus; and c. selecting a tobacco plant having a low nicotine trait based on the marker assay.

Embodiment 102

The method of Embodiment 101, wherein the one or more markers are within about 20 cM, 10 cM, 5 cM, 4 cM, 3 cM, 2 cM, 1 cM, 0.5 cM, or less than 0.5 cM of any one of polymorphic loci listed in Table 3 and Table 4, or any one of SEQ ID Nos. 131 to 144.

Embodiment 103

The method of Embodiment 101, wherein the assaying comprises assaying for the presence or absence of a nucleic acid sequence located within a sequence having at least 80%, at least 85%, at least 90%, at least 95%, at least 97%, at least 98%, at least 99% identity to a sequence selected from the group consisting of SEQ ID NOs: 9 to 28, 75 to 82, 86 to 100, 145, and fragments thereof.

Embodiment 104

The method of Embodiment 101, wherein the assaying comprises assaying for the presence or absence of a nucleic acid sequence located within a sequence having at least 80%, at least 85%, at least 90%, at least 95%, at least 97%, at least 98%, at least 99% identity to a sequence selected from the group consisting of SEQ ID NOs: 13, 28, 33, 48, 82, 86, 87, 101, 102, 145, and 146, and fragments thereof.

Embodiment 105

The method of Embodiment 101, wherein the method further comprises determining the nicotine level of said selected plant to confirm said low nicotine trait.

Embodiment 106

The method of Embodiment 101, wherein the collection of tobacco germplasm is a haploid breeding population.

Embodiment 107

A tobacco plant, or part thereof, comprising a first chromosomal deletion flanked by and not comprising any two of Nic1 Marker Nos. 1 to 207, a second chromosomal deletion flanked by and not comprising any two of Nic2 Marker Nos. 1 to 340, or both said first and said second chromosomal deletions, wherein said tobacco plant is capable of producing leaves having a USDA grade index value of 50 or more, 55 or more, 60 or more, 65 or more, 70 or more, 75 or more, 80 or more, 85 or more, 90 or more, or 95 or more.

Embodiment 108

The tobacco plant, or part thereof, of Embodiment 107, wherein said tobacco plant comprises a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%.

Embodiment 109

The tobacco plant, or part thereof, of Embodiment 107, wherein said first chromosomal deletion is flanked by and not comprising any two of Nic1 Marker Nos. 1 to 20, 21 to 40, 41 to 60, 61 to 80, 81 to 100, 101 to 120, 121 to 140, 141 to 160, 161 to 180, 181 to 200, or 201 to 207.

Embodiment 110

The tobacco plant, or part thereof, of Embodiment 107, wherein said first chromosomal deletion is flanked by and not comprising any two of Nic1 Marker Nos. 1 to 10, 11 to 20, 21 to 30, 31 to 40, 41 to 50, 51 to 60, 61 to 70, 71 to 80, 81 to 90, 91 to 100, 101 to 110, 111 to 120, 121 to 130, 131 to 140, 141 to 150, 151 to 160, 161 to 170, 171 to 180, 181 to 190, 191 to 200, or 201 to 207.

Embodiment 111

The tobacco plant, or part thereof, of Embodiment 107, wherein said second chromosomal deletion is flanked by and not comprising any two of Nic2 Marker Nos. 1 to 20, 21 to 40, 41 to 60, 61 to 80, 81 to 100, 101 to 120, 121 to 140, 141 to 160, 161 to 180, 181 to 200, 201 to 220, 221 to 240, 241 to 260, 261 to 280, 281 to 300, 301 to 320, or 321 to 340.

Embodiment 112

The tobacco plant, or part thereof, of Embodiment 107, wherein said second chromosomal deletion is flanked by and not comprising any two of Nic2 Marker Nos. 1 to 10, 11 to 20, 21 to 30, 31 to 40, 41 to 50, 51 to 60, 61 to 70, 71 to 80, 81 to 90, 91 to 100, 101 to 110, 111 to 120, 121 to 130, 131 to 140, 141 to 150, 151 to 160, 161 to 170, 171 to 180, 181 to 190, 191 to 200, 201 to 210, 211 to 220, 221 to 230, 231 to 240, 241 to 250, 251 to 260, 261 to 270, 271 to 280, 281 to 290, 291 to 300, 301 to 310, 311 to 320, 321 to 330, or 331 to 340.

Embodiment 113

A tobacco plant, or part thereof, comprising a mutation selected from the group consisting of a first chromosomal deletion flanked by and not comprising any two of Nic1 Marker Nos. 1 to 207, a second chromosomal deletion flanked by and not comprising any two of Nic2 Marker Nos. 1 to 340, and both said first and said second chromosomal deletions, wherein said tobacco plant is capable of producing leaves having a USDA grade index value comparable to that of a control plant when grown in similar growth conditions, wherein said control plant shares an essentially identical genetic background with said tobacco plant except said mutation.

Embodiment 114

The tobacco plant, or part thereof, of Embodiment 113, wherein said tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of said control plant when grown in similar growth conditions.

Embodiment 115

A population of the tobacco plants of any one of Embodiments 107 to 114.

Embodiment 116

Cured tobacco material from the tobacco plant of any one of claims 107 to 114.

Embodiment 117

The cured tobacco material of Embodiment 116, wherein said cured tobacco material is made by a curing process selected from the group consisting of flue curing, air curing, fire curing, and sun curing.

Embodiment 118

A tobacco blend comprising the cured tobacco material of claim 116.

Embodiment 119

The tobacco blend of Embodiment 118, wherein the cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in said tobacco blend by weight.

Embodiment 120

The tobacco blend of Embodiment 118, wherein the cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in said tobacco blend by volume.

Embodiment 121

A tobacco product comprising the cured tobacco material of claim 116.

Embodiment 122

The tobacco product of Embodiment 121, wherein the tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.

Embodiment 123

The tobacco product of Embodiment 121, wherein the smokeless tobacco product is selected from the group consisting of loose leaf chewing tobacco, plug chewing tobacco, moist snuff, and nasal snuff.

Having now generally described the disclosure, the same will be more readily understood through reference to the following examples that are provided by way of illustration, and are not intended to be limiting of the present disclosure, unless specified.

EXAMPLES

Example 1

Whole Genome Sequencing of Tobacco Lines Having Low Alkaloid

Whole genome sequencing was used to determine the genetic lesion underlying the nic1 mutation in Low Alkaloid (LA) Burley 21. Four tobacco lines were sequenced. These are LA Burley 21 (nic1 nic2, Average nicotine ~0.3% on a dry weight basis (Range~0.2-0.6%)), Low Intermediate (LI) Burley 21 (nic1 Nic2, Average nicotine ~2.3% (Range~1.5-3.0%)), High Intermediate (HI) Burley 21(Nic1 nic2, Average nicotine ~3.7% (Range~2.5-5.0%)), and wild-type Burley 21 (also referred to as "BU21") (Nic1 Nic2, Average nicotine ~4.7% (Range~4.0-6.0%)). LA Burley 21 (also referred to as "LA BU21") is a low total alkaloid line produced by incorporation of a low alkaloid gene(s) from a Cuban cigar variety into Burley 21 through several backcrosses (Legg et al. 1970).

Genomic DNA samples were prepared from tobacco leaves. Green leaf tissue from three plants each belonging to BU21 and LA BU21, as well as the High and Low Intermediates (HI BU21 and LI BU21, respectively) were collected. The tissue was flash frozen in liquid nitrogen and stored at −80° C. The stored tissue was ground in liquid Nitrogen and equal amount of tissue from the three plants belonging to each of the four lines was pooled together (~10 g total final weight) for sequencing.

DNA library preparation and sequencing were performed following standard industry protocols, which include, e.g., shearing of DNA to create paired end libraries with average insert size of 500 bp. The raw sequences were mapped to a proprietary TN90 genome, and Single Nucleotide Polymorphisms (SNPs) as well as Insertions and Deletions (InDels) were identified using a whole genome variant detection pipeline. The variant detection pipeline performs trimming and filtering of raw sequencing data based on sequence quality, followed by selection of reads with minimum length of 75 bp and maximum number of 2 unknown bases. These reads were then mapped to Altria's proprietary tobacco (TN90) genome using the software gaMap v2.0.0 (BETA). Only mapped reads with a quality score of at least 40 were further used in SNP and InDel detection using software gaVariant v.2.0.0 BETA. Only SNPs and InDels with a minimum variant quality of 37, genotype quality of 85 and a coverage depth of 7× were included for further analyses. The number of paired end sequencing reads, filtered reads, mapped reads, as well as percentage of mapped reads for each of the four lines are provided in Table 1. The mean coverage for the 4 varieties ranges between 22-40×, which exceeds the recommended coverage for variant detection (approximately 20×). Table 2 provides details on the number of SNPs and InDels detected in each of the four lines.

TABLE 1

Whole-genome sequencing statistics of the four sequenced Burley lines.

| Sample | Raw reads | Reads filtered | reads mapped | % Filtered | % Mapped |
| --- | --- | --- | --- | --- | --- |
| BU21 | 1,030,266,578 | 987,988,031 | 815,146,282 | 95.9 | 82.51 |
| HI BU21 | 928,747,952 | 889,038,519 | 738,942,909 | 95.72 | 83.12 |
| LI BU21 | 838,709,526 | 800,400,171 | 663,625,600 | 95.43 | 82.91 |
| LA BU21 | 792,837,196 | 755,706,369 | 621,019,698 | 95.32 | 82.18 |
| Total | 3,590,561,252 | 3,433,133,090 | 2,838,734,489 | 95.59 | 82.68 |

TABLE 2

Genotyping statistics of the four sequenced Burley lines.

| Sample | SNPs | Insertions | Deletions | % SNPs | % Insertions | % Deletions |
| --- | --- | --- | --- | --- | --- | --- |
| BU21 | 2,349,123 | 304,814 | 397,514 | 76.984 | 9.98915 | 13.02705 |
| HI BU21 | 2,253,395 | 292,635 | 386,493 | 76.842 | 9.97895 | 13.17954 |
| LI BU21 | 2,138,321 | 276,921 | 371,838 | 76.723 | 9.93588 | 13.34149 |
| LA BU21 | 2,083,729 | 265,561 | 358,655 | 76.949 | 9.80674 | 13.24455 |
| Total | 8,824,568 | 1,139,931 | 1,514,500 | 76.8745 | 9.92768 | 13.19816 |

Example 2

Analysis of the Genome Sequences to Identify Nic1 and Nic2 Loci

The genome sequences from Example 1 were analyzed to identify the nic1 and nic2 mutations in LA BU21. The sequences were first analyzed at Nic2 locus. The Nic2 locus was previously reported by Shoji et. al (2010) to comprise a deletion of 7 Ethylene Response Factor (ERF) genes. These deleted ERF genes were mapped to a single contiguous region of the TN90 genome. We scanned the sequencing data of BU21, HI BU21, LI BU21 and LA BU21 and identified that the variant profile in this region of the genome consists of homozygous reference (TN90) allele genotypes across BU21 and LI BU21, and missing data across HI BU21 and LA BU21. This indicates that Nic2 deletion is represented in the variant genotypes as missing data.

Previous literature suggests that Nic1 and Nic2 loci likely contain duplicated genes each originating from one of the progenitor species, *Nicotiana tomentosiformis* or *N. sylvestris* (Hibi et al., 1994). Further, Shoji et al. (2010) reported that Nic2 locus is derived from *N. tomentosiformis*, and that nic2 is a deletion. The similar nature of their origin suggested that nic1 may also be a deletion. A custom perl script was written to detect a pattern of homozygous or heterozygous reference allele calls in BU21 and HI BU21, and missing data in LI BU21 and LA BU21. The custom perl script detected a total of 14035 scaffolds with nearly 37916 variants sites total that match the pattern of missing data in LA BU21 and LI BU21 and homozygous genotypes in HI BU21 and BU21. The mean number of variants observed per scaffold is nearly 3 (2.701). One contiguous region or scaffold (Scaffold0002504, SEQ ID No: 1) contains 207 variant sites with this pattern (Table 3). Hence, this outlier scaffold has 76.67 times the number of variants with the specified pattern compared to the mean number of variants across the remaining scaffolds. Scaffold0002504 provides the first indication of the location of Nic1 locus.

Based on the coverage of the reads across scaffolds, no sequencing bias was observed to account for the absence of reads in LI BU21 and LA BU21. Further, at the known Nic2 locus (Scaffold0000549, SEQ ID No: 2), a similar pattern was observed where LA BU21 and HI BU21 show missing data and BU21 and LI BU21 show homozygous reference allele calls (340 sites on Scaffold0000549 compared to 2.49 sites observed in all scaffolds exhibiting such a pattern of variant sites) (Table 4).

TABLE 3

Polymorphic sites in a Nic1 deletion segment, NT1.0-Scaffold0002504. POS indicates the nucleotide position of each polymorphic site on Scaffold0002504. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic1 Marker No. | POS | REF | ALT | BU21 | HI | LI | LA |
|---|---|---|---|---|---|---|---|
| 1 | 240 | T | A | 0/0 | 0/0 | ./. | ./. |
| 2 | 1750 | CA | C | 0/0 | 0/0 | ./. | ./. |
| 3 | 2064 | G | A | 0/0 | 0/0 | ./. | ./. |
| 4 | 2671 | G | A | 0/0 | 0/0 | ./. | ./. |
| 5 | 2678 | G | T | 0/0 | 0/0 | ./. | ./. |
| 6 | 5174 | G | T | 0/0 | 0/0 | ./. | ./. |
| 7 | 5176 | A | C | 0/0 | 0/0 | ./. | ./. |
| 8 | 5781 | C | T | 0/0 | 0/0 | ./. | ./. |
| 9 | 5812 | A | G | 0/0 | 0/0 | ./. | ./. |
| 10 | 6312 | G | T | 0/0 | 0/0 | ./. | ./. |
| 11 | 6349 | T | G | 0/0 | 0/0 | ./. | ./. |
| 12 | 6373 | T | C | 0/0 | 0/0 | ./. | ./. |
| 13 | 8028 | T | G | 0/0 | 0/0 | ./. | ./. |
| 14 | 12004 | AT | A | 0/0 | 0/0 | ./. | ./. |
| 15 | 12668 | T | C | 0/0 | 0/0 | ./. | ./. |
| 16 | 12939 | A | G | 0/0 | 0/0 | ./. | ./. |
| 17 | 13171 | G | T | 0/0 | 0/0 | ./. | ./. |
| 18 | 13644 | G | T | 0/0 | 0/0 | ./. | ./. |
| 19 | 14078 | G | A | 0/0 | 0/0 | ./. | ./. |
| 20 | 14085 | T | C | 0/0 | 0/0 | ./. | ./. |
| 21 | 29126 | G | T | 0/0 | 0/0 | ./. | ./. |
| 22 | 46969 | G | A | 0/0 | 0/0 | ./. | ./. |
| 23 | 54856 | C | T | 0/0 | 0/0 | ./. | ./. |
| 24 | 54923 | T | C | 0/0 | 0/0 | ./. | ./. |
| 25 | 63743 | T | C | 0/0 | 0/0 | ./. | ./. |
| 26 | 69020 | G | T | 0/0 | 0/0 | ./. | ./. |
| 27 | 78215 | A | G | 0/0 | 0/0 | ./. | ./. |
| 28 | 87817 | T | G | 0/0 | 0/0 | ./. | ./. |
| 29 | 91989 | A | G | 0/0 | 0/0 | ./. | ./. |
| 30 | 92936 | C | G | 0/0 | 0/0 | ./. | ./. |
| 31 | 104894 | G | T | 0/0 | 0/0 | ./. | ./. |
| 32 | 108471 | A | G | 0/0 | 0/0 | ./. | ./. |
| 33 | 108492 | G | A | 0/0 | 0/0 | ./. | ./. |
| 34 | 108503 | A | C | 0/0 | 0/0 | ./. | ./. |
| 35 | 109907 | A | C | 0/0 | 0/0 | ./. | ./. |

TABLE 3-continued

Polymorphic sites in a Nic1 deletion segment, NT1.0-Scaffold0002504. POS indicates the nucleotide position of each polymorphic site on Scaffold0002504. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic1 Marker No. | POS | REF | ALT | BU21 | HI | LI | LA |
|---|---|---|---|---|---|---|---|
| 36 | 112193 | A | T | 0/0 | 0/0 | ./. | ./. |
| 37 | 114778 | C | T | 0/0 | 0/0 | ./. | ./. |
| 38 | 114852 | C | T | 0/0 | 0/0 | ./. | ./. |
| 39 | 117178 | A | G | 0/0 | 0/0 | ./. | ./. |
| 40 | 123634 | G | A | 0/0 | 0/0 | ./. | ./. |
| 41 | 130508 | A | G | 0/0 | 0/0 | ./. | ./. |
| 42 | 130966 | T | C | 0/0 | 0/0 | ./. | ./. |
| 43 | 131000 | C | T | 0/0 | 0/0 | ./. | ./. |
| 44 | 131045 | C | A | 0/0 | 0/0 | ./. | ./. |
| 45 | 134007 | A | G | 0/0 | 0/0 | ./. | ./. |
| 46 | 134046 | A | G | 0/0 | 0/0 | ./. | ./. |
| 47 | 136601 | C | T | 0/0 | 0/0 | ./. | ./. |
| 48 | 136884 | GT | G | 0/0 | 0/0 | ./. | ./. |
| 49 | 150080 | G | A | 0/0 | 0/0 | ./. | ./. |
| 50 | 150585 | T | A | 0/0 | 0/0 | ./. | ./. |
| 51 | 153975 | T | C | 0/0 | 0/0 | ./. | ./. |
| 52 | 159146 | A | G | 0/0 | 0/0 | ./. | ./. |
| 53 | 162586 | C | T | 0/0 | 0/0 | ./. | ./. |
| 54 | 163446 | G | A | 0/0 | 0/0 | ./. | ./. |
| 55 | 163641 | T | C | 0/0 | 0/0 | ./. | ./. |
| 56 | 167356 | T | C | 0/0 | 0/0 | ./. | ./. |
| 57 | 171095 | A | T | 0/0 | 0/0 | ./. | ./. |
| 58 | 181539 | A | G | 0/0 | 0/0 | ./. | ./. |
| 59 | 182327 | C | T | 0/0 | 0/0 | ./. | ./. |
| 60 | 190959 | C | T | 0/0 | 0/0 | ./. | ./. |
| 61 | 198368 | G | A | 0/0 | 0/0 | ./. | ./. |
| 62 | 198393 | A | G | 0/0 | 0/0 | ./. | ./. |
| 63 | 204573 | G | C | 0/0 | 0/0 | ./. | ./. |
| 64 | 205220 | A | G | 0/0 | 0/0 | ./. | ./. |
| 65 | 205252 | C | T | 0/0 | 0/0 | ./. | ./. |
| 66 | 206301 | C | A | 0/0 | 0/0 | ./. | ./. |
| 67 | 206500 | G | A | 0/0 | 0/0 | ./. | ./. |
| 68 | 206634 | A | C | 0/0 | 0/0 | ./. | ./. |
| 69 | 207061 | A | G | 0/0 | 0/0 | ./. | ./. |
| 70 | 207101 | G | A | 0/0 | 0/0 | ./. | ./. |
| 71 | 207131 | T | G | 0/0 | 0/0 | ./. | ./. |
| 72 | 207181 | T | A | 0/0 | 0/0 | ./. | ./. |
| 73 | 207204 | C | G | 0/0 | 0/0 | ./. | ./. |
| 74 | 207512 | C | A | 0/0 | 0/0 | ./. | ./. |
| 75 | 208518 | A | C | 0/0 | 0/0 | ./. | ./. |
| 76 | 208522 | C | T | 0/0 | 0/0 | ./. | ./. |
| 77 | 208556 | T | C | 0/0 | 0/0 | ./. | ./. |
| 78 | 208572 | T | C | 0/0 | 0/0 | ./. | ./. |
| 79 | 209297 | T | C | 0/0 | 0/0 | ./. | ./. |
| 80 | 209315 | C | T | 0/0 | 0/0 | ./. | ./. |
| 81 | 209661 | C | T | 0/0 | 0/0 | ./. | ./. |
| 82 | 209674 | T | C | 0/0 | 0/0 | ./. | ./. |
| 83 | 210485 | T | G | 0/0 | 0/0 | ./. | ./. |
| 84 | 211269 | T | C | 0/0 | 0/0 | ./. | ./. |
| 85 | 216116 | C | T | 0/0 | 0/0 | ./. | ./. |
| 86 | 222130 | G | A | 0/0 | 0/0 | ./. | ./. |
| 87 | 224309 | G | T | 0/0 | 0/0 | ./. | ./. |
| 88 | 224568 | C | T | 0/0 | 0/0 | ./. | ./. |
| 89 | 232343 | C | T | 0/0 | 0/0 | ./. | ./. |
| 90 | 238580 | C | T | 0/0 | 0/0 | ./. | ./. |
| 91 | 239069 | T | A | 0/0 | 0/0 | ./. | ./. |
| 92 | 242812 | A | T | 0/0 | 0/0 | ./. | ./. |
| 93 | 243675 | A | G | 0/0 | 0/0 | ./. | ./. |
| 94 | 244449 | A | G | 0/0 | 0/0 | ./. | ./. |
| 95 | 244950 | T | C | 0/0 | 0/0 | ./. | ./. |
| 96 | 245176 | A | G | 0/0 | 0/0 | ./. | ./. |
| 97 | 254755 | G | A | 0/0 | 0/0 | ./. | ./. |
| 98 | 255169 | C | T | 0/0 | 0/0 | ./. | ./. |
| 99 | 259166 | G | A | 0/0 | 0/0 | ./. | ./. |
| 100 | 271206 | G | A | 0/0 | 0/0 | ./. | ./. |

TABLE 3-continued

Polymorphic sites in a Nic1 deletion segment, NT1.0-Scaffold0002504. POS indicates the nucleotide position of each polymorphic site on Scaffold0002504. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic1 Marker No. | POS | REF | ALT | BU21 | HI | LI | LA |
|---|---|---|---|---|---|---|---|
| 101 | 272201 | T | C | 0/0 | 0/0 | ./. | ./. |
| 102 | 273944 | T | C | 0/0 | 0/0 | ./. | ./. |
| 103 | 276518 | C | T | 0/0 | 0/0 | ./. | ./. |
| 104 | 276838 | T | A | 0/0 | 0/0 | ./. | ./. |
| 105 | 281675 | G | T | 0/0 | 0/0 | ./. | ./. |
| 106 | 284726 | G | T | 0/0 | 0/0 | ./. | ./. |
| 107 | 286609 | C | T | 0/0 | 0/0 | ./. | ./. |
| 108 | 286915 | A | G | 0/0 | 0/0 | ./. | ./. |
| 109 | 286966 | T | A | 0/0 | 0/0 | ./. | ./. |
| 110 | 286987 | A | G | 0/0 | 0/0 | ./. | ./. |
| 111 | 293036 | A | G | 0/0 | 0/0 | ./. | ./. |
| 112 | 300478 | G | T | 0/0 | 0/0 | ./. | ./. |
| 113 | 300631 | C | T | 0/0 | 0/0 | ./. | ./. |
| 114 | 300759 | A | T | 0/0 | 0/0 | ./. | ./. |
| 115 | 301119 | G | A | 0/0 | 0/0 | ./. | ./. |
| 116 | 303538 | A | C | 0/0 | 0/0 | ./. | ./. |
| 117 | 304744 | A | G | 0/0 | 0/0 | ./. | ./. |
| 118 | 306236 | C | T | 0/0 | 0/0 | ./. | ./. |
| 119 | 308259 | C | A | 0/0 | 0/0 | ./. | ./. |
| 120 | 313448 | A | G | 0/0 | 0/0 | ./. | ./. |
| 121 | 317046 | C | G | 0/0 | 0/0 | ./. | ./. |
| 122 | 318876 | GGGGGGT | G | 0/0 | 0/0 | ./. | ./. |
| 123 | 320878 | G | T | 0/0 | 0/0 | ./. | ./. |
| 124 | 321339 | T | G | 0/0 | 0/0 | ./. | ./. |
| 125 | 321361 | A | G | 0/0 | 0/0 | ./. | ./. |
| 126 | 321363 | C | T | 0/0 | 0/0 | ./. | ./. |
| 127 | 321532 | A | C | 0/0 | 0/0 | ./. | ./. |
| 128 | 324556 | A | G | 0/0 | 0/0 | ./. | ./. |
| 129 | 324990 | G | A | 0/0 | 0/0 | ./. | ./. |
| 130 | 329545 | T | A | 0/0 | 0/0 | ./. | ./. |
| 131 | 349886 | T | C | 0/0 | 0/0 | ./. | ./. |
| 132 | 350146 | A | C | 0/0 | 0/0 | ./. | ./. |
| 133 | 350163 | A | G | 0/0 | 0/0 | ./. | ./. |
| 134 | 350515 | T | G | 0/0 | 0/0 | ./. | ./. |
| 135 | 351620 | A | C | 0/0 | 0/0 | ./. | ./. |
| 136 | 353656 | A | G | 0/0 | 0/0 | ./. | ./. |
| 137 | 354639 | CT | C | 0/0 | 0/0 | ./. | ./. |
| 138 | 366150 | AG | A | 0/0 | 0/0 | ./. | ./. |
| 139 | 388388 | T | G | 0/0 | 0/0 | ./. | ./. |
| 140 | 390555 | G | A | 0/0 | 0/0 | ./. | ./. |
| 141 | 391708 | C | T | 0/0 | 0/0 | ./. | ./. |
| 142 | 392358 | G | C | 0/0 | 0/0 | ./. | ./. |
| 143 | 392712 | T | C | 0/0 | 0/0 | ./. | ./. |
| 144 | 401096 | G | T | 0/0 | 0/0 | ./. | ./. |
| 145 | 401445 | G | C | 0/0 | 0/0 | ./. | ./. |
| 146 | 404189 | A | C | 0/0 | 0/0 | ./. | ./. |
| 147 | 406610 | T | G | 0/0 | 0/0 | ./. | ./. |
| 148 | 407131 | C | T | 0/0 | 0/0 | ./. | ./. |
| 149 | 411268 | A | C | 0/0 | 0/0 | ./. | ./. |
| 150 | 412538 | T | A | 0/0 | 0/0 | ./. | ./. |
| 151 | 412550 | G | T | 0/0 | 0/0 | ./. | ./. |
| 152 | 413003 | A | C | 0/0 | 0/0 | ./. | ./. |
| 153 | 413373 | A | T | 0/0 | 0/0 | ./. | ./. |
| 154 | 413437 | C | T | 0/0 | 0/0 | ./. | ./. |
| 155 | 415425 | A | G | 0/0 | 0/0 | ./. | ./. |
| 156 | 415449 | A | C | 0/0 | 0/0 | ./. | ./. |
| 157 | 415458 | T | G | 0/0 | 0/0 | ./. | ./. |
| 158 | 417103 | A | C | 0/0 | 0/0 | ./. | ./. |
| 159 | 418099 | G | A | 0/0 | 0/0 | ./. | ./. |
| 160 | 418558 | A | G | 0/0 | 0/0 | ./. | ./. |
| 161 | 423778 | T | C | 0/0 | 0/0 | ./. | ./. |
| 162 | 430030 | G | T | 0/0 | 0/0 | ./. | ./. |
| 163 | 437935 | T | C | 0/0 | 0/0 | ./. | ./. |
| 164 | 440647 | G | A | 0/0 | 0/0 | ./. | ./. |

TABLE 3-continued

Polymorphic sites in a Nic1 deletion segment, NT1.0-Scaffold0002504. POS indicates the nucleotide position of each polymorphic site on Scaffold0002504. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic1 Marker No. | POS | REF | ALT | BU21 | HI | LI | LA |
|---|---|---|---|---|---|---|---|
| 165 | 440664 | C | T | 0/0 | 0/0 | ./. | ./. |
| 166 | 442849 | T | A | 0/0 | 0/0 | ./. | ./. |
| 167 | 445778 | A | G | 0/0 | 0/0 | ./. | ./. |
| 168 | 446871 | T | C | 0/0 | 0/0 | ./. | ./. |
| 169 | 447998 | A | T | 0/0 | 0/0 | ./. | ./. |
| 170 | 450145 | A | G | 0/0 | 0/0 | ./. | ./. |
| 171 | 452523 | A | G | 0/0 | 0/0 | ./. | ./. |
| 172 | 452968 | G | A | 0/0 | 0/0 | ./. | ./. |
| 173 | 452987 | T | C | 0/0 | 0/0 | ./. | ./. |
| 174 | 453033 | C | T | 0/0 | 0/0 | ./. | ./. |
| 175 | 453112 | G | A | 0/0 | 0/0 | ./. | ./. |
| 176 | 453174 | T | C | 0/0 | 0/0 | ./. | ./. |
| 177 | 453188 | G | A | 0/0 | 0/0 | ./. | ./. |
| 178 | 454399 | T | C | 0/0 | 0/0 | ./. | ./. |
| 179 | 456245 | A | C | 0/0 | 0/0 | ./. | ./. |
| 180 | 466990 | T | C | 0/0 | 0/0 | ./. | ./. |
| 181 | 473415 | C | T | 0/0 | 0/0 | ./. | ./. |
| 182 | 479185 | G | A | 0/0 | 0/0 | ./. | ./. |
| 183 | 481321 | T | C | 0/0 | 0/0 | ./. | ./. |
| 184 | 481329 | T | C | 0/0 | 0/0 | ./. | ./. |
| 185 | 481922 | T | C | 0/0 | 0/0 | ./. | ./. |
| 186 | 485778 | G | A | 0/0 | 0/0 | ./. | ./. |
| 187 | 486466 | A | G | 0/0 | 0/0 | ./. | ./. |
| 188 | 487632 | G | A | 0/0 | 0/0 | ./. | ./. |
| 189 | 495057 | TA | T | 0/0 | 0/0 | ./. | ./. |
| 190 | 496107 | G | A | 0/0 | 0/0 | ./. | ./. |
| 191 | 496129 | G | T | 0/0 | 0/0 | ./. | ./. |
| 192 | 498389 | C | T | 0/0 | 0/0 | ./. | ./. |
| 193 | 502623 | G | T | 0/0 | 0/0 | ./. | ./. |
| 194 | 515727 | T | C | 0/0 | 0/0 | ./. | ./. |
| 195 | 517529 | C | T | 0/0 | 0/0 | ./. | ./. |
| 196 | 521866 | T | C | 0/0 | 0/0 | ./. | ./. |
| 197 | 525885 | AAAAAAAAAAAAAAAAAAAAAAAAAAAAAAAAAAAAAAAAAAAACTTT (SEQ ID NO: 71) | A | 0/0 | 0/0 | ./. | ./. |
| 198 | 528989 | A | G | 0/0 | 0/0 | ./. | ./. |
| 199 | 542757 | A | G | 0/0 | 0/0 | ./. | ./. |
| 200 | 542859 | C | A | 0/0 | 0/0 | ./. | ./. |
| 201 | 543285 | T | C | 0/0 | 0/0 | ./. | ./. |
| 202 | 543440 | G | C | 0/0 | 0/0 | ./. | ./. |
| 203 | 543565 | G | A | 0/0 | 0/0 | ./. | ./. |
| 204 | 543749 | C | T | 0/0 | 0/0 | ./. | ./. |
| 205 | 543771 | T | C | 0/0 | 0/0 | ./. | ./. |
| 206 | 543941 | C | A | 0/0 | 0/0 | ./. | ./. |
| 207 | 543958 | G | C | 0/0 | 0/0 | ./. | ./. |

TABLE 4

Polymorphic sites in a Nic2 deletion segment, NT1.0-Scaffold0000549. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic2 Marker No. | POS | REF | ALT | BU21 | HI | LI | LA |
|---|---|---|---|---|---|---|---|
| 1 | 8514 | T | A | 0/0 | ./. | 0/0 | ./. |
| 2 | 12287 | A | C | 0/0 | ./. | 0/0 | ./. |
| 3 | 15020 | C | T | 0/0 | ./. | 0/0 | ./. |

TABLE 4-continued

Polymorphic sites in a Nic2 deletion segment, NT1.0-Scaffold0000549. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic2 Marker No. | POS | REF | ALT | BU21 | HI | LI | LA |
|---|---|---|---|---|---|---|---|
| 4 | 20105 | C | T | 0/0 | ./. | 0/0 | ./. |
| 5 | 21133 | G | T | 0/0 | ./. | 0/0 | ./. |
| 6 | 21182 | A | C | 0/0 | ./. | 0/0 | ./. |
| 7 | 25267 | T | C | 0/0 | ./. | 0/0 | ./. |
| 8 | 27211 | A | G | 0/0 | ./. | 0/0 | ./. |
| 9 | 27965 | T | A | 0/0 | ./. | 0/0 | ./. |
| 10 | 28780 | A | G | 0/0 | ./. | 0/0 | ./. |
| 11 | 28800 | G | A | 0/0 | ./. | 0/0 | ./. |
| 12 | 28976 | T | A | 0/0 | ./. | 0/0 | ./. |
| 13 | 29013 | G | A | 0/0 | ./. | 0/0 | ./. |
| 14 | 31000 | C | T | 0/0 | ./. | 0/0 | ./. |
| 15 | 31074 | T | C | 0/0 | ./. | 0/0 | ./. |
| 16 | 31118 | A | G | 0/0 | ./. | 0/0 | ./. |
| 17 | 31136 | G | A | 0/0 | ./. | 0/0 | ./. |
| 18 | 31930 | T | G | 0/0 | ./. | 0/0 | ./. |
| 19 | 32523 | A | G | 0/0 | ./. | 0/0 | ./. |
| 20 | 33617 | A | C | 0/0 | ./. | 0/0 | ./. |
| 21 | 33661 | A | T | 0/0 | ./. | 0/0 | ./. |
| 22 | 35656 | T | C | 0/0 | ./. | 0/0 | ./. |
| 23 | 35674 | C | T | 0/0 | ./. | 0/0 | ./. |
| 24 | 44008 | C | T | 0/0 | ./. | 0/0 | ./. |
| 25 | 62895 | T | C | 0/0 | ./. | 0/0 | ./. |
| 26 | 62916 | G | A | 0/0 | ./. | 0/0 | ./. |
| 27 | 64381 | A | G | 0/0 | ./. | 0/0 | ./. |
| 28 | 77284 | A | T | 0/0 | ./. | 0/0 | ./. |
| 29 | 77363 | A | G | 0/0 | ./. | 0/0 | ./. |
| 30 | 77909 | G | C | 0/0 | ./. | 0/0 | ./. |
| 31 | 77975 | A | T | 0/0 | ./. | 0/0 | ./. |
| 32 | 77985 | A | G | 0/0 | ./. | 0/0 | ./. |
| 33 | 80196 | C | T | 0/0 | ./. | 0/0 | ./. |
| 34 | 87731 | C | T | 0/0 | ./. | 0/0 | ./. |
| 35 | 87799 | G | A | 0/0 | ./. | 0/0 | ./. |
| 36 | 89358 | G | T | 0/0 | ./. | 0/0 | ./. |
| 37 | 92022 | T | C | 0/0 | ./. | 0/0 | ./. |
| 38 | 92542 | C | A | 0/0 | ./. | 0/0 | ./. |
| 39 | 92675 | C | T | 0/0 | ./. | 0/0 | ./. |
| 40 | 92695 | G | A | 0/0 | ./. | 0/0 | ./. |
| 41 | 94612 | C | G | 0/0 | ./. | 0/0 | ./. |
| 42 | 94683 | C | T | 0/0 | ./. | 0/0 | ./. |
| 43 | 103131 | G | T | 0/0 | ./. | 0/0 | ./. |
| 44 | 108577 | A | G | 0/0 | ./. | 0/0 | ./. |
| 45 | 108967 | G | A | 0/0 | ./. | 0/0 | ./. |
| 46 | 113914 | T | C | 0/0 | ./. | 0/0 | ./. |
| 47 | 118142 | A | T | 0/0 | ./. | 0/0 | ./. |
| 48 | 118151 | T | C | 0/0 | ./. | 0/0 | ./. |
| 49 | 119780 | A | T | 0/0 | ./. | 0/0 | ./. |
| 50 | 121195 | G | A | 0/0 | ./. | 0/0 | ./. |
| 51 | 135236 | G | T | 0/0 | ./. | 0/0 | ./. |
| 52 | 135239 | C | T | 0/0 | ./. | 0/0 | ./. |
| 53 | 135401 | T | C | 0/0 | ./. | 0/0 | ./. |
| 54 | 135683 | T | A | 0/0 | ./. | 0/0 | ./. |
| 55 | 136546 | C | T | 0/0 | ./. | 0/0 | ./. |
| 56 | 136553 | T | G | 0/0 | ./. | 0/0 | ./. |
| 57 | 137241 | G | A | 0/0 | ./. | 0/0 | ./. |
| 58 | 137643 | CT | C | 0/0 | ./. | 0/0 | ./. |
| 59 | 138384 | C | G | 0/0 | ./. | 0/0 | ./. |
| 60 | 138450 | T | C | 0/0 | ./. | 0/0 | ./. |
| 61 | 138457 | G | A | 0/0 | ./. | 0/0 | ./. |
| 62 | 138663 | T | C | 0/0 | ./. | 0/0 | ./. |
| 63 | 138791 | G | A | 0/0 | ./. | 0/0 | ./. |
| 64 | 152981 | C | T | 0/0 | ./. | 0/0 | ./. |
| 65 | 152994 | G | A | 0/0 | ./. | 0/0 | ./. |
| 66 | 158500 | C | T | 0/0 | ./. | 0/0 | ./. |
| 67 | 159059 | G | A | 0/0 | ./. | 0/0 | ./. |
| 68 | 159855 | A | C | 0/0 | ./. | 0/0 | ./. |
| 69 | 162242 | C | A | 0/0 | ./. | 0/0 | ./. |
| 70 | 162272 | T | C | 0/0 | ./. | 0/0 | ./. |

TABLE 4-continued

Polymorphic sites in a Nic2 deletion segment, NT1.0-Scaffold0000549. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic2 Marker No. | POS | REF | ALT | BU21 | HI | LI | LA |
|---|---|---|---|---|---|---|---|
| 71 | 162616 | T | C | 0/0 | ./. | 0/0 | ./. |
| 72 | 162698 | A | T | 0/0 | ./. | 0/0 | ./. |
| 73 | 163071 | T | C | 0/0 | ./. | 0/0 | ./. |
| 74 | 163389 | T | A | 0/0 | ./. | 0/0 | ./. |
| 75 | 163549 | C | T | 0/0 | ./. | 0/0 | ./. |
| 76 | 169105 | A | C | 0/0 | ./. | 0/0 | ./. |
| 77 | 169578 | A | G | 0/0 | ./. | 0/0 | ./. |
| 78 | 170180 | G | A | 0/0 | ./. | 0/0 | ./. |
| 79 | 170221 | G | T | 0/0 | ./. | 0/0 | ./. |
| 80 | 170292 | A | G | 0/0 | ./. | 0/0 | ./. |
| 81 | 176741 | TG | T | 0/0 | ./. | 0/0 | ./. |
| 82 | 177610 | G | A | 0/0 | ./. | 0/0 | ./. |
| 83 | 189973 | C | A | 0/0 | ./. | 0/0 | ./. |
| 84 | 190622 | T | C | 0/0 | ./. | 0/0 | ./. |
| 85 | 192179 | T | C | 0/0 | ./. | 0/0 | ./. |
| 86 | 192203 | A | G | 0/0 | ./. | 0/0 | ./. |
| 87 | 192520 | G | A | 0/0 | ./. | 0/0 | ./. |
| 88 | 198596 | A | T | 0/0 | ./. | 0/0 | ./. |
| 89 | 210148 | C | T | 0/0 | ./. | 0/0 | ./. |
| 90 | 211238 | A | G | 0/0 | ./. | 0/0 | ./. |
| 91 | 211276 | G | A | 0/0 | ./. | 0/0 | ./. |
| 92 | 211298 | C | T | 0/0 | ./. | 0/0 | ./. |
| 93 | 213281 | C | G | 0/0 | ./. | 0/0 | ./. |
| 94 | 221865 | T | G | 0/0 | ./. | 0/0 | ./. |
| 95 | 224164 | T | A | 0/0 | ./. | 0/0 | ./. |
| 96 | 226470 | A | G | 0/0 | ./. | 0/0 | ./. |
| 97 | 228965 | C | A | 0/0 | ./. | 0/0 | ./. |
| 98 | 230571 | G | A | 0/0 | ./. | 0/0 | ./. |
| 99 | 232100 | C | G | 0/0 | ./. | 0/0 | ./. |
| 100 | 232459 | G | A | 0/0 | ./. | 0/0 | ./. |
| 101 | 234537 | C | T | 0/0 | ./. | 0/0 | ./. |
| 102 | 241822 | G | A | 0/0 | ./. | 0/0 | ./. |
| 103 | 244741 | C | T | 0/0 | ./. | 0/0 | ./. |
| 104 | 246403 | G | A | 0/0 | ./. | 0/0 | ./. |
| 105 | 246519 | C | T | 0/0 | ./. | 0/0 | ./. |
| 106 | 247174 | G | A | 0/0 | ./. | 0/0 | ./. |
| 107 | 252132 | G | A | 0/0 | ./. | 0/0 | ./. |
| 108 | 252717 | T | C | 0/0 | ./. | 0/0 | ./. |
| 109 | 252728 | T | C | 0/0 | ./. | 0/0 | ./. |
| 110 | 255099 | A | G | 0/0 | ./. | 0/0 | ./. |
| 111 | 257486 | C | T | 0/0 | ./. | 0/0 | ./. |
| 112 | 258008 | C | A | 0/0 | ./. | 0/0 | ./. |
| 113 | 258101 | G | A | 0/0 | ./. | 0/0 | ./. |
| 114 | 260634 | C | T | 0/0 | ./. | 0/0 | ./. |
| 115 | 260944 | C | T | 0/0 | ./. | 0/0 | ./. |
| 116 | 261816 | T | C | 0/0 | ./. | 0/0 | ./. |
| 117 | 264558 | T | C | 0/0 | ./. | 0/0 | ./. |
| 118 | 265660 | G | A | 0/0 | ./. | 0/0 | ./. |
| 119 | 275884 | A | G | 0/0 | ./. | 0/0 | ./. |
| 120 | 277012 | A | G | 0/0 | ./. | 0/0 | ./. |
| 121 | 278708 | A | G | 0/0 | ./. | 0/0 | ./. |
| 122 | 278762 | T | C | 0/0 | ./. | 0/0 | ./. |
| 123 | 278781 | G | T | 0/0 | ./. | 0/0 | ./. |
| 124 | 281156 | A | C | 0/0 | ./. | 0/0 | ./. |
| 125 | 282192 | G | T | 0/0 | ./. | 0/0 | ./. |
| 126 | 285956 | A | G | 0/0 | ./. | 0/0 | ./. |
| 127 | 286075 | A | G | 0/0 | ./. | 0/0 | ./. |
| 128 | 290957 | G | T | 0/0 | ./. | 0/0 | ./. |
| 129 | 295851 | C | A | 0/0 | ./. | 0/0 | ./. |
| 130 | 297396 | G | C | 0/0 | ./. | 0/0 | ./. |
| 131 | 298942 | G | T | 0/0 | ./. | 0/0 | ./. |
| 132 | 299095 | A | G | 0/0 | ./. | 0/0 | ./. |
| 133 | 300592 | C | T | 0/0 | ./. | 0/0 | ./. |
| 134 | 301121 | C | G | 0/0 | ./. | 0/0 | ./. |
| 135 | 301147 | C | T | 0/0 | ./. | 0/0 | ./. |
| 136 | 306986 | G | A | 0/0 | ./. | 0/0 | ./. |
| 137 | 310002 | C | T | 0/0 | ./. | 0/0 | ./. |

TABLE 4-continued

Polymorphic sites in a Nic2 deletion segment, NT1.0-Scaffold0000549. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic2 Marker No. | POS | REF | ALT | BU21 | HI | LI | LA |
|---|---|---|---|---|---|---|---|
| 138 | 314892 | C | T | 0/0 | ./. | 0/0 | ./. |
| 139 | 324211 | G | A | 0/0 | ./. | 0/0 | ./. |
| 140 | 327796 | T | G | 0/0 | ./. | 0/0 | ./. |
| 141 | 330726 | A | G | 0/0 | ./. | 0/0 | ./. |
| 142 | 331046 | G | A | 0/0 | ./. | 0/0 | ./. |
| 143 | 332636 | T | C | 0/0 | ./. | 0/0 | ./. |
| 144 | 336046 | G | C | 0/0 | ./. | 0/0 | ./. |
| 145 | 338147 | C | A | 0/0 | ./. | 0/0 | ./. |
| 146 | 340868 | C | T | 0/0 | ./. | 0/0 | ./. |
| 147 | 341170 | T | A | 0/0 | ./. | 0/0 | ./. |
| 148 | 359439 | T | A | 0/0 | ./. | 0/0 | ./. |
| 149 | 359447 | C | A | 0/0 | ./. | 0/0 | ./. |
| 150 | 362131 | A | G | 0/0 | ./. | 0/0 | ./. |
| 151 | 363467 | G | A | 0/0 | ./. | 0/0 | ./. |
| 152 | 365467 | T | A | 0/0 | ./. | 0/0 | ./. |
| 153 | 367311 | A | G | 0/0 | ./. | 0/0 | ./. |
| 154 | 370267 | G | A | 0/0 | ./. | 0/0 | ./. |
| 155 | 384941 | A | G | 0/0 | ./. | 0/0 | ./. |
| 156 | 393244 | G | T | 0/0 | ./. | 0/0 | ./. |
| 157 | 394169 | T | C | 0/0 | ./. | 0/0 | ./. |
| 158 | 394200 | A | G | 0/0 | ./. | 0/0 | ./. |
| 159 | 394213 | A | C | 0/0 | ./. | 0/0 | ./. |
| 160 | 394228 | G | A | 0/0 | ./. | 0/0 | ./. |
| 161 | 396927 | C | T | 0/0 | ./. | 0/0 | ./. |
| 162 | 404142 | T | C | 0/0 | ./. | 0/0 | ./. |
| 163 | 404761 | A | G | 0/0 | ./. | 0/0 | ./. |
| 164 | 406475 | G | A | 0/0 | ./. | 0/0 | ./. |
| 165 | 406481 | T | A | 0/0 | ./. | 0/0 | ./. |
| 166 | 410940 | G | A | 0/0 | ./. | 0/0 | ./. |
| 167 | 411032 | G | A | 0/0 | ./. | 0/0 | ./. |
| 168 | 411069 | T | A | 0/0 | ./. | 0/0 | ./. |
| 169 | 411317 | GA | G | 0/0 | ./. | 0/0 | ./. |
| 170 | 413027 | C | A | 0/0 | ./. | 0/0 | ./. |
| 171 | 413058 | C | T | 0/0 | ./. | 0/0 | ./. |
| 172 | 414268 | C | G | 0/0 | ./. | 0/0 | ./. |
| 173 | 416798 | T | C | 0/0 | ./. | 0/0 | ./. |
| 174 | 417540 | G | C | 0/0 | ./. | 0/0 | ./. |
| 175 | 420742 | A | G | 0/0 | ./. | 0/0 | ./. |
| 176 | 421259 | T | C | 0/0 | ./. | 0/0 | ./. |
| 177 | 426709 | A | G | 0/0 | ./. | 0/0 | ./. |
| 178 | 427690 | G | C | 0/0 | ./. | 0/0 | ./. |
| 179 | 430705 | G | A | 0/0 | ./. | 0/0 | ./. |
| 180 | 431773 | G | A | 0/0 | ./. | 0/0 | ./. |
| 181 | 433900 | A | G | 0/0 | ./. | 0/0 | ./. |
| 182 | 442372 | T | C | 0/0 | ./. | 0/0 | ./. |
| 183 | 451131 | G | A | 0/0 | ./. | 0/0 | ./. |
| 184 | 454572 | C | A | 0/0 | ./. | 0/0 | ./. |
| 185 | 460976 | G | A | 0/0 | ./. | 0/0 | ./. |
| 186 | 461460 | C | T | 0/0 | ./. | 0/0 | ./. |
| 187 | 464177 | A | G | 0/0 | ./. | 0/0 | ./. |
| 188 | 465089 | T | C | 0/0 | ./. | 0/0 | ./. |
| 189 | 465495 | T | G | 0/0 | ./. | 0/0 | ./. |
| 190 | 468266 | C | A | 0/0 | ./. | 0/0 | ./. |
| 191 | 474980 | C | T | 0/0 | ./. | 0/0 | ./. |
| 192 | 480131 | A | T | 0/0 | ./. | 0/0 | ./. |
| 193 | 483164 | T | C | 0/0 | ./. | 0/0 | ./. |
| 194 | 484777 | A | G | 0/0 | ./. | 0/0 | ./. |
| 195 | 485948 | G | A | 0/0 | ./. | 0/0 | ./. |
| 196 | 486626 | G | C | 0/0 | ./. | 0/0 | ./. |
| 197 | 494004 | C | T | 0/0 | ./. | 0/0 | ./. |
| 198 | 494393 | T | C | 0/0 | ./. | 0/0 | ./. |
| 199 | 495953 | C | T | 0/0 | ./. | 0/0 | ./. |
| 200 | 496552 | A | G | 0/0 | ./. | 0/0 | ./. |
| 201 | 499298 | A | G | 0/0 | ./. | 0/0 | ./. |
| 202 | 499947 | T | C | 0/0 | ./. | 0/0 | ./. |
| 203 | 501352 | G | A | 0/0 | ./. | 0/0 | ./. |
| 204 | 505470 | A | G | 0/0 | ./. | 0/0 | ./. |

TABLE 4-continued

Polymorphic sites in a Nic2 deletion segment, NT1.0-Scaffold0000549. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic2 Marker No. | POS | REF | ALT | BU21 | HI | LI | LA |
|---|---|---|---|---|---|---|---|
| 205 | 509926 | G | A | 0/0 | ./. | 0/0 | ./. |
| 206 | 511336 | A | G | 0/0 | ./. | 0/0 | ./. |
| 207 | 513808 | TC | T | 0/0 | ./. | 0/0 | ./. |
| 208 | 515055 | C | T | 0/0 | ./. | 0/0 | ./. |
| 209 | 516444 | A | G | 0/0 | ./. | 0/0 | ./. |
| 210 | 519420 | A | T | 0/0 | ./. | 0/0 | ./. |
| 211 | 521028 | G | C | 0/0 | ./. | 0/0 | ./. |
| 212 | 521834 | T | C | 0/0 | ./. | 0/0 | ./. |
| 213 | 524240 | A | C | 0/0 | ./. | 0/0 | ./. |
| 214 | 524256 | T | C | 0/0 | ./. | 0/0 | ./. |
| 215 | 524317 | A | G | 0/0 | ./. | 0/0 | ./. |
| 216 | 524986 | G | A | 0/0 | ./. | 0/0 | ./. |
| 217 | 526266 | A | C | 0/0 | ./. | 0/0 | ./. |
| 218 | 526905 | C | T | 0/0 | ./. | 0/0 | ./. |
| 219 | 526987 | C | A | 0/0 | ./. | 0/0 | ./. |
| 220 | 530341 | A | G | 0/0 | ./. | 0/0 | ./. |
| 221 | 531695 | A | T | 0/0 | ./. | 0/0 | ./. |
| 222 | 541587 | T | C | 0/0 | ./. | 0/0 | ./. |
| 223 | 541648 | G | A | 0/0 | ./. | 0/0 | ./. |
| 224 | 544386 | A | G | 0/0 | ./. | 0/0 | ./. |
| 225 | 545716 | T | C | 0/0 | ./. | 0/0 | ./. |
| 226 | 546047 | C | A | 0/0 | ./. | 0/0 | ./. |
| 227 | 546372 | A | G | 0/0 | ./. | 0/0 | ./. |
| 228 | 546416 | A | G | 0/0 | ./. | 0/0 | ./. |
| 229 | 546434 | T | A | 0/0 | ./. | 0/0 | ./. |
| 230 | 546775 | C | T | 0/0 | ./. | 0/0 | ./. |
| 231 | 547015 | A | G | 0/0 | ./. | 0/0 | ./. |
| 232 | 554248 | A | G | 0/0 | ./. | 0/0 | ./. |
| 233 | 554496 | C | T | 0/0 | ./. | 0/0 | ./. |
| 234 | 556239 | A | G | 0/0 | ./. | 0/0 | ./. |
| 235 | 558480 | C | T | 0/0 | ./. | 0/0 | ./. |
| 236 | 562524 | C | T | 0/0 | ./. | 0/0 | ./. |
| 237 | 563642 | A | T | 0/0 | ./. | 0/0 | ./. |
| 238 | 563802 | T | A | 0/0 | ./. | 0/0 | ./. |
| 239 | 563862 | G | T | 0/0 | ./. | 0/0 | ./. |
| 240 | 573521 | C | T | 0/0 | ./. | 0/0 | ./. |
| 241 | 573552 | T | C | 0/0 | ./. | 0/0 | ./. |
| 242 | 574370 | C | A | 0/0 | ./. | 0/0 | ./. |
| 243 | 576866 | C | T | 0/0 | ./. | 0/0 | ./. |
| 244 | 577137 | C | T | 0/0 | ./. | 0/0 | ./. |
| 245 | 582336 | T | A | 0/0 | ./. | 0/0 | ./. |
| 246 | 585822 | G | A | 0/0 | ./. | 0/0 | ./. |
| 247 | 586808 | A | G | 0/0 | ./. | 0/0 | ./. |
| 248 | 592379 | A | C | 0/0 | ./. | 0/0 | ./. |
| 249 | 594088 | T | C | 0/0 | ./. | 0/0 | ./. |
| 250 | 594122 | T | A | 0/0 | ./. | 0/0 | ./. |
| 251 | 594128 | C | A | 0/0 | ./. | 0/0 | ./. |
| 252 | 596697 | T | C | 0/0 | ./. | 0/0 | ./. |
| 253 | 599034 | G | C | 0/0 | ./. | 0/0 | ./. |
| 254 | 609636 | T | C | 0/0 | ./. | 0/0 | ./. |
| 255 | 610500 | C | T | 0/0 | ./. | 0/0 | ./. |
| 256 | 610533 | T | A | 0/0 | ./. | 0/0 | ./. |
| 257 | 610938 | A | G | 0/0 | ./. | 0/0 | ./. |
| 258 | 614216 | A | G | 0/0 | ./. | 0/0 | ./. |
| 259 | 614885 | TTA | T | 0/0 | ./. | 0/0 | ./. |
| 260 | 617065 | G | A | 0/0 | ./. | 0/0 | ./. |
| 261 | 621974 | G | A | 0/0 | ./. | 0/0 | ./. |
| 262 | 623585 | T | G | 0/0 | ./. | 0/0 | ./. |
| 263 | 645256 | C | G | 0/0 | ./. | 0/0 | ./. |
| 264 | 645263 | T | C | 0/0 | ./. | 0/0 | ./. |
| 265 | 646476 | C | T | 0/0 | ./. | 0/0 | ./. |
| 266 | 652446 | AT | A | 0/0 | ./. | 0/0 | ./. |
| 267 | 660505 | C | T | 0/0 | ./. | 0/0 | ./. |
| 268 | 667339 | G | A | 0/0 | ./. | 0/0 | ./. |
| 269 | 668081 | A | G | 0/0 | ./. | 0/0 | ./. |
| 270 | 669231 | T | G | 0/0 | ./. | 0/0 | ./. |
| 271 | 680482 | G | A | 0/0 | ./. | 0/0 | ./. |

TABLE 4-continued

Polymorphic sites in a Nic2 deletion segment, NT1.0-Scaffold0000549. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic2 Marker No. | POS | REF | ALT | BU21 | HI | LI | LA |
|---|---|---|---|---|---|---|---|
| 272 | 680899 | T | C | 0/0 | ./. | 0/0 | ./. |
| 273 | 681503 | A | G | 0/0 | ./. | 0/0 | ./. |
| 274 | 681579 | TA | T | 0/0 | ./. | 0/0 | ./. |
| 275 | 685669 | G | A | 0/0 | ./. | 0/0 | ./. |
| 276 | 687781 | T | C | 0/0 | ./. | 0/0 | ./. |
| 277 | 690142 | C | T | 0/0 | ./. | 0/0 | ./. |
| 278 | 696619 | G | A | 0/0 | ./. | 0/0 | ./. |
| 279 | 696973 | C | T | 0/0 | ./. | 0/0 | ./. |
| 280 | 699014 | T | C | 0/0 | ./. | 0/0 | ./. |
| 281 | 699059 | A | G | 0/0 | ./. | 0/0 | ./. |
| 282 | 699441 | A | G | 0/0 | ./. | 0/0 | ./. |
| 283 | 699482 | A | G | 0/0 | ./. | 0/0 | ./. |
| 284 | 699507 | A | C | 0/0 | ./. | 0/0 | ./. |
| 285 | 699568 | AC | A | 0/0 | ./. | 0/0 | ./. |
| 286 | 699991 | C | T | 0/0 | ./. | 0/0 | ./. |
| 287 | 701221 | G | A | 0/0 | ./. | 0/0 | ./. |
| 288 | 701338 | C | T | 0/0 | ./. | 0/0 | ./. |
| 289 | 704968 | A | G | 0/0 | ./. | 0/0 | ./. |
| 290 | 705347 | C | T | 0/0 | ./. | 0/0 | ./. |
| 291 | 708907 | T | C | 0/0 | ./. | 0/0 | ./. |
| 292 | 710281 | C | T | 0/0 | ./. | 0/0 | ./. |
| 293 | 711996 | T | C | 0/0 | ./. | 0/0 | ./. |
| 294 | 714019 | C | A | 0/0 | ./. | 0/0 | ./. |
| 295 | 714445 | T | C | 0/0 | ./. | 0/0 | ./. |
| 296 | 714483 | T | C | 0/0 | ./. | 0/0 | ./. |
| 297 | 714491 | T | C | 0/0 | ./. | 0/0 | ./. |
| 298 | 716492 | A | G | 0/0 | ./. | 0/0 | ./. |
| 299 | 716551 | A | G | 0/0 | ./. | 0/0 | ./. |
| 300 | 721681 | G | A | 0/0 | ./. | 0/0 | ./. |
| 301 | 722271 | T | A | 0/0 | ./. | 0/0 | ./. |
| 302 | 723002 | G | C | 0/0 | ./. | 0/0 | ./. |
| 303 | 732955 | T | C | 0/0 | ./. | 0/0 | ./. |
| 304 | 734117 | T | G | 0/0 | ./. | 0/0 | ./. |
| 305 | 743601 | TA | T | 0/0 | ./. | 0/0 | ./. |
| 306 | 745383 | C | T | 0/0 | ./. | 0/0 | ./. |
| 307 | 745938 | C | T | 0/0 | ./. | 0/0 | ./. |
| 308 | 747238 | T | C | 0/0 | ./. | 0/0 | ./. |
| 309 | 750673 | A | G | 0/0 | ./. | 0/0 | ./. |
| 310 | 751683 | G | T | 0/0 | ./. | 0/0 | ./. |
| 311 | 751702 | C | T | 0/0 | ./. | 0/0 | ./. |
| 312 | 762212 | A | G | 0/0 | ./. | 0/0 | ./. |
| 313 | 762934 | C | T | 0/0 | ./. | 0/0 | ./. |
| 314 | 765864 | C | T | 0/0 | ./. | 0/0 | ./. |
| 315 | 768978 | G | A | 0/0 | ./. | 0/0 | ./. |
| 316 | 770377 | T | A | 0/0 | ./. | 0/0 | ./. |
| 317 | 773111 | G | A | 0/0 | ./. | 0/0 | ./. |
| 318 | 773112 | T | A | 0/0 | ./. | 0/0 | ./. |
| 319 | 773155 | A | T | 0/0 | ./. | 0/0 | ./. |
| 320 | 778101 | C | A | 0/0 | ./. | 0/0 | ./. |
| 321 | 778231 | T | A | 0/0 | ./. | 0/0 | ./. |
| 322 | 779756 | C | T | 0/0 | ./. | 0/0 | ./. |
| 323 | 780381 | A | G | 0/0 | ./. | 0/0 | ./. |
| 324 | 780398 | A | C | 0/0 | ./. | 0/0 | ./. |
| 325 | 782275 | A | C | 0/0 | ./. | 0/0 | ./. |
| 326 | 782502 | T | G | 0/0 | ./. | 0/0 | ./. |
| 327 | 788379 | A | G | 0/0 | ./. | 0/0 | ./. |
| 328 | 788416 | T | A | 0/0 | ./. | 0/0 | ./. |
| 329 | 789721 | C | T | 0/0 | ./. | 0/0 | ./. |
| 330 | 795120 | G | A | 0/0 | ./. | 0/0 | ./. |
| 331 | 797627 | G | A | 0/0 | ./. | 0/0 | ./. |
| 332 | 799891 | A | C | 0/0 | ./. | 0/0 | ./. |
| 333 | 800525 | A | G | 0/0 | ./. | 0/0 | ./. |
| 334 | 801525 | T | C | 0/0 | ./. | 0/0 | ./. |
| 335 | 802686 | ATGCCATGTGGTTTATATTATTGGCACG | A | 0/0 | ./. | 0/0 | ./. |

TABLE 4-continued

Polymorphic sites in a Nic2 deletion segment, NT1.0-Scaffold0000549. REF refers to the sequence of a reference TN90 allele. ALT refers to a sequence polymorphism found in K326, Narrow Leaf Madole, or Oriental type. "0/0" refers to homozygous for the reference TN90 allele while "./." refers to missing data (e.g., deletion).

| Nic2 Marker No. | POS | REF | ALT | BU21 | HI | LI | LA |
|---|---|---|---|---|---|---|---|
|  |  | TGAG TTGT CCGT GCGA GTCC AGAT ATTT ATAC TATA GC (SEQ ID NO: 72) |  |  |  |  |  |
| 336 | 802777 | A | T | 0/0 | ./. | 0/0 | ./. |
| 337 | 807008 | T | C | 0/0 | ./. | 0/0 | ./. |
| 338 | 808634 | T | G | 0/0 | ./. | 0/0 | ./. |
| 339 | 813994 | G | A | 0/0 | ./. | 0/0 | ./. |
| 340 | 817957 | A | G | 0/0 | ./. | 0/0 | ./. |

(BU21, HI BU21, LI BU21, and LA BU21) using a customized sbeadex maxi plant kit (LGC genomics, LLC, Beverly, Mass.) on the automated DNA extraction instrument, Oktopure (LGC genomics, LLC, Beverly, Mass.). Ninety (90) out of the 173 individuals were randomly chosen from this population to be genotyped at both Nic1 and Nic2 locus along with a control locus. The identified Nic1 deletion was confirmed by PCR amplification of a selected region of the identified deletion. PCR primers were designed for the Nic1 locus using Primer3 web V. 4.0.0 and are shown in Table 5. Primer sequences for Nic2 locus, and the control locus were obtained from Shoji et al. (2010), and are also provided in Table 5.

PCR was performed in a 30 μL reaction with 5 μl of ~10 ng/μl DNA, 15 μl of 2× AmpliTaq Gold® 360 MasterMix (Applied Biosystems, Foster City, Calif.), 1.2 μl of 10 μM Forward primer, 1.2 μl of 10 μM Reverse primer, and 7.6 μl of ddH$_2$O. PCR reactions proceeded with an initial denaturation at 95° C. for 5 min, followed by 35 cycles, with a temperature profile of 94° C. for 20 s, 20 s at the optimal annealing temperature (Table 5), and 72° C. for 1 minute. This was followed by a 7-minute final elongation period at 72° C., and an indefinite hold at 4° C.

TABLE 5

Table listing primer sequences and annealing temperature used for PCR

| Locus | Specific Gene | Primer | Primer Sequence (SEQ ID) | PCR Tm |
|---|---|---|---|---|
| Nic1 | g100614_Scaffold0002504 | F | CAACCTAGCCACTGGTCCAT (SEQ ID No: 3) | 62 |
|  |  | R | TCAAACCAAGAGCGAGGAGT (SEQ ID No: 4) |  |
| Nic2 | ERF 189 | F | GGGCAATGGAAATGAATCTAGC (SEQ ID No: 5) | 55 |
|  |  | R | CTTCCTTCCTTTTCACATAG (SEQ ID No: 6) |  |
| Control | ERF 199 | F | CCATTCATTTTCATCCAAACCC (SEQ ID No: 7) | 55 |
|  |  | R | CGGAGTACTTTTCATGGGATTC (SEQ ID No: 8) |  |

Example 3

Confirmation of the Identified Nic1 Locus by Genetic Segregation Analysis

To help confirm the identity of the region identified as Nic1 locus, an F$_2$ population segregating for Nic1 and Nic2 loci was developed with the aim of observing markers for nic1 and nic2 segregating with the phenotype. The F$_2$ population was developed from a cross between TN90 with LA BU21, and has a population size of 173. DNA was extracted from green leaf tissue of individual F$_2$ plants as well as the parental lines and the four known Burley lines PCR products were then visualized on eGene (Qiagen N. V., Venlo, Netherlands), with presence of a PCR product band of desirable size scored as presence of a locus and its absence noted as deletion of the locus. The primer for gene ERF199 (Table 5) served as control, and its absence indicated issues with DNA quality and if absent the sample was removed from further analyses. Alkaloid measurements of nicotine, nornicotine, anatabine and anabasin were also made on each individual plant from leaf samples collected 2 weeks after topping (Table 6), using a GC-FID method based on CORESTA Recommended Methods (CRM N0.7)

and ISO Standards (ISO TC 126N 394 E.). Alkaloid measurements served as an additional confirmation for the nic1 and nic2 genotype.

All 90 F$_2$ individuals as well as TN90, BU21, HI BU21, LI BU21 and LA BU21 showed successful amplification of the control ERF 199 primers. A deletion of Nic2 locus was observed in 19 out of the 90 F$_2$ individuals, as well as in HI BU21 and LA BU21. A deletion of Nic1 locus was seen in 21 out of the 90 F2 individuals, as well as in LI BU21 and LA BU21. Also, both Nic1 and Nic2 loci were seen to be deleted in 5 out of the 90 F$_2$ plants, along with LA BU21. Table 6 provides information on the genotype calls for 90 out of the 173 F$_2$ individual. Table 7 provides the observed and expected number of plants for each genotype given a segregation ratio of 9:3:3:1 for the two loci. Average percent total alkaloid levels for each of the four genotypes observed in the F$_2$ segregating population ((LA Burley 21×TN 90 LC) (X)) are shown in Table 8.

TABLE 6

Nic1 and Nic2 genotypes and alkaloid measurements of individual plants of the F$_2$ population segregating for nic1 and nic2 ((LA Burley 21 × TN 90 LC) (X)). The absence of Nic1 and Ni2 genotype information indicate that those plants were not genotyped. BLQ: below level of quantification.

| Plant | Nic1 Genotype (Present = 1, Absent = 0) | Nic2 Genotype (Present = 1, Absent = 0) | Percent Total Alkaloid | Percent Nicotine |
|---|---|---|---|---|
| Plant 1 | 1 | 0 | 3.0011 | 2.8628 |
| Plant 2 | 1 | 1 | 2.6729 | 2.5628 |
| Plant 3 | 0 | 1 | 2.2933 | 2.2051 |
| Plant 4 | 0 | 0 | BLQ | BLQ |
| Plant 5 | 1 | 1 | 3.1597 | 3.0139 |
| Plant 6 | 1 | 1 | 2.9731 | 2.8266 |
| Plant 7 | 0 | 0 | BLQ | BLQ |
| Plant 8 | 1 | 1 | 2.8809 | 2.763 |
| Plant 9 | 1 | 1 | 4.1221 | 3.9034 |
| Plant 10 | 1 | 1 | 3.994 | 3.8198 |
| Plant 11 | 1 | 1 | 3.7119 | 3.5467 |
| Plant 12 | 1 | 1 | 3.6687 | 3.5089 |
| Plant 13 | 1 | 1 | 4.2203 | 4.0304 |
| Plant 14 | 1 | 0 | 3.2027 | 3.0498 |
| Plant 15 | 1 | 1 | 3.7481 | 3.5971 |
| Plant 16 | 0 | 1 | BLQ | BLQ |
| Plant 17 | 1 | 1 | 4.422 | 4.1744 |
| Plant 18 | 1 | 1 | 2.8292 | 2.7127 |
| Plant 19 | 1 | 0 | 2.7538 | 2.6094 |
| Plant 20 | | | 1.9167 | 1.8179 |
| Plant 21 | 1 | 1 | 4.3081 | 4.0381 |
| Plant 22 | 1 | 1 | 3.6128 | 3.4443 |
| Plant 23 | 1 | 1 | BLQ | BLQ |
| Plant 24 | 1 | 1 | BLQ | BLQ |
| Plant 25 | 0 | 1 | 1.9377 | 1.8346 |
| Plant 26 | 1 | 1 | 2.8042 | 2.6369 |
| Plant 27 | 1 | 1 | 3.2544 | 3.1033 |
| Plant 28 | 1 | 1 | 3.4886 | 3.3306 |
| Plant 29 | 1 | 1 | 2.7115 | 2.5954 |
| Plant 30 | 1 | 1 | BLQ | BLQ |
| Plant 31 | 1 | 1 | 4.1091 | 3.9219 |
| Plant 32 | 1 | 1 | 3.2426 | 3.1062 |
| Plant 33 | 0 | 1 | 1.9005 | 1.7845 |
| Plant 34 | | | BLQ | BLQ |
| Plant 35 | 0 | 1 | 3.0363 | 2.8753 |
| Plant 36 | 1 | 1 | 3.6491 | 3.4489 |
| Plant 37 | 0 | 1 | 1.7179 | 1.6199 |
| Plant 38 | 1 | 0 | 2.8954 | 2.7684 |
| Plant 39 | 1 | 1 | 3.5936 | 3.4294 |
| Plant 40 | 0 | 1 | 2.8582 | 2.7421 |
| Plant 41 | 1 | 0 | BLQ | BLQ |
| Plant 42 | | | 4.4196 | 4.2055 |
| Plant 43 | | | BLQ | BLQ |
| Plant 44 | 0 | 1 | 1.6122 | 1.5324 |
| Plant 45 | 1 | 1 | 2.4573 | 2.3326 |
| Plant 46 | 1 | 1 | 3.4145 | 3.1655 |

TABLE 6-continued

Nic1 and Nic2 genotypes and alkaloid measurements of individual plants of the F$_2$ population segregating for nic1 and nic2 ((LA Burley 21 × TN 90 LC) (X)). The absence of Nic1 and Ni2 genotype information indicate that those plants were not genotyped. BLQ: below level of quantification.

| Plant | Nic1 Genotype (Present = 1, Absent = 0) | Nic2 Genotype (Present = 1, Absent = 0) | Percent Total Alkaloid | Percent Nicotine |
|---|---|---|---|---|
| Plant 47 | 1 | 1 | 3.5314 | 3.3588 |
| Plant 48 | 1 | 1 | 3.7216 | 3.5305 |
| Plant 49 | 1 | 0 | 3.9067 | 3.7233 |
| Plant 50 | 1 | 0 | 3.0601 | 2.9073 |
| Plant 51 | 1 | 1 | 3.8504 | 3.6463 |
| Plant 52 | 0 | 1 | BLQ | BLQ |
| Plant 53 | 1 | 1 | 4.759 | 4.47 |
| Plant 54 | | | 3.6204 | 3.4389 |
| Plant 55 | 0 | 0 | 0.5823 | 0.5489 |
| Plant 56 | 1 | 1 | 3.5092 | 3.3467 |
| Plant 57 | | | 4.107 | 3.9257 |
| Plant 58 | 0 | 1 | 2.4405 | 2.3477 |
| Plant 59 | 0 | 0 | 0.4188 | 0.3927 |
| Plant 60 | 1 | 1 | 3.8854 | 3.7403 |
| Plant 61 | 1 | 1 | 5.0457 | 4.8093 |
| Plant 62 | 0 | 1 | 2.1401 | 2.0358 |
| Plant 63 | 1 | 1 | 3.5212 | 3.3729 |
| Plant 64 | 1 | 1 | 5.1868 | 4.9157 |
| Plant 65 | | | 2.1012 | 1.9855 |
| Plant 66 | 1 | 0 | 0.3436 | 0.3282 |
| Plant 67 | | | 2.3158 | 2.2265 |
| Plant 68 | 1 | 1 | 4.5611 | 4.3195 |
| Plant 69 | 1 | 0 | 3.5517 | 3.4176 |
| Plant 70 | 1 | 1 | 3.945 | 3.7651 |
| Plant 71 | 0 | 1 | 3.8097 | 3.6456 |
| Plant 72 | 1 | 0 | 4.1787 | 3.9818 |
| Plant 73 | 1 | 0 | 5.8965 | 5.5549 |
| Plant 74 | | | 3.5723 | 3.393 |
| Plant 75 | 1 | 1 | 5.6703 | 5.3808 |
| Plant 76 | 1 | 1 | 3.1131 | 2.9747 |
| Plant 77 | 1 | 1 | 4.2168 | 4.0215 |
| Plant 78 | 0 | 1 | 2.9419 | 2.79 |
| Plant 79 | 1 | 1 | 4.2109 | 3.9834 |
| Plant 80 | | | 4.3812 | 4.1685 |
| Plant 81 | 1 | 0 | 0.7258 | 0.6868 |
| Plant 82 | 1 | 0 | 4.0284 | 3.8092 |
| Plant 83 | 0 | 1 | 2.076 | 1.9724 |
| Plant 84 | 1 | 1 | 5.1348 | 4.8334 |
| Plant 85 | 1 | 1 | 5.6781 | 5.3311 |
| Plant 86 | 1 | 1 | 4.3462 | 4.1069 |
| Plant 87 | 1 | 1 | 4.0997 | 3.8974 |
| Plant 88 | 1 | 1 | 3.47 | 3.3158 |
| Plant 89 | 0 | 1 | 2.7871 | 2.6465 |
| Plant 90 | | | 3.5846 | 3.4166 |
| Plant 91 | | | 2.3103 | 2.187 |
| Plant 92 | | | 2.8975 | 2.7746 |
| Plant 93 | | | 3.5385 | 3.3521 |
| Plant 94 | | | 5.2231 | 4.9531 |
| Plant 95 | | | 0.5855 | 0.5538 |
| Plant 96 | | | 2.6133 | 2.4813 |
| Plant 97 | | | 4.3772 | 4.1254 |
| Plant 98 | | | 5.453 | 5.0786 |
| Plant 99 | | | 3.5055 | 3.2963 |
| Plant 100 | | | 2.0902 | 1.9902 |
| Plant 101 | | | 4.5207 | 4.2845 |
| Plant 102 | | | 2.0429 | 1.943 |
| Plant 103 | | | BLQ | BLQ |
| Plant 104 | | | 3.448 | 3.3 |
| Plant 105 | | | 4.3806 | 4.1605 |
| Plant 106 | | | 4.3696 | 4.1293 |
| Plant 107 | | | 4.0754 | 3.8637 |
| Plant 108 | | | 4.1516 | 3.8525 |
| Plant 109 | | | 3.6425 | 3.4421 |
| Plant 110 | | | 4.5431 | 4.3192 |
| Plant 111 | | | 4.4435 | 4.1513 |
| Plant 112 | | | 3.9523 | 3.737 |
| Plant 113 | | | 3.4997 | 3.3269 |
| Plant 114 | | | 3.8171 | 3.638 |
| Plant 115 | | | 3.4582 | 3.3031 |
| Plant 116 | 1 | 1 | 3.5845 | 3.4243 |

TABLE 6-continued

Nic1 and Nic2 genotypes and alkaloid measurements of individual plants of the F$_2$ population segregating for nic1 and nic2 ((LA Burley 21 × TN 90 LC) (X)). The absence of Nic1 and Ni2 genotype information indicate that those plants were not genotyped. BLQ: below level of quantification.

| Plant | Nic1 Genotype (Present = 1, Absent = 0) | Nic2 Genotype (Present = 1, Absent = 0) | Percent Total Alkaloid | Percent Nicotine |
|---|---|---|---|---|
| Plant 117 | | | 3.945 | 3.7507 |
| Plant 118 | 0 | 1 | 2.5889 | 2.4632 |
| Plant 119 | 1 | 1 | 3.5472 | 3.3747 |
| Plant 120 | 0 | 1 | 2.4497 | 2.3085 |
| Plant 121 | 1 | 1 | 4.1965 | 3.9772 |
| Plant 122 | 1 | 0 | 3.8719 | 3.6731 |
| Plant 123 | 1 | 1 | 4.5964 | 4.3886 |
| Plant 124 | 1 | 1 | 3.8232 | 3.667 |
| Plant 125 | | | 4.7023 | 4.4466 |
| Plant 126 | | | 3.4026 | 3.2343 |
| Plant 127 | | | 3.2645 | 3.1016 |
| Plant 128 | | | 2.842 | 2.7461 |
| Plant 129 | | | 3.8524 | 3.6496 |
| Plant 130 | | | 4.7094 | 4.4891 |
| Plant 131 | | | 0.4548 | 0.4254 |
| Plant 132 | | | 3.3652 | 3.211 |
| Plant 133 | | | 3.2598 | 3.1137 |
| Plant 134 | | | BLQ | BLQ |
| Plant 135 | | | 3.3438 | 3.2074 |
| Plant 136 | | | 3.7641 | 3.5279 |
| Plant 137 | | | 3.6367 | 3.4453 |
| Plant 138 | 0 | 0 | 0.4207 | 0.3995 |
| Plant 139 | | | 2.2626 | 2.0909 |
| Plant 140 | | | 4.102 | 3.8806 |
| Plant 141 | | | 4.4366 | 4.2298 |
| Plant 142 | | | 4.386 | 4.1759 |
| Plant 143 | | | 5.7992 | 5.4971 |
| Plant 144 | | | BLQ | BLQ |
| Plant 145 | | | 2.8282 | 2.6992 |
| Plant 146 | | | 2.7978 | 2.6543 |
| Plant 147 | | | 3.6949 | 3.5188 |
| Plant 148 | | | 2.3355 | 2.2257 |
| Plant 149 | | | 1.7436 | 1.6735 |
| Plant 150 | | | BLQ | BLQ |
| Plant 151 | | | 1.2908 | 1.2512 |
| Plant 152 | | | 2.09 | 1.999 |
| Plant 153 | | | 3.2661 | 3.1309 |
| Plant 154 | | | BLQ | BLQ |
| Plant 155 | | | 2.9794 | 2.8095 |
| Plant 156 | | | 5.3031 | 5.0703 |
| Plant 157 | | | 3.6654 | 3.4826 |
| Plant 158 | | | 3.7191 | 3.5198 |
| Plant 159 | | | 3.5148 | 3.359 |
| Plant 160 | | | 3.0729 | 2.9446 |
| Plant 161 | | | 4.0171 | 3.8311 |
| Plant 162 | | | 2.4201 | 2.3083 |
| Plant 163 | | | 4.4837 | 4.2994 |
| Plant 164 | | | 3.5759 | 3.4229 |
| Plant 165 | | | 3.8303 | 3.6354 |
| Plant 166 | | | 4.0415 | 3.8397 |
| Plant 167 | | | 2.3684 | 2.2563 |
| Plant 168 | | | 3.5194 | 3.3464 |
| Plant 169 | | | 4.3816 | 4.1756 |
| Plant 170 | | | 3.7741 | 3.5736 |
| Plant 171 | | | 2.1715 | 2.0453 |
| Plant 172 | | | 6.5454 | 6.1323 |
| Plant 173 | | | 6.9723 | 6.6948 |

TABLE 7

The observed segregation ratio for nic1 and nic2 in the studied F$_2$ population are not significantly different from the expected segregation ratio of 9:3:3:1 at a significance threshold of 0.05 ($\chi^2$ = 0.9827, df = 3, P value = 0.1944).

| Genotype | Ratio Expected | Number of Plants Expected | Number of Plants Observed |
|---|---|---|---|
| Nic1 Nic2 | 9/16 | 50.625 | 55 |
| Nic1 nic2 | 3/16 | 16.875 | 14 |
| nic1 Nic2 | 3/16 | 16.875 | 16 |
| nic1 nic2 | 1/16 | 5.625 | 5 |

TABLE 8

Average percent total alkaloid levels for each of the four genotypes observed in the F$_2$ segregating population ((LA Burley 21 x TN 90 LC) (X)). Both the mean and standard deviation are shown. Number indicates the number of plants for each genotype for which alkaloid levels were measured. The number of plants for each genotype differs from those listed in Table 7 because plants with alkaloid levels below level of quantification (BLQ) are excluded here.

| Genotype | Number | Mean | Std Dev | Std Err Mean | Lower 95% | Upper 95% |
|---|---|---|---|---|---|---|
| Nic1 Nic2 | 49 | 3.8419 | 0.74094 | 0.10585 | 3.6291 | 4.0547 |
| Nic1 nic2 | 13 | 3.18588 | 1.43233 | 0.39726 | 2.3203 | 4.0514 |
| nic1 Nic2 | 15 | 2.43933 | 0.58525 | 0.15111 | 2.1152 | 2.7634 |
| nic1 nic2 | 3 | 0.47393 | 0.09385 | 0.05419 | 0.2408 | 0.7071 |

Example 4

Identification of Genes in Nic1 Deletion Based on the Expression Pattern of Genes in the Identified Nic1 Deletion Segment The identified Nic1 deletion segment, NT1.0-Scaffold0002504, has at least 20 annotated genes. Their expression patterns were analyzed in tobacco roots based on a Root RNASeq dataset. The Root RNASeq dataset were constructed based on RNA-sequencing and transcriptional profiling of root tissues from four varieties: BU21, HI BU21, LI BU21 and LA BU21.

Tobacco plants of these four varieties were grown in the greenhouse until a majority of the lines started budding, and then root and leaf tissue samples were harvested. Root tissue (~100 mg) from 15 plants each of the four varieties, from untopped plants and topped plants were collected. Table 9 provides details of the number of samples, time points and conditions at which sample was collected from these plants. Roots from each genotype were harvested at various time points. RNA was extracted from the roots and pooled together to form two separate pooled samples for each genotype; one before topping and one after. Specifically, tobacco roots were flash frozen in liquid nitrogen and then macerated using 2000 Geno/Grinder Spex sample prep. The macerated tissue was further used for RNA extraction on the automated Maxwell® 16 systems (Promega, Madison, Wis.), using the tissue RNA extraction kit (Promega, Madison, Wis.). The isolated RNA was quantified using a Nanodrop1000 to confirm that all samples met the minimum yield required for 2×100 bp paired end sequencing using HiSeq2000.

After sequencing, the raw RNASeq reads were trimmed and further filtered. The filtered RNASeq reads were then mapped to ALCS's proprietary tobacco genome using the transcriptome mapping application in CLC genomics workbench v.7.1 (Qiagen, N.V., Velno, The Netherlands). The raw expression of a gene is measured as the number of mapped reads for each of the 204,695 annotated genes within the tobacco genome. The gene expression value for each gene was then normalized using the reads per kilobase of transcript per million mapped reads (RPKM) values to obtain relative levels of gene expression.

Among the 20 genes annotated in the identified Nic1 deletion segment, NT1.0-Scaffold0002504, 18 genes show no expression in any of the varieties at any condition. Only 2 genes were expressed in the root (Table 10). They are g100614_Scaffold0002504 and g100631_Scaffold0002504 (having genomic sequences of SEQ ID NOs: 28 and 13, cDNA sequences of SEQ ID NOs: 48 and 33, protein sequences of SEQ ID NOs: 68 and 53, respectively). Both expressed genes are annotated as "late blight resistance protein homolog". Similar expression patterns were also observed for genes at Nic2 locus (Table 11).

TABLE 9

Tissue sampling designs for RNAseq-based transcriptional profiling of tobacco roots.

| | | Number of plants sampled | | | | |
|---|---|---|---|---|---|---|
| | | Time point | | | | |
| Genotype | Condition | 30 mins | 2 hrs | 6 hrs | 24 hrs | 72 hrs |
| Burley 21 | Before Topping | 3 | 3 | 3 | 3 | 3 |
| | After Topping | 3 | 3 | 3 | 3 | 3 |
| HI Burley 21 | Before Topping | 3 | 3 | 3 | 3 | 3 |
| | After Topping | 3 | 3 | 3 | 3 | 3 |
| LI Burley 21 | Before Topping | 3 | 3 | 3 | 3 | 3 |
| | After Topping | 3 | 3 | 3 | 3 | 3 |
| LA Burley 21 | Before Topping | 3 | 3 | 3 | 3 | 3 |
| | After Topping | 3 | 3 | 3 | 3 | 3 |

Example 5

Identification of Genes Regulated by Nic1 and Nic2

The Root RNASeq dataset from Example 4 also allowed the identification of genes, the expression of which is regulated by Nic1 or Nic2. Pairwise comparisons of gene expression in four varieties: BU21, HI BU21, LI BU21 and LA BU21 were performed. FIG. 1 shows the number of genes identified as up or down regulated between each possible pairwise combination of varieties at false discovery rate (FDR) corrected P value of 0.05.

Figure 2:
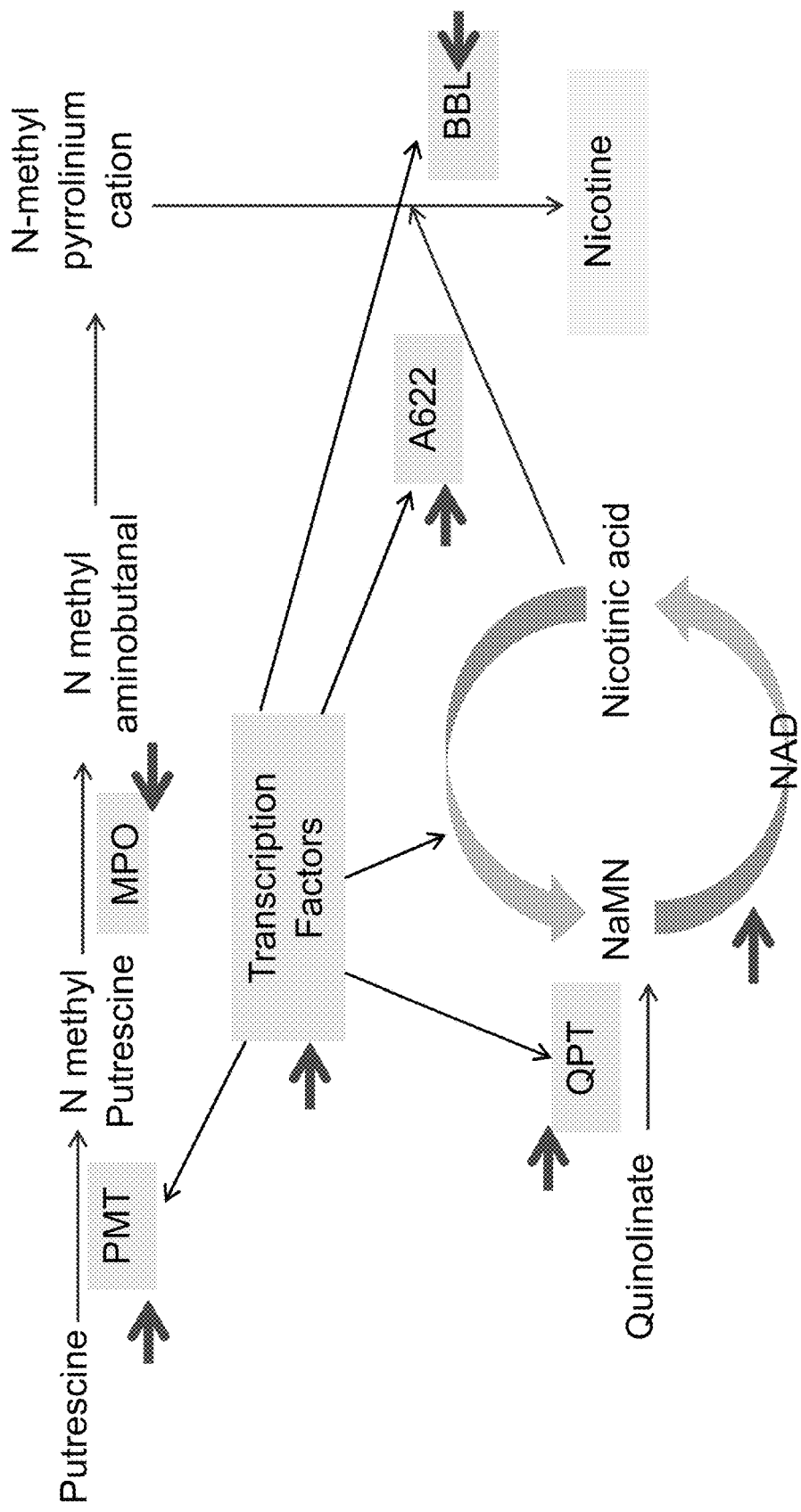
FIG. 2 shows that Nic1 regulates genes involved in nicotine biosynthesis. Red arrows indicate genes whose expression is upregulated in the presence of Nic1, especially within comparisons (i) BU21 vs LA BU21, and (ii) HI BU21 vs LA BU21.

The comparisons of BU21 vs LA BU21 and that of HI BU21 vs LA BU21 are the most informative, with identification of all genes in the Nicotine biosynthesis pathway post formation of Putrescine. The effects of Nic1 locus (present in BU21 and HI BU21, but absent in LA BU21) were also confirmed. FIG. 2 indicate some of the genes upregulated in presence of Nic1.

Example 6

Development of Molecular Markers at or Near Nic1 and Nic2 Deletion Segments

The identified Nic1 deletion segment, NT1.0-Scaffold0002504, has a length of at least 544,860 bps. Within this segment, at least 207 variant sites were detected between a reference TN90 genome sequence and BU21 lines representing a pattern of deletion (Table 3)

The identified Nic2 deletion segment within scaffoldNT1.0-Scaffold0000549 (total length of NT1.0-Scaffold0000549=1,142,469 bps), has a length of at least 820,000 bps. Within this segment, at least 340 polymorphic sites were detected between a reference TN90 genome sequence and Burley 21 lines representing a pattern of deletion (Table 4)

Example 7

Breeding of Tobacco Varieties Containing Low Nicotine

The identified nic1 deletion segment, genes within, and molecular markers associated therewith are used to breed and produce low nicotine tobacco hybrids, varieties, and lines which comprise a nic1 deletion or partial deletion. These genes and markers are also used to screen for additional nic1 and nic2 alleles from various *Nicotiana* germplasm, for example, different *Nicotiana* species or *Nicotiana tabacum* lines. A collection of forty-three *Nicotiana* species, forty-nine *Nicotiana rustica* lines, and approximately six hundred *Nicotiana tabacum* lines that can be screened is provided in Table 8 of U.S. Pat. No. 7,700,834.

Germplasm identified as having novel nic1 or nic2 alleles is used as source material for breeding with cultivated tobaccos. Interspecific or intraspecific hybridization methods combined with standard breeding methods, such as backcrossing or the pedigree method, may be used to transfer a desirable nic1 or nic2 mutant allele from the donor source to cultivated tobaccos. For example, a low-nicotine variety comprising a nic1, nic2, or both mutant alleles (e.g., a donor parent such as LA Burley 21) is crossed to an elite high-nicotine variety having a desirable genetic background and agronomically elite traits. $F_1$ progeny plants from this cross is optionally assayed for one or more molecular markers exemplified in Tables 9 and 10. An $F_1$ progeny plant is then backcrossed with the parent elite high-nicotine variety (recurrent parent). Plants from the BC1 generation are genotyped using molecular markers exemplified in Tables 9 and 10 to select for tobacco plants with smaller nic1 or nic2 deletion segments. After multiple rounds of backcrossing (e.g., 5-7 generations), an new elite tobacco variety is obtained comprising both a low-nicotine trait and other desirable traits from the recurrent parent elite line. This new elite tobacco variety is also free to any genetic drag associated with the low-nicotine trait due to genetic recombination events around Nic1 and Nic2 loci. These recombination events unlink nic1 and nic2 mutations from any associated detrimental mutations and thus reduce or avoid genetic drag. Using the above breeding and marker-assisted selection strategy, one can also achieve the pyramiding or stacking of a low-nicotine trait with other transgenes or natural alleles that reduce nicotine or nornicotine levels.

Low-nicotine tobacco hybrids, varieties, or lines can be made as a Burley type, a dark type, a flue-cured type, a Maryland type or an Oriental type tobacco, or can be essentially derived from BU 64, CC 101, CC 200, CC 27, CC 301, CC 400, CC 500, CC 600, CC 700, CC 800, CC 900, Coker 176, Coker 319, Coker 371 Gold, Coker 48, CU 263, DF911, *Galpao* tobacco, GL 26H, GL 350, GL 600, GL 737, GL 939, GL 973, HB 04P, K 149, K 326, K 346, K 358, K394, K 399, K 730, KDH 959, KT 200, KT204LC, KY 10, KY 14, KY 160, KY 17, KY 171, KY 907, KY907LC, KTY14×L8 LC, Little Crittenden, McNair 373, McNair 944, msKY 14×L8, Narrow Leaf Madole, NC 100, NC 102, NC 2000, NC 291, NC 297, NC 299, NC 3, NC 4, NC 5, NC 6, NC7, NC 606, NC 71, NC 72, NC 810, NC BH 129, NC 2002, Neal Smith Madole, OXFORD 207, 'Perique' tobacco, PVH03, PVH09, PVH19, PVHSO, PVH51, R 610, R 630, R 7-11, R 7-12, RG 17, RG 81, RG H51, RGH 4, RGH 51, RS 1410, Speight 168, Speight 172, Speight 179, Speight 210, Speight 220, Speight 225, Speight 227, Speight 234, Speight G-28, Speight G-70, Speight H-6, Speight H20, Speight NF3, TI 1406, TI 1269, TN 86, TN86LC, TN 90, TN 97, TN97LC, TN D94, TN D950, TR (Tom Rosson) Madole, VA 309, or VA359, Maryland 609, HB3307PLC, HB4488PLC, KT206LC, KT209LC, KT210LC, KT212LC, R610LC, PVH2310, NC196, KTD14LC, KTD6LC, KTD8LC, PD7302LC, PD7305LC, PD7309LC, PD7318LC, PD7319LC, PD7312LC, ShireyLC, or any commercial tobacco variety according to standard tobacco breeding techniques known in the art.

TABLE 10

Genes annotated in a Nic1 deletion scaffold, NT1.0-Scaffold0002504 (SEQ ID No. 1). "Start" and "End" denote the starting and ending nucleotide positions of the annotated genes on scaffold NT1.0-Scaffold0002504. Only two bolded genes (g100631_Scaffold0002504 and g100614_Scaffold0002504) were observed to express in the root of BU21 and HI BU21 both before and after topping. No expression of these two genes were detected in LI BU21 or LA BU21 roots. All other listed genes show no root expression in BU21, HI BU21, LI BU21, or LA BU21 based on the Root RNASeq dataset. The asterisk (*) indicates that SEQ ID Nos. 83 and 84 correspond to refined cDNA and amino acid sequences of SEQ ID NO. 80, respectively.

| Gene | Blast Hit Description | Start | End | Genomic sequence (SEQ ID) | Refined genomic sequence (SEQ ID) | cDNA sequence (SEQ ID) | Amino acid sequence (SEQ ID) |
|---|---|---|---|---|---|---|---|
| g100624_Scaffold0002504 | gi\|113205363\|gb\|AAT66771.2\|Putative polyprotein, identical [Solanum demissum] | 23574 | 44762 | 9 | | 29 | 49 |
| g100616_Scaffold0002504 | gi\|113205363\|gb\|AAT66771.2\|Putative polyprotein, identical [Solanum demissum] | 49007 | 62258 | 10 | | 30 | 50 |
| g100619_Scaffold0002504 | gi\|460410342\|ref\|XP_004250589.1\|PREDICTED: uncharacterized protein LOC101263780 [Solanum lycopersicum] | 63561 | 67079 | 11 | | 31 | 51 |
| g100629_Scaffold0002504 | gi\|113205363\|gb\|AAT66771.2\|Putative polyprotein, identical [Solanum demissum] | 72790 | 84448 | 12 | | 32 | 52 |
| g100631_Scaffold0002504 | **gi\|460370553\|ref\|XP_004231117.1\| PREDICTED: putative late blight resistance protein homolog R1A-10-like [ [*Solanum lycopersicum*]] | 124722 | 127361 | 13 | | 33 | 53** |
| g100627_Scaffold0002504 | gi\|113205316\|gb\|ABI34339.1\|Polyprotein, 3'-partial, putative [Solanum demissum] | 130345 | 131552 | 14 | | 34 | 54 |
| g100630_Scaffold0002504 | gi\|113205316\|gb\|ABI34339.1\|Polyprotein, 3'-partial, putative [Solanum demissum] | 146435 | 147770 | 15 | | 35 | 55 |
| g100633_Scaffold0002504 | gi\|113205316\|gb\|ABI34339.1\|Polyprotein, 3'-partial, putative [Solanum demissum] | 174793 | 179215 | 16 | | 36 | 56 |
| g100620_Scaffold0002504 | NA | 186534 | 189120 | 17 | | 37 | 57 |
| g100625_Scaffold0002504 | gi\|460395064\|ref\|XP_004243109.1\|PREDICTED: uncharacterized protein LOC101263429 [Solanum lycopersicum] | 247160 | 250636 | 18 | | 38 | 58 |
| g100615_Scaffold0002504 | gi\|113205363\|gb\|AAT66771.2\|Putative polyprotein, identical [Solanum demissum] | 263965 | 268932 | 19 | | 39 | 59 |
| g100618_Scaffold0002504 | gi\|460410504\|ref\|XP_004250667.1\|PREDICTED: uncharacterized protein LOC101267192 [Solanum lycopersicum] | 282902 | 284495 | 20 | | 40 | 60 |
| g100622_Scaffold0002504 | NA | 305097 | 306605 | 21 | 75 | 41 | 61 |
| g100617_Scaffold0002504 | gi\|113205345\|gb\|AAT38783.2\|hypothetical protein SDM1_46t00006 [Solanum demissum] | 351391 | 354310 | 22 | 76 | 42 | 62 |
| g100621_Scaffold0002504 | gi\|113205363\|gb\|AAT66771.2\|Putative polyprotein, identical [Solanum demissum] | 385927 | 388324 | 23 | 77 | 43 | 63 |
| g100632_Scaffold0002504 | NA | 421150 | 422045 | 24 | 78 | 44 | 64 |
| g100628_Scaffold0002504 | NA | 427647 | 432434 | 25 | 79 | 45 | 65 |
| g100623_Scaffold0002504 | gi\|89179421\|gb\|ABD63156.1\|Retrotransposon gag protein [Asparagus officinalis] | 471868 | 472786 | 26 | 80* | 46 | 66 |
| g100626_Scaffold0002504 | gi\|147845547\|emb\|CAN78493.1\|hypothetical protein VITISV_037041 [Vitis vinifera] | 477222 | 483825 | 27 | 81 | 47 | 67 |
| g100614_Scaffold0002504 | **gi\|460406698\|ref\|XP_004248798.1\| PREDICTED: putative late blight resistance protein homolog R1B-14-like [ [*Solanum lycopersicum*]] | 530011 | 535390 | 28 | 82 | 48 | 68** |

TABLE 11

Genes annotated in a Nic2 deletion scaffold, NT1.0-Scaffold0000549 (SEQ ID No. 2). "Start" and "End" denote the starting and ending nucleotide positions of the annotated genes on scaffold NT1.0-Scaffold0002504. Only three bolded genes (g38885_Scaffold0000549, g38878_Scaffold0000549 and g38864_Scaffold0000549) were observed to express in the root of BU21 and LI BU21 both before and after topping. No expression of these three genes were detected in HI BU21 or LA BU21 roots. All other listed genes show no root expression in BU21, HI BU21, LI BU21, or LA BU21 based on the Root RNASeq dataset.

| Gene | Blast Hit Description | Start | End |
|---|---|---|---|
| g38875_Scaffold0000549 | gi\|47824950\|gb\|AAT38724.1\|Putative retrotransposon protein, identical [*Solanum demissum*] | 1064 | 2604 |
| g38854_Scaffold0000549 | gi\|460414233\|ref\|XP_004252477.1\|PREDICTED: uncharacterized protein LOC101245629 [*Solanum lycopersicum*] | 12488 | 12827 |
| g38847_Scaffold0000549 | gi\|460407027\|ref\|XP_004248959.1\|PREDICTED: uncharacterized protein LOC101266468 [*Solanum lycopersicum*] | 40706 | 42338 |
| g38857_Scaffold0000549 | gi\|460410342\|ref\|XP_004250589.1\|PREDICTED: uncharacterized protein LOC101263780 [*Solanum lycopersicum*] | 63740 | 66314 |
| g38861_Scaffold0000549 | gi\|460395064\|ref\|XP_004243109.1\|PREDICTED: uncharacterized protein LOC101263429 [*Solanum lycopersicum*] | 69289 | 71053 |
| g38873_Scaffold0000549 | gi\|460407027\|ref\|XP_004248959.1\|PREDICTED: uncharacterized protein LOC101266468 [*Solanum lycopersicum*] | 71359 | 78187 |
| g38871_Scaffold0000549 | gi\|460415745\|ref\|XP_004253217.1\|PREDICTED: uncharacterized protein LOC101263890 [*Solanum lycopersicum*] | 99417 | 112568 |
| g38850_Scaffold0000549 | NA | 136925 | 137758 |
| g38855_Scaffold0000549 | NA | 141858 | 144628 |
| g38872_Scaffold0000549 | NA | 147982 | 150752 |
| g38849_Scaffold0000549 | gi\|147865536\|emb\|CAN81563.1\|hypothetical protein VITISV_019697 [*Vitis vinifera*] | 151800 | 153027 |
| g38866_Scaffold0000549 | gi\|460407027\|ref\|XP_004248959.1\|PREDICTED: uncharacterized protein LOC101266468 [*Solanum lycopersicum*] | 159812 | 161152 |
| g38853_Scaffold0000549 | gi\|460407027\|ref\|XP_004248959.1\|PREDICTED: uncharacterized protein LOC101266468 [*Solanum lycopersicum*] | 165374 | 166727 |
| g38868_Scaffold0000549 | NA | 205238 | 206813 |
| g38884_Scaffold0000549 | gi\|460406842\|ref\|XP_004248867.1\|PREDICTED: putative ribonuclease H protein At1g65750-like [*Solanum lycopersicum*] | 223785 | 228636 |
| g38876_Scaffold0000549 | NA | 246679 | 246970 |
| g38856_Scaffold0000549 | NA | 263028 | 264922 |
| g38859_Scaffold0000549 | NA | 267551 | 269920 |
| g38848_Scaffold0000549 | gi\|460410377\|ref\|XP_004250606.1\|PREDICTED: uncharacterized protein LOC101247390 [*Solanum lycopersicum*] | 274617 | 278325 |
| g38885_Scaffold0000549 | **gi\|296278604\|gb\|ADH04266.1\|ERF1 [*Nicotiana benthamiana*] | 279007 | 279583** |
| g38862_Scaffold0000549 | NA | 281949 | 283475 |
| g38877_Scaffold0000549 | gi\|147773804\|emb\|CAN60970.1\|hypothetical protein VITISV_026408 [*Vitis vinifera*] | 313840 | 316312 |
| g38869_Scaffold0000549 | gi\|147775355\|emb\|CAN65719.1\|hypothetical protein VITISV_020846 [*Vitis vinifera*] | 320254 | 322003 |
| g38881_Scaffold0000549 | gi\|460410342\|ref\|XP_004250589.1\|PREDICTED: uncharacterized protein LOC101263780 [*Solanum lycopersicum*] | 336602 | 338552 |
| g38852_Scaffold0000549 | gi\|113205363\|gb\|AAT66771.2\|Putative polyprotein, identical [*Solanum demissum*] | 352315 | 358329 |
| g38886_Scaffold0000549 | gi\|460387720\|ref\|XP_004239522.1\|PREDICTED: uncharacterized protein LOC101244956 [*Solanum lycopersicum*] | 359255 | 372066 |
| g38878_Scaffold0000549 | **gi\|296278604\|gb\|ADH04266.1\|ERF1 [*Nicotiana benthamiana*] | 372621 | 375461** |
| g38860_Scaffold0000549 | gi\|460366233\|ref\|XP_004228993.1\|PREDICTED: uncharacterized protein LOC101255727 [*Solanum lycopersicum*] | 386045 | 387443 |
| g38864_Scaffold0000549 | **gi\|296278604\|gb\|ADH04266.1\|ERF1 [*Nicotiana benthamiana*] | 416812 | 419577** |
| g38863_Scaffold0000549 | NA | 449315 | 449560 |
| g38865_Scaffold0000549 | NA | 449684 | 449943 |
| g38879_Scaffold0000549 | gi\|470132088\|ref\|XP_004301918.1\|PREDICTED: uncharacterized protein LOC101298139 [*Fragaria vesca* subsp. *vesca*] | 456673 | 458830 |
| g38867_Scaffold0000549 | gi\|460395064\|ref\|XP_004243109.1\|PREDICTED: uncharacterized protein LOC101263429 [*Solanum lycopersicum*] | 550298 | 551726 |
| g38883_Scaffold0000549 | NA | 666517 | 668921 |
| g38846_Scaffold0000549 | NA | 679387 | 681160 |
| g38843_Scaffold0000549 | gi\|113205316\|gb\|ABI34339.1\|Polyprotein, 3'-partial, putative [*Solanum demissum*] | 696597 | 697503 |
| g38880_Scaffold0000549 | gi\|4406792\|gb\|AAD20101.1\|putative retroelement pol polyprotein [*Arabidopsis thaliana*] | 748082 | 752804 |
| g38870_Scaffold0000549 | gi\|156603850\|ref\|XP_001618917.1\|hypothetical protein NEMVEDRAFT_v1g68789 [*Nematostella vectensis*]gi\|156200895\|gb\|EDO26817.1\|predicted protein [*Nematostella vectensis*] | 766567 | 768613 |
| g38874_Scaffold0000549 | gi\|460415871\|ref\|XP_004253277.1\|PREDICTED: uncharacterized protein LOC101244169 [*Solanum lycopersicum*] | 769094 | 773060 |
| g38844_Scaffold0000549 | gi\|460415745\|ref\|XP_004253217.1\|PREDICTED: uncharacterized protein LOC101263890 [*Solanum lycopersicum*] | 781866 | 785313 |

Example 8

Development of Tobacco Varieties with Desirable Nicotine Levels Via a Transgenic Approach Both overexpression and suppression approaches are taken to investigate the function of Nic1 genes. Two sets of transgenic plants are generated, one using the full length coding sequence and the other using an RNAi sequence. For expression of the full length coding sequence or the RNAi sequence, an expression vector can be constructed to have a CsVMV promoter and a NOS terminator, as well as a cassette having a Kanamycin selection marker (NPT II) under direction of an actin2 promoter and having a NOS terminator. Exemplary transformation cassette sequences of RNAi constructs targeting genes in Nic deletion segment can be found in SEQ ID Nos: 69 and 70. One of ordinary skill in the art understands that other target sequences can be used in constructing RNAi constructs or other transgenic approach for gene silencing (e.g., artificial microRNA, trans-acting siRNA, etc.).

Nucleic acid constructs carrying transgenes of interest are introduced into tobacco leaf disc using DNA bombardment or a biolistic approach. See, for example, Sanford et al., 1993, Methods Enzymol., 217:483-510; and Okuzaki and Tabei, 2012, Plant Biotechnology, 29:307-310. Briefly, the plasmid DNA containing the transformation cassette is coated on 1 μm gold particles (DNA/gold) as follows. The 1 μm gold particles are baked at 180° C. for 12 hours, and a stock solution (40 mg/ml) is prepared. To make a mixture for 10 shots, 100 μl of the stock solution is mixed with 40 μl of expression vector DNA (1 μg/μl), 100 μl of 2.5 M $CaCl_2$, and 40 μl of 0.1 M spermidine in a 1.5-ml tube. The mixture is centrifuged for 30 s at 13,000×g, and the pellet is washed with 500 μl 100% ethanol. The DNA/gold mixture is suspended in 100 μl of water, and 10 μl is applied onto a macrocarrier, dried, and then bombarded. Two shots are bombarded per plate using a 1,100 psi rupture disc under partial vacuum (711 mmHg) in a PDS-1000/He system (Bio-Rad Laboratories, Hercules, Calif., USA). Narrow Leaf Madole (NLM) and Tennessee 90 (TN90) tobacco leaf discs are used for transformation with the RNAi constructs, and with the full length gene constructs. Whole tobacco leaf (about 45×30 mm in length) is placed on the MS medium overnight, and the leaf disc is bombarded with the construct on the second day. Leaves are then cut into small pieces (about 5×5 mm) and replaced on the TOM medium (MS medium with 20 g sucrose/L; 1 mg/L IAA and 2.5 mg/L BAP) to grow at 27° C. for 3-5 days, then transferred to TOM medium to grow, which contains 300 mg/l Kanamycin (TOM-Kan). Tissues are transferred to new TOM-Kan plates every 2-3 weeks for 4-6 weeks (27° C., 16 h light). Kanamycin-resistant primary shoots are regenerated at 4-6 weeks after bombardment. Shoots are transferred to MS-Kanamycin plates to grow root. The leaves and/or roots from T1 plants (and subsequent generations) are then evaluated to determine the amount of one or more alkaloids and/or one or more TSNAs.

Example 9

Development of Novel Nic1 Mutations Via Random Mutagenesis

Random mutagenesis of tobacco plants are performed using Ethyl methanesulfonate (EMS) mutagenesis or fast neutron bombardment. EMS mutagenesis consists of chemically inducing random point mutations over the length of the genome. Fast neutron mutagenesis consists of exposing seeds to neutron bombardment which causes large deletions through double stranded DNA breakage.

For EMS mutagenesis, one gram (approximately 10,000 seeds) of Tennessee 90 tobacco (TN90) seeds are washed in 0.1% Tween for fifteen minutes and then soaked in 30 ml of ddH2O for two hours. One hundred fifty (150) μl of 0.5% EMS (Sigma, Catalogue No. M-0880) is then mixed into the seed/ddH2O solution and incubated for 8-12 hours (rotating at 30 rpm) under a hood at room temperature (RT; approximately 20° C.). The liquid then is removed from the seeds and mixed into 1 M NaOH overnight for decontamination and disposal. The seeds are then washed twice with 100 ml ddH2O for 2-4 hours. The washed seeds were then suspended in 0.1% agar solution.

The EMS-treated seeds in the agar solution are evenly spread onto water-soaked Carolina's Choice Tobacco Mix (Carolina Soil Company, Kinston, N.C.) in flats at ~2000 seeds/flat. The flats are then covered with plastic wrap and placed in a growth chamber. Once the seedlings emerge from the soil, the plastic wrap is punctured to allow humidity to decline gradually. The plastic wrap is completely removed after two weeks. Flats are moved to a greenhouse and fertilized with NPK fertilizer. The seedlings re plugged into a float tray and grown until transplanting size. The plants are subsequently transplanted into a field. During growth, the plants self-pollinate to form M1 seeds. At the mature stage, five capsules are harvested from each plant and individual designations are given to the set of seeds from each plant. This forms the M1 population. A composite of M1 seed from each M0 plant are grown, and leaves from M1 plants are collected for DNA extraction. Target genes are amplified and sequenced for mutation identification.

Example 10

Development of Novel Nic1 Mutations Via Targeted Mutagenesis

Tobacco lines with low nicotine while maintaining high leaf quality are produced by introducing mutations into Nic1 locus via precise genome engineering technologies, for example, Transcription activator-like effector nucleases (TALENs), meganuclease, zinc finger nuclease, and CRISPR. Genome modifications are made in commercial tobacco varieties such as TN90, K326 and Narrow Leaf Madole.

For example, specific target sequences from Nic1 genes can serve as TALEN target binding regions. The TALEN sites are specific for the single gene or a DNA segment from Nic1 locus. TALEN regions 1 and 2 would be used to disrupt a critical region of Nic1 and partial fuse together to create long stretch deletion but smaller than entire Nic1 deletion region. The plants created will be expected to have low nicotine contents but high leaf quality.

Based on target DNA sequences, sequences for transcription activator like (TAL) effector proteins are synthesized and cloned into plant expression vectors to serve as entry vectors. Depending on the purpose, different protocols are used to generate mutagenic tobacco lines: 1) one or more entry vectors (pALCS1 containing the target TALs) are directly transformed into tobacco protoplasts to generate random sequence deletion or insertion mutagenic tobacco lines; 2) a donor sequence (e.g., a reporter gene, e.g., the GUS gene) flanked on the left and right side with sequences that are homologous with the target insertion sequence is co-transformed into tobacco protoplasts with one or more entry vectors (pALCS1 containing the target TALs) to generated mutagenic tobacco lines containing a reporter gene; and 3) a donor sequence containing target TALs that have a point mutation is co-transformed into tobacco protoplasts with one or more entry vectors (pALCS1 containing the target TALs) to generated mutagenic tobacco lines having a point mutation; 4) a donor sequence containing a tissue specific promoter sequence to generate mutant tobacco lines that express the endogenous gene in a tissue specific manner; and 5) a donor sequence containing a combination of the aforementioned donor sequences with a reporter gene construct to facilitate mutant tobacco screening.

Tobacco protoplasts are isolated from TN90 tobacco leaves growing in Magenta boxes in a growth chamber.

Well-expanded leaves (5 cm) from 3-4-week-old plants are cut into 0.5 to 1-mm leaf strips from the middle part of a leaf Leaf strips are transferred into the prepared enzyme solution (1% cellulase R10, 0.25% macerozyme R10, 0.4 M mannitol, 20 mM KCl, 20 mM MES (pH 5.7), 10 mM CaCl2, 0.1% BSA) by dipping both sides of the strips. Leaf strips are vacuum infiltrated for 30 min in the dark using a desiccator with continuing digestion in the dark for 4 hour to overnight at room temperature without shaking Protoplasts are filtered in 100 µm nylon filter and purified with 3 ml Lymphoprep. Protoplasts are centrifuged and washed with W5n solution (154 mM NaCl, 125 mM $CaCl_2$, 5 mM KCl, 2 mM MES, 991 mg/l glucose pH 5.7) and suspended in W5n solution at the concentration of 5×105/ml. Protoplasts are kept on ice for 30 min to settle at the bottom of the tube by gravity. W5n solution was moved and protoplasts were re-suspended in P2 solution at room temperature. 50 µl DNA (10-20 µg of plasmid), 500 µl protoplasts (2×105 protoplasts) and 550 µl of PEG solution (40%, v/v 10 ml 4 g PEG4000, 0.2 M mannitol, 0.1 M CaCl2) are mixed gently in a 15-ml microfuge tube, and the mixture incubated at room temperature for 5 min.

Protoplasts are pelleted and re-suspended with 1 ml 2×8EN1 (8EN1: MS salt without $NH_4NO_3$, MS vitamin, 0.2% myo-Inositol, 4 mM MES, 1 mg/l NAA, 1 mg/l IAA, 0.5 M mannitol, 0.5 mg/l BAP, 1.5% sucrose). Transformed protoplasts are jellified with equal amount of low-meting agarose (LMA), and 0.2 ml of protoplast-LAM is dropped to form a bead. 10 ml 8EN1 is added to the bead, and in 7 days, 5 ml 8EN1 is taken out and 5 ml 8EN2 (8EN1 with 0.25 M mannitol) is added; after another 7 days (14 day), 10 ml 8EN2 is taken out and 10 ml 8EN2 is added; in another 7 days (21 day), 5 ml 8EN2 is taken out and 5 ml 8EN3 (8EN1 with 3% sucrose and without mannitol) is added; after another 7 days (28 day), 10 ml 8EN3 is taken out and 10 ml 8EN3 is added. Protoplasts are kept for two weeks until micro-callus growth. Callus is transferred to NCM solid media until it reaches about 5 mm (usually about two weeks). Callus was transferred to TOM-Kan solid media to grow shoots, and transformed tobacco plants were regenerated using the methods described herein.

Example 11

Further Genetic Confirmation of the Identified Nic1 Lesion

A genetic segregation analysis was conducted in an $F_2$ population of 522 plants from a cross between TN90 with LA BU21 (Table 12). This $F_2$ population ((LA Burley 21×TN 90 LC) (X)) was subject to PCR-based genotyping of the Nic1 and Nic2 loci as described in Example 3. The percent total alkaloid and percent nicotine levels of each plant were also measured as in Example 3. Briefly, tobacco samples were collected at an intermediate growth stage (layby stage) for genotyping. The plants were topped at an elongated bud stage. Samples for chemistry analysis were taken two weeks after topping of the plants.

Figure 3:
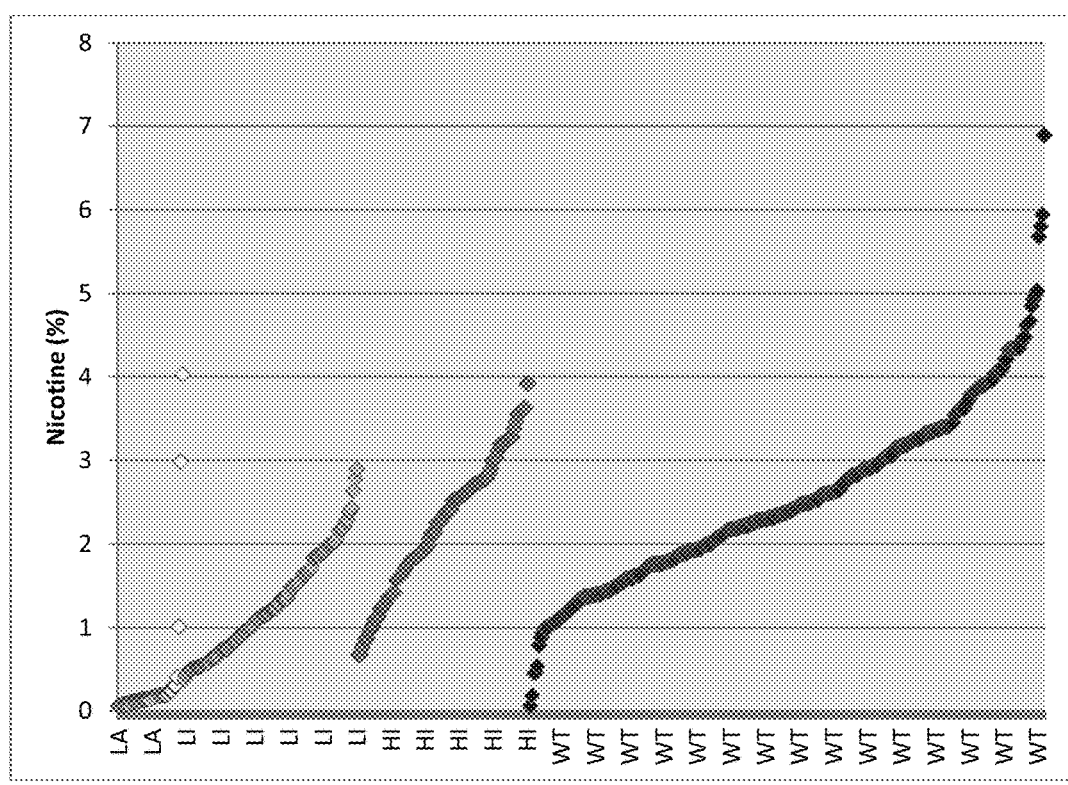
FIG. 3 shows genotypic and chemistry data of an $F_2$ population by plotting the chemistry (y axis) of each plant by it genotype (x axis).
Figure 4:
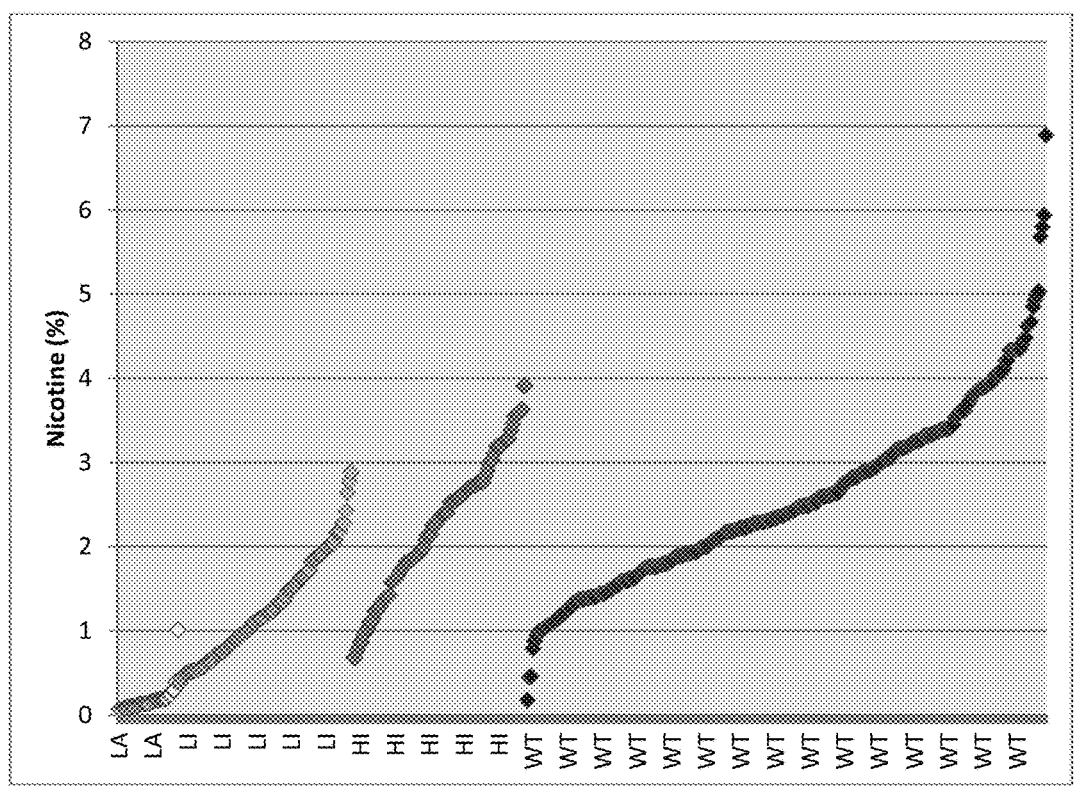
FIG. 4 is identical to FIG. 3 except excluding 8 outliers likely due to sampling errors.

The genotypic data again confirm a segregation ratio of 9:3:3:1 for the Nic1 and Nic2 loci in the $F_2$ population. Average percent total alkaloid and average percent nicotine levels in each of the four genotypes are also consistent with the segregation data and the earlier observation that nic1 has a stronger effect than nic2 over the total alkaloid and nicotine levels (Tables 13 and 14). The genotype and chemistry data of this $F_2$ population are further shown in FIGS. 3 and 4 by plotting the chemistry (y axis) of each plant by it genotype (x axis). FIG. 4 differs from FIG. 3 in its exclusion of 8 plants that were likely switched due to sampling or processing errors.

Figure 5:
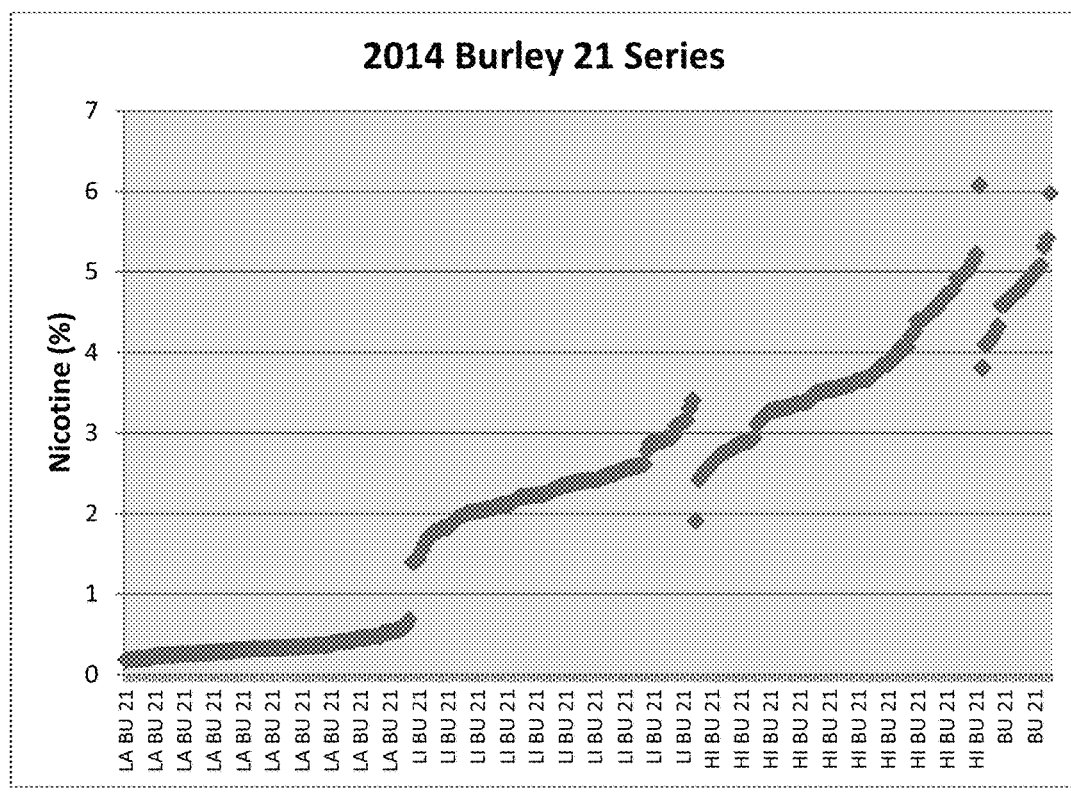
FIG. 5 shows percent nicotine levels of isogenic BU21 low alkaloid series (LA BU21, LI BU21, HI BU21, and BU21) in a 2014 field test.
Figure 6:
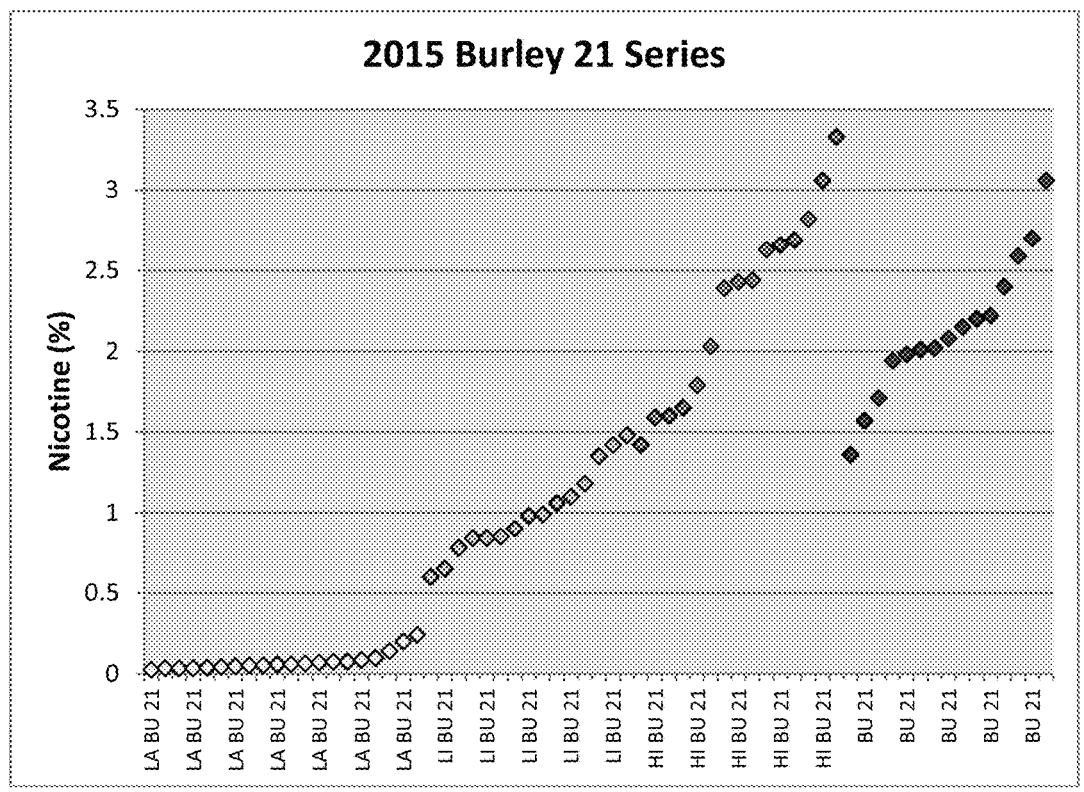
FIG. 6 shows percent nicotine levels of isogenic BU21 low alkaloid series (LA BU21, LI BU21, HI BU21, and BU21) in a 2015 field test.

Moreover, groups of isogenic BU21 low alkaloid series germplasm (LA BU21, LI BU21, HI BU21, and BU21) were tested across two years. The low alkaloid trait is not affected by year-to-year variations in leaf alkaloid levels. Shown is FIGS. 5 and 6, the percent reduction of nicotine content appeared consistent across two years, illustrating that the low alkaloid trait is not impacted by environmental factors or field conditions.

TABLE 12

Nic1 and Nic2 genotypes and alkaloid measurements of individual plants of a larger $F_2$ population segregating for nic1 and nic2 ((LA Burley 21 × TN 90 LC) (X)). N/S represent no sample. Asterisks represent four pairs (8 total having plant Nos: 163 and 164, 174 and 175, 361 and 362, 481 and 482, also in bold) of adjacent plants where DNA or leaf samples were likely switched during either sampling, processing or analysis stage. Each of the four pairs of plants were side by side in the field.

| Plant No. | Nic1 (Present = 1, Deleted = 0) | Nic2 (Present = 1, Deleted = 0) | Percent Nicotine | Percent Total Alkaloids |
|---|---|---|---|---|
| 1 | 1 | 1 | 1.33 | 1.389 |
| 2 | 1 | 1 | 1.59 | 1.66 |
| 3 | 0 | 1 | 0.72 | 0.7511 |
| 4 | 1 | 1 | 2.59 | 2.753 |
| 5 | 1 | 0 | 0.81 | 0.8422 |
| 6 | 1 | 1 | 1.04 | 1.096 |
| 7 | 1 | 1 | 1.76 | 1.843 |
| 8 | 1 | 1 | 1.07 | 1.121 |
| 9 | 1 | 0 | 1.85 | 1.938 |
| 10 | 1 | 1 | 1.58 | 1.662 |
| 11 | 1 | 0 | 1.1 | 1.147 |
| 12 | 1 | 0 | 0.68 | 0.7045 |
| 13 | 1 | 1 | 1.33 | 1.39 |
| 14 | 1 | 0 | 1.77 | 1.828 |
| 15 | 1 | 1 | 1.83 | 1.93 |
| 16 | 1 | 1 | 3.34 | 3.513 |
| 17 | 0 | 0 | 0.059 | 0.0643 |
| 18 | 1 | 1 | 3.36 | 3.543 |
| 19 | 0 | 0 | 0.062 | 0.0661 |
| 20 | 1 | 1 | 2.31 | 2.437 |
| 21 | 1 | 0 | 1.23 | 1.286 |
| 22 | 1 | 0 | 1.61 | 1.701 |
| 23 | 1 | 1 | 1.18 | 1.241 |
| 24 | 0 | 0 | 0.106 | 0.1099 |
| 25 | 0 | 1 | 1.41 | 1.487 |
| 26 | 1 | 1 | 2.47 | 2.6 |
| 27 | 1 | 1 | 2.16 | 2.245 |
| 28 | 1 | 1 | 2.22 | 2.334 |
| 29 | 1 | 0 | 2.54 | 2.667 |
| 30 | 1 | 1 | 1.37 | 1.429 |
| 31 | 1 | 1 | 1.86 | 1.956 |
| 32 | 1 | 1 | 1.68 | 1.762 |
| 33 | 1 | 0 | 1.91 | 1.996 |
| 34 | 1 | 1 | 2.89 | 3.051 |
| 35 | 0 | 1 | 1.15 | 1.205 |
| 36 | 1 | 1 | 2.92 | 3.064 |
| 37 | 1 | 0 | 2.84 | 3.005 |
| 38 | 0 | 1 | 1.49 | 1.566 |
| 39 | 0 | 0 | 0.17 | 0.1796 |
| 40 | 1 | 0 | 3.02 | 3.211 |
| 41 | 1 | 0 | 1.29 | 1.35 |
| 42 | 1 | 1 | 1.73 | 1.805 |
| 43 | 1 | 0 | 1.37 | 1.469 |
| 44 | 1 | 1 | 2.18 | 2.279 |
| 45 | 0 | 0 | 0.16 | 0.1719 |
| 46 | 1 | 0 | 2.38 | 2.495 |
| 47 | 1 | 1 | 2.34 | 2.455 |
| 48 | 1 | 0 | 1.39 | 1.455 |
| 49 | 1 | 0 | 2.9 | 3.044 |
| 50 | 0 | 1 | 2.18 | 2.307 |
| 51 | 0 | 1 | 1.34 | 1.393 |
| 52 | 1 | 0 | 1.9 | 1.98 |
| 53 | 1 | 1 | 1.49 | 1.566 |

TABLE 12-continued

Nic1 and Nic2 genotypes and alkaloid measurements of individual plants of a larger $F_2$ population segregating for nic1 and nic2 ((LA Burley 21 × TN 90 LC) (X)). N/S represent no sample. Asterisks represent four pairs (8 total having plant Nos: 163 and 164, 174 and 175, 361 and 362, 481 and 482, also in bold) of adjacent plants where DNA or leaf samples were likely switched during either sampling, processing or analysis stage. Each of the four pairs of plants were side by side in the field.

| Plant No. | Nic1 (Present = 1, Deleted = 0) | Nic2 (Present = 1, Deleted = 0) | Percent Nicotine | Percent Total Alkaloids |
|---|---|---|---|---|
| 54 | 1 | 1 | 2.22 | 2.347 |
| 55 | 1 | 1 | 3.21 | 3.359 |
| 56 | 1 | 1 | 3.67 | 3.862 |
| 57 | 1 | 1 | 2.07 | 2.17 |
| 58 | 0 | 1 | 0.83 | 0.8704 |
| 59 | 1 | 1 | 2.37 | 2.492 |
| 60 | 1 | 1 | 2.25 | 2.395 |
| 61 | 1 | 1 | 2.53 | 2.678 |
| 62 | 1 | 1 | 2.19 | 2.326 |
| 63 | 1 | 1 | 1.92 | 1.997 |
| 64 | 1 | 1 | 3.06 | 3.229 |
| 65 | 1 | 1 | 3.2 | 3.369 |
| 66 | 1 | 1 | 2.83 | 2.997 |
| 67 | 1 | 1 | 4.07 | 4.257 |
| 68 | 1 | 1 | 2.4 | 2.498 |
| 69 | 0 | 1 | 1.66 | 1.734 |
| 70 | 1 | 1 | 1.93 | 2.045 |
| 71 | 1 | 1 | 3.79 | 3.99 |
| 72 | 0 | 0 | 0.079 | 0.0849 |
| 73 | 1 | 1 | 2.17 | 2.289 |
| 74 | 1 | 0 | 3.58 | 3.778 |
| 75 | 1 | 1 | 2.63 | 2.76 |
| 76 | 0 | 1 | 1.52 | 1.603 |
| 77 | 1 | 1 | 3.04 | 3.211 |
| 78 | 1 | 1 | 2.82 | 2.979 |
| 79 | 1 | 1 | 2.6 | 2.74 |
| 80 | 1 | 1 | 2.48 | 2.597 |
| 81 | 1 | 1 | 1.88 | 1.977 |
| 82 | 1 | 1 | 2.98 | 3.106 |
| 83 | 0 | 1 | 0.99 | 1.0255 |
| 84 | 0 | 0 | 0.3 | 0.3194 |
| 85 | 1 | 1 | 1.79 | 1.873 |
| 86 | 1 | 1 | 2.37 | 2.477 |
| 87 | 1 | 1 | 2.79 | 2.932 |
| 88 | 1 | 1 | 2.14 | 2.301 |
| 89 | 1 | 1 | 4.35 | 4.588 |
| 90 | 0 | 0 | 0.09 | 0.0972 |
| 91 | 0 | 1 | 1.59 | 1.67 |
| 92 | 1 | 0 | 1.71 | 1.789 |
| 93 | 1 | 1 | 3.94 | 4.114 |
| 94 | 1 | 1 | 2.65 | 2.755 |
| 95 | 0 | 1 | 1.14 | 1.211 |
| 96 | 1 | 0 | 2.14 | 2.248 |
| 97 | 1 | 1 | 2.62 | 2.743 |
| 98 | 1 | 0 | 0.95 | 0.9865 |
| 99 | 1 | 1 | 2.61 | 2.729 |
| 100 | 1 | 1 | 3.33 | 3.485 |
| 101 | 1 | 0 | 2.77 | 2.878 |
| 102 | 1 | 1 | 2.31 | 2.424 |
| 103 | 0 | 1 | 0.49 | 0.5099 |
| 104 | 1 | 1 | 2.5 | 2.611 |
| 105 | 0 | 1 | 0.97 | 1.012 |
| 106 | 1 | 1 | 2.29 | 2.404 |
| 107 | 1 | 1 | 1.11 | 1.16 |
| 108 | 1 | 0 | 1.87 | 1.947 |
| 109 | 0 | 1 | 0.95 | 1 |
| 110 | 1 | 1 | 3.05 | 3.209 |
| 111 | 1 | 0 | 3.28 | 3.437 |
| 112 | 1 | 0 | 3.46 | 3.637 |
| 113 | 1 | 1 | 4.33 | 4.594 |
| 114 | 1 | 1 | 4.35 | 4.552 |
| 115 | 1 | 1 | 3.56 | 3.746 |
| 116 | 1 | 1 | 1.85 | 1.93 |
| 117 | 1 | 1 | 5.94 | 6.305 |
| 118 | 0 | 1 | 1.47 | 1.559 |
| 119 | 1 | 1 | 3.8 | 4.028 |
| 120 | 0 | 1 | 1.9 | 2.007 |
| 121 | 1 | 0 | 3.38 | 3.573 |
| 122 | 0 | 0 | 0.3 | 0.3191 |
| 123 | 1 | 1 | 4.04 | 4.245 |
| 124 | 1 | 1 | 3.4 | 3.622 |
| 125 | 0 | 1 | 1.09 | 1.141 |
| 126 | 1 | 0 | 2.71 | 2.828 |
| 127 | 1 | 1 | 4.93 | 5.178 |
| 128 | 1 | 0 | 2.65 | 2.801 |
| 129 | 1 | 1 | 1.62 | 1.693 |
| 130 | 1 | 0 | 2.13 | 2.232 |
| 131 | 0 | 1 | 2.64 | 2.789 |
| 132 | 1 | 1 | 3.17 | 3.329 |
| 133 | 0 | 1 | 1.99 | 2.108 |
| 134 | 1 | 1 | 2.28 | 2.377 |
| 135 | 1 | 1 | 3.85 | 4.019 |
| 136 | 1 | 1 | 3.62 | 3.792 |
| 137 | 1 | 0 | 3.19 | 3.355 |
| 138 | 0 | 1 | 1.49 | 1.565 |
| 139 | 1 | 1 | 4.33 | 4.516 |
| 140 | 1 | 1 | 3.88 | 4.097 |
| 141 | 1 | 1 | 5.68 | 6.003 |
| 142 | 1 | 1 | 3.15 | 3.292 |
| 143 | 1 | 0 | 2.35 | 2.456 |
| 144 | 1 | 0 | 3.63 | 3.786 |
| 145 | 1 | 1 | 3.32 | 3.532 |
| 146 | 1 | 1 | 3.26 | 3.407 |
| 147 | 1 | 1 | 3.37 | 3.507 |
| 148 | 1 | 0 | 3.21 | 3.388 |
| 149 | 1 | 1 | 3.7 | 3.873 |
| 150 | 0 | 0 | 0.4 | 0.4279 |
| 151 | 1 | 1 | 1.41 | 1.482 |
| 152 | 1 | 1 | 2.18 | 2.273 |
| 153 | 1 | 1 | 2.58 | 2.725 |
| 154 | 0 | 1 | 2.89 | 3.088 |
| 155 | 1 | 1 | 1.51 | 1.593 |
| 156 | 0 | 1 | 2.03 | 2.143 |
| 157 | 0 | 1 | 2.03 | 2.151 |
| 158 | 1 | 0 | 1.27 | 1.323 |
| 159 | 1 | 1 | 1.62 | 1.734 |
| 160 | 1 | 1 | 4.48 | 4.67 |
| 161 | 1 | 1 | 1 | 1.045 |
| 162 | 1 | 1 | 3.17 | 3.309 |
| 163* | 1 | 1 | 0.18 | 0.1906 |
| 164* | 0 | 1 | 2.38 | 2.493 |
| 165 | 1 | 1 | 3.62 | 3.745 |
| 166 | 1 | 1 | N/S | N/S |
| 167 | 1 | 0 | 2.62 | 2.717 |
| 168 | 1 | 1 | 2.31 | 2.428 |
| 169 | 1 | 0 | 2.52 | 2.645 |
| 170 | 1 | 1 | 4.35 | 4.527 |
| 171 | 1 | 0 | 1.66 | 1.741 |
| 172 | 1 | 1 | 3.03 | 3.159 |
| 173 | 1 | 0 | 3.2 | 3.343 |
| 174* | 1 | 1 | 0.059 | 0.0653 |
| 175* | 0 | 0 | 4.03 | 4.197 |
| 176 | 1 | 1 | 2.85 | 3.01 |
| 177 | 1 | 1 | 2.91 | 3.086 |
| 178 | 1 | 1 | 4.21 | 4.395 |
| 179 | 1 | 1 | 1.09 | 1.154 |
| 180 | 1 | 1 | 1.15 | 1.206 |
| 181 | 1 | 0 | 3.2 | 3.345 |
| 182 | 1 | 1 | 3.28 | 3.406 |
| 183 | 1 | 1 | 3.17 | 3.324 |
| 184 | 1 | 0 | 3.24 | 3.392 |
| 185 | 1 | 1 | 0.94 | 0.987 |
| 186 | 1 | 1 | 3.95 | 4.123 |
| 187 | 1 | 0 | 0.68 | 0.7094 |
| 188 | 0 | 1 | 1.94 | 2.007 |
| 189 | 1 | 1 | 0.46 | 0.4809 |

TABLE 12-continued

Nic1 and Nic2 genotypes and alkaloid measurements of individual plants of a larger $F_2$ population segregating for nic1 and nic2 ((LA Burley 21 × TN 90 LC) (X)). N/S represent no sample. Asterisks represent four pairs (8 total having plant Nos: 163 and 164, 174 and 175, 361 and 362, 481 and 482, also in bold) of adjacent plants where DNA or leaf samples were likely switched during either sampling, processing or analysis stage. Each of the four pairs of plants were side by side in the field.

| Plant No. | Nic1 (Present = 1, Deleted = 0) | Nic2 (Present = 1, Deleted = 0) | Percent Nicotine | Percent Total Alkaloids |
|---|---|---|---|---|
| 190 | 0 | 1 | 2.28 | 2.356 |
| 191 | 1 | 1 | 2.25 | 2.336 |
| 192 | 1 | 0 | 2.74 | 2.842 |
| 193 | 1 | 1 | 3.9 | 4.091 |
| 194 | 1 | 1 | 3.39 | 3.578 |
| 195 | 1 | 0 | 2.59 | 2.698 |
| 196 | 0 | 0 | 0.131 | 0.1383 |
| 197 | 1 | 1 | 2.28 | 2.365 |
| 198 | 1 | 0 | 2.27 | 2.395 |
| 199 | 0 | 0 | 0.1 | 0.1063 |
| 200 | 1 | 1 | 2.39 | 2.496 |
| 201 | 0 | 1 | 1.02 | 1.09 |
| 202 | 1 | 1 | 1.99 | 2.09 |
| 203 | 1 | 1 | 3.44 | 3.594 |
| 204 | 1 | 1 | 3.05 | 3.167 |
| 205 | 0 | 1 | 0.85 | 0.8839 |
| 206 | 0 | 1 | 2.18 | 2.331 |
| 207 | 1 | 1 | 1.89 | 1.971 |
| 208 | 1 | 1 | 1.37 | 1.445 |
| 209 | 1 | 1 | 3.26 | 3.432 |
| 210 | 1 | 1 | 1.28 | 1.3224 |
| 211 | 0 | 1 | 1.86 | 1.966 |
| 212 | 1 | 1 | 1.53 | 1.59 |
| 213 | 0 | 0 | 0.142 | 0.1513 |
| 214 | 1 | 1 | 2.22 | 2.331 |
| 215 | 1 | 1 | 2.94 | 3.075 |
| 216 | 0 | 1 | 1.72 | 1.801 |
| 217 | 1 | 1 | 3.89 | 4.044 |
| 218 | 1 | 1 | 4.47 | 4.691 |
| 219 | 0 | 1 | 1.63 | 1.696 |
| 220 | 1 | 0 | 3.28 | 3.432 |
| 221 | 1 | 0 | 1.14 | 1.193 |
| 222 | 1 | 1 | 3.91 | 4.089 |
| 223 | 1 | 0 | 0.87 | 0.9002 |
| 224 | 1 | 1 | 1.8 | 1.891 |
| 225 | 1 | 1 | 2.25 | 2.369 |
| 226 | 1 | 0 | 2.59 | 2.738 |
| 227 | 0 | 1 | 0.89 | 0.933 |
| 228 | 0 | 1 | 0.64 | 0.669 |
| 227B | 1 | 1 | 1.38 | 1.439 |
| 228B | 1 | 1 | 3.25 | 3.421 |
| 229 | 1 | 0 | 3.57 | 3.71 |
| 230 | 0 | 1 | 2.43 | 2.583 |
| 231 | 1 | 1 | 3.23 | 3.398 |
| 232 | 1 | 1 | 4.85 | 5.187 |
| 233 | 0 | 1 | 1.09 | 1.138 |
| 234 | 0 | 0 | 0.24 | 0.2521 |
| 235 | 1 | 1 | 2.49 | 2.597 |
| 236 | 1 | 1 | 4.07 | 4.327 |
| 237 | 0 | 1 | 1.17 | 1.235 |
| 238 | 0 | 0 | 0.16 | 0.1683 |
| 239 | 1 | 1 | 3.18 | 3.323 |
| 240 | 1 | 0 | 2.39 | 2.5 |
| 241 | 1 | 1 | 1.72 | 1.805 |
| 242 | 0 | 1 | 0.95 | 0.992 |
| 243 | 0 | 1 | 0.75 | 0.787 |
| 244 | 1 | 1 | 2.28 | 2.398 |
| 245 | 1 | 1 | 1.89 | 1.989 |
| 246 | 1 | 0 | 3.91 | 4.084 |
| 247 | 1 | 1 | 2.53 | 2.648 |
| 248 | 0 | 1 | 0.68 | 0.7146 |
| 249 | 1 | 1 | 2.82 | 2.966 |
| 250 | 1 | 1 | 1.76 | 1.841 |
| 251 | 0 | 0 | 0.18 | 0.1936 |
| 252 | 1 | 1 | 1.39 | 1.452 |
| 253 | 1 | 1 | 3.54 | 3.722 |
| 254 | 1 | 1 | 4.05 | 4.247 |
| 255 | 1 | 1 | 2.09 | 2.192 |
| 256 | 1 | 1 | 1.47 | 1.551 |
| 257 | 1 | 0 | 2.54 | 2.677 |
| 258 | 1 | 1 | 3.83 | 4.002 |
| 259 | 1 | 0 | 1.23 | 1.301 |
| 260 | 1 | 1 | 1.92 | 2.017 |
| 261 | 1 | 1 | 2.17 | 2.323 |
| 262 | 1 | 0 | 2.41 | 2.552 |
| 263 | 1 | 0 | 2.3 | 2.435 |
| 262B | 1 | 0 | 1.34 | 1.408 |
| 263B | 1 | 1 | 3.39 | 3.577 |
| 264 | 0 | 1 | 1.98 | 2.093 |
| 265 | 0 | 1 | 0.8 | 0.854 |
| 266 | 1 | 1 | 1.76 | 1.863 |
| 267 | 1 | 1 | 1.87 | 1.989 |
| 268 | 0 | 0 | 0.19 | 0.2031 |
| 269 | 0 | 0 | 0.12 | 0.1293 |
| 270 | 0 | 1 | 0.57 | 0.607 |
| 271 | 0 | 0 | 0.139 | 0.1481 |
| 272 | 1 | 0 | 1.81 | 1.893 |
| 273 | 1 | 0 | 2.13 | 2.244 |
| 274 | 0 | 1 | 0.52 | 0.5523 |
| 275 | 0 | 1 | 1.7 | 1.805 |
| 276 | 1 | 0 | 1.83 | 1.922 |
| 277 | 1 | 1 | 2 | 2.101 |
| 278 | 0 | 1 | 0.91 | 0.9535 |
| 279 | 1 | 1 | 3.25 | 3.439 |
| 280 | 1 | 1 | 3.45 | 3.586 |
| 281 | 1 | 1 | 4.62 | 4.807 |
| 282 | 1 | 1 | 3.41 | 3.566 |
| 283 | 0 | 1 | 1.34 | 1.407 |
| 284 | 1 | 1 | 2.43 | 2.556 |
| 285 | 1 | 1 | 1.44 | 1.514 |
| 286 | 1 | 1 | 2.49 | 2.614 |
| 287 | 0 | 0 | 0.137 | 0.1445 |
| 288 | 1 | 1 | 1.78 | 1.863 |
| 289 | 0 | 1 | 0.53 | 0.5681 |
| 290 | 1 | 1 | N/S | N/S |
| 291 | 0 | 1 | 0.73 | 0.775 |
| 292 | 1 | 1 | 1.43 | 1.504 |
| 293 | 1 | 1 | 1.92 | 2.012 |
| 294 | 0 | 1 | 0.51 | 0.5388 |
| 295 | 1 | 0 | 2.07 | 2.181 |
| 296 | 1 | 1 | 1.4 | 1.463 |
| 297 | 1 | 1 | 4.21 | 4.548 |
| 298 | 1 | 0 | 3.11 | 3.225 |
| 299 | 1 | 1 | 3.93 | 4.158 |
| 300 | 1 | 1 | 1.99 | 2.062 |
| 301 | 0 | 1 | 0.56 | 0.5858 |
| 302 | 1 | 1 | 1.93 | 2.018 |
| 303 | 1 | 1 | 1.06 | 1.114 |
| 304 | 1 | 1 | 6.89 | 7.302 |
| 305 | 1 | 0 | 2.25 | 2.366 |
| 306 | 1 | 0 | 1.42 | 1.479 |
| 307 | 1 | 0 | 2.39 | 2.591 |
| 308 | 1 | 1 | 2.52 | 2.635 |
| 309 | 1 | 0 | 1.84 | 1.933 |
| 310 | 1 | 1 | 2.29 | 2.412 |
| 311 | 1 | 1 | 1.62 | 1.707 |
| 312 | 0 | 1 | 1.89 | 1.988 |
| 313 | 1 | 1 | 2.48 | 2.577 |
| 314 | 0 | 0 | 1.01 | 1.056 |
| 315 | 1 | 1 | 2.21 | 2.334 |
| 316 | 1 | 1 | 1.54 | 1.617 |
| 317 | 1 | 1 | N/S | N/S |
| 318 | 0 | 1 | 0.65 | 0.6821 |
| 319 | 1 | 1 | 3.32 | 3.493 |
| 320 | 1 | 0 | 2.68 | 2.8 |
| 321 | 1 | 1 | 2.71 | 2.835 |

TABLE 12-continued

Nic1 and Nic2 genotypes and alkaloid measurements of individual plants of a larger F₂ population segregating for nic1 and nic2 ((LA Burley 21 × TN 90 LC) (X)). N/S represent no sample. Asterisks represent four pairs (8 total having plant Nos: 163 and 164, 174 and 175, 361 and 362, 481 and 482, also in bold) of adjacent plants where DNA or leaf samples were likely switched during either sampling, processing or analysis stage. Each of the four pairs of plants were side by side in the field.

| Plant No. | Nic1 (Present = 1, Deleted = 0) | Nic2 (Present = 1, Deleted = 0) | Percent Nicotine | Percent Total Alkaloids |
|---|---|---|---|---|
| 322 | 1 | 0 | 1.97 | 2.068 |
| 323 | 1 | 1 | 2.76 | 2.905 |
| 324 | 1 | 0 | 3.92 | 4.122 |
| 325 | 1 | 0 | 2.56 | 2.724 |
| 326 | 1 | 1 | 3.18 | 3.355 |
| 327 | 0 | 1 | 2.08 | 2.165 |
| 328 | 1 | 0 | 2.77 | 2.89 |
| 329 | 1 | 1 | 2.11 | 2.216 |
| 330 | 1 | 0 | 1.81 | 1.878 |
| 331 | 0 | 0 | 0.2 | 0.2096 |
| 332 | 1 | 1 | 1.8 | 1.894 |
| 333 | 0 | 1 | 0.75 | 0.7875 |
| 334 | 1 | 0 | 2.78 | 2.92 |
| 335 | 0 | 0 | 0.19 | 0.2044 |
| 336 | 1 | 1 | 2.2 | 2.31 |
| 337 | 1 | 1 | 1.54 | 1.606 |
| 338 | 0 | 0 | 0.19 | 0.1986 |
| 339 | 1 | 1 | 2.05 | 2.153 |
| 340 | 1 | 0 | 1.57 | 1.644 |
| 341 | 1 | 1 | 2.64 | 2.768 |
| 342 | 1 | 1 | 2.4 | 2.522 |
| 343 | 1 | 1 | 2.1 | 2.213 |
| 344 | 1 | 1 | 2.83 | 2.989 |
| 345 | 1 | 0 | 2.77 | 2.899 |
| 346 | 1 | 1 | 1.44 | 1.509 |
| 347 | | | 2.89 | 3.042 |
| 348 | 1 | 1 | 1.76 | 1.841 |
| 349 | 0 | 1 | 0.59 | 0.6235 |
| 350 | 1 | 1 | 3.62 | 3.804 |
| 351 | | | 0.67 | 0.707 |
| 352 | 1 | 0 | 2.25 | 2.352 |
| 353 | 1 | 1 | 1.7 | 1.786 |
| 354 | 1 | 1 | 2.36 | 2.463 |
| 355 | 1 | 1 | N/S | N/S |
| 356 | 1 | 1 | 3.36 | 3.549 |
| 357 | 1 | 1 | 1.63 | 1.706 |
| 358 | 0 | 1 | 0.84 | 0.887 |
| 359 | 0 | 1 | 0.5 | 0.5223 |
| 360 | 1 | 1 | 2.44 | 2.568 |
| 361* | 0 | 1 | 1.86 | 1.931 |
| 362* | 0 | 0 | 2.98 | 3.122 |
| 363 | 0 | 0 | 0.072 | 0.0754 |
| 364 | 0 | 1 | 1.64 | 1.739 |
| 365 | 1 | 1 | 3.4 | 3.602 |
| 366 | 1 | 0 | 2.72 | 2.872 |
| 367 | 0 | 1 | 1.12 | 1.205 |
| 368 | 1 | 1 | 3 | 3.207 |
| 369 | 1 | 1 | 1.45 | 1.542 |
| 370 | 1 | 1 | 4.65 | 4.975 |
| 371 | 1 | 1 | 3.1 | 3.271 |
| 372 | 1 | 1 | 1.2 | 1.252 |
| 373 | 1 | 1 | 1.94 | 2.049 |
| 374 | 0 | 0 | 0.24 | 0.2523 |
| 375 | 1 | 1 | 3.4 | 3.528 |
| 376 | 1 | 0 | 2.73 | 2.863 |
| 377 | 0 | 1 | 0.57 | 0.5979 |
| 378 | 1 | 1 | 2.34 | 2.447 |
| 379 | 1 | 1 | 2.9 | 3.073 |
| 380 | 1 | 1 | 2.03 | 2.156 |
| 381 | 1 | 1 | 2.07 | 2.177 |
| 382 | 0 | 1 | 1.23 | 1.301 |
| 383 | 1 | 1 | 2.42 | 2.554 |
| 384 | 1 | 1 | 3.32 | 3.518 |
| 385 | 1 | 1 | 2.18 | 2.293 |
| 386 | 1 | 1 | 1.58 | 1.668 |
| 387 | 0 | 1 | 1.21 | 1.285 |
| 388 | 0 | 0 | 0.074 | 0.0789 |
| 389 | 1 | 1 | 1.65 | 1.725 |
| 390 | 1 | 1 | 2.36 | 2.507 |
| 391 | 1 | 1 | 1.94 | 2.055 |
| 392 | 1 | 1 | 2 | 2.102 |
| 393 | 1 | 1 | 2.61 | 2.705 |
| 394 | 0 | 1 | 1 | 1.06 |
| 395 | 1 | 1 | 2.53 | 2.641 |
| 396 | 1 | 1 | 1.03 | 1.081 |
| 397 | 0 | 0 | 0.136 | 0.1417 |
| 398 | 1 | 1 | 0.99 | 1.033 |
| 399 | 1 | 1 | 1.96 | 2.062 |
| 400 | 0 | 0 | 0.113 | 0.1193 |
| 401 | 1 | 1 | 1.75 | 1.841 |
| 402 | 1 | 1 | 2.34 | 2.442 |
| 403 | 1 | 1 | 1.92 | 2.002 |
| 404 | 1 | 1 | 3.87 | 4.06 |
| 405 | 1 | 1 | 2.94 | 3.068 |
| 406 | 1 | 1 | 1.15 | 1.204 |
| 407 | 1 | 1 | 3.15 | 3.359 |
| 408 | 1 | 1 | 1.83 | 1.923 |
| 409 | 1 | 1 | 2.28 | 2.402 |
| 410 | 1 | 1 | 2.76 | 2.906 |
| 411 | 1 | 1 | 1.88 | 1.994 |
| 412 | 1 | 1 | 1.28 | 1.342 |
| 413 | 1 | 1 | 1.12 | 1.175 |
| 414 | 0 | 1 | 1.28 | 1.341 |
| 415 | 1 | 1 | 2.22 | 2.334 |
| 416 | 0 | 1 | 1.05 | 1.099 |
| 417 | 1 | 1 | 3.01 | 3.148 |
| 418 | 1 | 1 | 3.27 | 3.444 |
| 419 | 1 | 1 | 1.77 | 1.86 |
| 420 | 1 | 1 | 1.44 | 1.497 |
| 421 | 0 | 1 | 0.55 | 0.5777 |
| 422 | 1 | 0 | 2.7 | 2.825 |
| 423 | 1 | 1 | 1.24 | 1.315 |
| 424 | 1 | 1 | 2.95 | 3.106 |
| 425 | 0 | 1 | 0.63 | 0.6607 |
| 426 | 1 | 1 | 2.88 | 3.014 |
| 427 | 1 | 1 | 2.31 | 2.455 |
| 428 | 1 | 0 | 1.92 | 1.994 |
| 429 | 1 | 1 | 3.05 | 3.232 |
| 430 | 1 | 1 | 1.76 | 1.88 |
| 431 | 0 | 0 | 0.11 | 0.1164 |
| 432 | 0 | 1 | 0.78 | 0.8129 |
| 433 | 0 | 1 | 2.01 | 2.134 |
| 434 | 1 | 1 | 1.98 | 2.095 |
| 435 | | | 1.71 | 1.801 |
| 436 | 1 | 0 | 3.27 | 3.447 |
| 437 | 0 | 1 | 0.89 | 0.944 |
| 438 | 1 | 1 | 2.9 | 3.049 |
| 439 | 0 | 0 | 0.18 | 0.1905 |
| 440 | 1 | 1 | 4.12 | 4.367 |
| 441 | 0 | 1 | 1.53 | 1.623 |
| 442 | 1 | 1 | 4.07 | 4.315 |
| 443 | 0 | 1 | 1.35 | 1.429 |
| 444 | 1 | 0 | 2.98 | 3.12 |
| 445 | 1 | 1 | 4.98 | 5.272 |
| 446 | 0 | 1 | 1.22 | 1.288 |
| 447 | 1 | 1 | 4.34 | 4.578 |
| 448 | 1 | 1 | 2.89 | 3.028 |
| 449 | 1 | 1 | 5.8 | 6.135 |
| 450 | 1 | 1 | 4.34 | 4.553 |
| 451 | 1 | 0 | 3.6 | 3.791 |
| 452 | 1 | 1 | 4.67 | 4.947 |
| 453 | 0 | 1 | 1.83 | 1.918 |
| 454 | 1 | 1 | 2.6 | 2.692 |
| 455 | 1 | 1 | 5.03 | 5.301 |
| 456 | 1 | 1 | 4.41 | 4.695 |
| 457 | 1 | 0 | 2.62 | 2.741 |

TABLE 12-continued

Nic1 and Nic2 genotypes and alkaloid measurements of individual plants of a larger $F_2$ population segregating for nic1 and nic2 ((LA Burley 21 x TN 90 LC) (X)). N/S represent no sample. Asterisks represent four pairs (8 total having plant Nos: 163 and 164, 174 and 175, 361 and 362, 481 and 482, also in bold) of adjacent plants where DNA or leaf samples were likely switched during either sampling, processing or analysis stage. Each of the four pairs of plants were side by side in the field.

| Plant No. | Nic1 (Present = 1, Deleted = 0) | Nic2 (Present = 1, Deleted = 0) | Percent Nicotine | Percent Total Alkaloids |
|---|---|---|---|---|
| 458 | 0 | 0 | 0.133 | 0.1425 |
| 459 | 0 | 1 | 0.53 | 0.5534 |
| 460 | 0 | 1 | 0.63 | 0.6663 |
| 461 | 0 | 1 | 2.78 | 2.943 |
| 462 | 1 | 1 | 2.64 | 2.785 |
| 463 | 0 | 1 | 1.23 | 1.296 |
| 464 | 0 | 1 | 1.55 | 1.629 |
| 465 | 1 | 1 | 2.49 | 2.626 |
| 466 | 1 | 1 | 2.8 | 2.936 |
| 467 | 0 | 0 | 0.19 | 0.2026 |
| 468 | 0 | 1 | 1.91 | 2.029 |
| 469 | 1 | 1 | 1.37 | 1.442 |
| 470 | 0 | 1 | 1.29 | 1.375 |
| 471 | 1 | 1 | 3.74 | 3.919 |
| 472 | 0 | 1 | 1.67 | 1.78 |
| 473 | 1 | 1 | 1.39 | 1.479 |
| 474 | 1 | 1 | 0.88 | 0.926 |
| 475 |  |  | 2.53 | 2.679 |
| 476 | 1 | 1 | 3.59 | 3.756 |
| 477 | 1 | 1 | 3.96 | 4.196 |
| 478 | 1 | 1 | 1.59 | 1.679 |
| 479 | 0 | 1 | 2.27 | 2.385 |
| 480 | 0 | 0 | 0.108 | 0.1147 |
| 481* | 0 | 1 | 2.21 | 2.363 |
| 482* | 1 | 1 | 0.54 | 0.5726 |
| 483 | 1 | 1 | 1.76 | 1.854 |
| 484 | 1 | 1 | 3.34 | 3.512 |
| 485 | 1 | 1 | 1.4 | 1.468 |
| 486 | 1 | 0 | 0.87 | 0.9085 |
| 487 | 0 | 1 | 0.38 | 0.3976 |
| 488 | 1 | 1 | 2.53 | 2.662 |
| 489 | 0 | 1 | 1.34 | 1.412 |
| 490 | 0 | 1 | 1.17 | 1.246 |
| 491 | 0 | 1 | 0.43 | 0.4505 |
| 492 | 1 | 0 | 3.55 | 3.741 |
| 493 | 0 | 1 | 2.16 | 2.294 |
| 494 | 1 | 1 | 2.6 | 2.736 |
| 495 | 1 | 1 | 2.73 | 2.905 |
| 496 | 1 | 1 | 2.46 | 2.591 |
| 497 | 1 | 1 | 1.8 | 1.906 |
| 498 | 0 | 1 | 0.75 | 0.7913 |
| 499 | 1 | 1 | 1.37 | 1.461 |
| 500 | 1 | 0 | 1.63 | 1.731 |
| 501 | 1 | 1 | 1.34 | 1.417 |
| 502 | 1 | 0 | 0.98 | 1.0156 |
| 503 | 1 | 1 | 0.79 | 0.8276 |
| 504 | 1 | 0 | 1.75 | 1.812 |
| 505 | 1 | 1 | 1.49 | 1.571 |
| 506 | 0 | 0 | 0.084 | 0.0892 |
| 507 | 1 | 1 | 1.2 | 1.247 |
| 508 | 1 | 0 | 1.98 | 2.081 |
| 509 | 1 | 0 | 1.03 | 1.0704 |
| 510 | 1 | 0 | 1.4 | 1.475 |
| 511 | 1 | 0 | 0.76 | 0.791 |
| 512 | 1 | 1 | 1.4 | 1.491 |
| 513 | 1 | 1 | 2.29 | 2.402 |
| 514 | 1 | 1 | 1.14 | 1.19 |
| 515 | 1 | 1 | 1 | 1.044 |
| 516 | 1 | 1 | 1.26 | 1.356 |
| 517 | 0 | 1 | 0.52 | 0.5535 |
| 518 | 1 | 1 | 0.45 | 0.4786 |
| 519 | 1 | 0 | 1.59 | 1.651 |
| 520 | 1 | 1 | 1.59 | 1.667 |
| 521 | 0 | 1 | 0.46 | 0.4803 |
| 522 | 1 | 0 | 1.1 | 1.162 |

TABLE 13

Genetic segregation of an $F_2$ segregating population ((LA Burley 21 x TN 90 LC) (X)) and average percent total alkaloid and percent nicotine levels in each of the four segregating genotypes. Both the mean and standard deviation are shown. Three plants with missing samples are excluded rendering the total number of plants analyzed to be 518.

| Genotype | Ratio Expected | Number of Plants Expected | Number of Plants Observed | Average Percent Nicotine | Std Dev (Nicotine) | Average Percent Total Alkaloid | Std Dev (Total Alkaloid) |
|---|---|---|---|---|---|---|---|
| Nic1 Nic2 | 9/16 | 291.9 | 288 | 2.55 | 1.08 | 2.68 | 1.14 |
| Nic1 nic2 | 3/16 | 97.3 | 96 | 2.25 | 0.83 | 2.36 | 0.87 |
| nic1 Nic2 | 3/16 | 97.3 | 97 | 1.30 | 0.61 | 1.37 | 0.65 |
| nic1 nic2 | 1/16 | 32.4 | 37 | 0.36 | 0.78 | 0.38 | 0.81 |

TABLE 14

A re-analysis of the segregation population in Table 12 further excluding the four plant pairs which were likely switched (plant Nos: 163 and 164, 174 and 175, 361 and 362, 481 and 482) and rendering the total plant number to be 510.

| Genotype | Ratio Expected | Number of Plants Expected | Number of Plants Observed | Average Percent Nicotine | Std Dev (Nicotine) | Average Percent Total Alkaloid | Std Dev (Total Alkaloid) |
| --- | --- | --- | --- | --- | --- | --- | --- |
| Nic1 Nic2 | 9/16 | 286.88 | 285 | 2.57 | 1.06 | 2.71 | 1.11 |
| Nic1 nic2 | 3/16 | 95.63 | 96 | 2.25 | 0.83 | 2.36 | 0.87 |
| nic1 Nic2 | 3/16 | 95.63 | 95 | 1.28 | 0.60 | 1.35 | 0.64 |
| nic1 nic2 | 1/16 | 31.88 | 34 | 0.18 | 0.16 | 0.19 | 0.17 |

Example 12

Genome Re-sequencing to Validate and Refine Sequences in the Identified Nic1 Lesion Genomic sequences of the identified Nic1 scaffold and annotated genes were re-sequenced using PacBio's SMRT sequencing technology (NT2.0). Sequence quality of Nic1 locus region (NT1.0-Scaffold0002504) was improved. Briefly, base pairs (bps) 1 to 133,550 of NT2.0-Scaffold4274 (SEQ ID No: 73) correspond to and replace NT1.0-Scaffold0002504 between bps 384,701 to 542,313 in the minus orientation. Base pairs 1 to 59,671 of NT2.0-Scaffold14415 (SEQ ID No: 74) correspond to and replace NT1.0-Scaffold0002504 between bps 288,601 to 363,040 in the minus orientation.

Additional genomic sequence data are provided in SEQ ID Nos: 75 to 82 for the 8 genes previously identified in SEQ ID Nos: 21 to 28, respectively. A new set of cDNA and protein sequences of "g100623_Scaffold0002504" are also identified (new sequences of SEQ ID No: 83 and 84 relative to previous sequences of SEQ ID No: 46 and 66, respectively).

Each and every U.S. or foreign patent, publication of patent application, non-patent literature or any other reference mentioned in this application is incorporated by reference in its entirety.

Example 13

Figure 7:
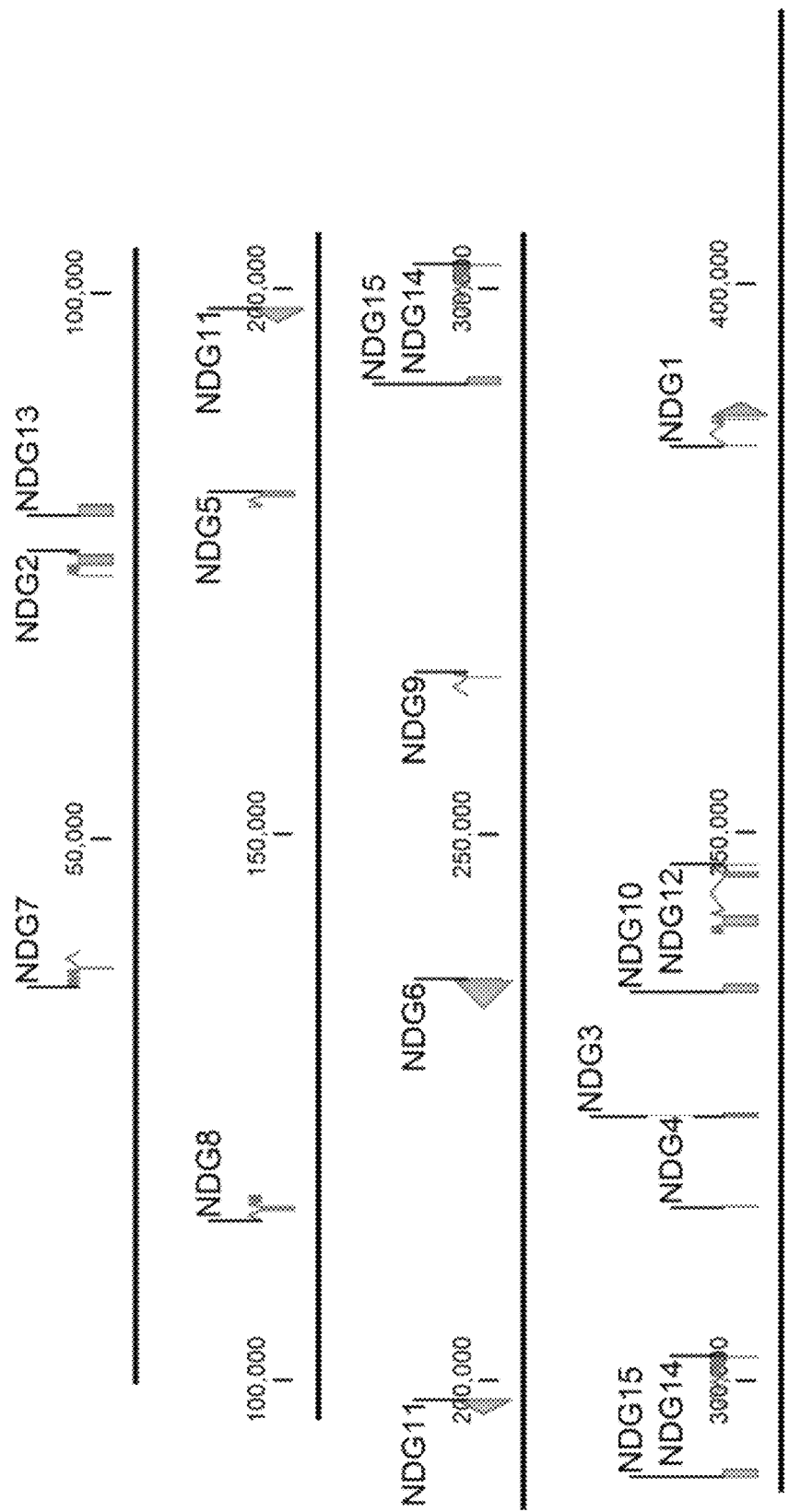
FIG. 7 shows the relative genomic position of NDG1 to NDG15 genes on SEQ ID NO: 85 which is shown in four overlapping segments (from top to bottom, nucleotide 1 to ~100 k, ~100 k to ~200 k, ~200 k to ~300 k, and ~300 k to 425 k, respectively).

Complete Sequencing of the Nic1 Lesion Region Using Bacteria Artificial Chromosome Sequencing A bacterial artificial chromosomes (BAC) walking method was used to generate the complete sequence around the Nic1 locus and further identify boundary sequences of the genomic deletion. Briefly, 21 BAC clones associated with whole-genome profiling (WGP) contigs were identified and pooled to form 3 pools of 7 BACs each. Each pool was sequenced separately on separate SMRT cells (PacBio). The sequences were assembled into 14 contigs, which were further assembled into one contig based on overlapping sequence information obtained by blasting 1000 bps on either end of each contig. The resulting reference contig was used to re-map resequencing data from BU21, HI, LI, and LA BU21 lines. A contiguous 425,001 bp region (SEQ ID NO: 85) that spans the entire Nic1 deletion was identified. Table 15 provides details of the fifteen identified gene models with functional information for the encoded proteins based on the best BLAST hit. The relative position of these fifteen genes on SEQ ID NO: 85 can be found in FIG. 7. The genomic sequences (SEQ ID NOs: 86 to 100), coding sequences (CDS; SEQ ID NOs: 101 to 115) and protein sequences (SEQ ID NOs: 116 to 130) are provided for the fifteen Nic1 Deletion Genes (NDG1 to NDG15). Among these, genomic sequence data provided in SEQ ID NOs: 86, 87, and 90 to 100 correspond to the 13 gene models previously identified in SEQ ID NOs: 28, 13, 20, 22, 11, 17, 23, 26, 21, 27, 14, 25, and 24, respectively. RNAi constructs are designed to silence NDG1 to NDG15 and are also used to make transgenic tobacco plants with lower alkaloid levels.

Example 14

Development of Additional SNP Markers for Selecting Nic1 and Nic2

To provide more efficient selection of plants that harbor nic1 and nic2 mutations, 12 SNPs (6 SNPs for each locus) flanking nic1 and nic2 deletions were identified to develop co-dominant markers. Three SNPs upstream and 3 SNPs downstream of each deletion region are used. Each of the SNP polymorphisms is less than 100 kb from the corresponding deleted region. Table 16 provides more details on the relative location and sequence polymorphism for each SNP, and also provides sequence information for 60 bps upstream and downstream of each SNP. High throughput Kompetetive Allele Specific PCR™ or KASP™ assays (LGC Genomics, Beverly, Mass.) are designed based on the identified SNPs for genotyping. These SNP markers can be used to detect plants that are heterozygous for a nic1 or nic2 deletion and can also distinguish a true homozygous deletion from a bad PCR reaction. The effectiveness of two SNP markers (Seq ID Nos. 135 and 137) for genotyping the $F_2$ population ((LA Burley 21×TN 90 LC) (X)) of Example 11 (see plant No. 1 to 72 of Table 12) is shown in Table 18.

Example 15

Identification of an ERF Gene Associated with Nic1

An ERF gene, named as "ERF-39 like" was identified 307,823 bps downstream of the Nic1 deletion region. Given this gene's close proximity, two adjoining SNP markers (SEQ ID Nos. 143 and 144) were identified for genotyping and tracking purposes. The details of the two SNPs are provided in Table 17. The genomic, cDNA, and protein sequence of the ERF-39 like gene are provided in SEQ ID Nos: 145 to 147, respectively. Plants that overexpress or downregulate the ERF-39 gene (e.g., via RNAi, artificial

Example 16

Development of Low-alkaloid Tobacco Plants Via Gene Silencing and Genome Editing Tobacco lines with low nicotine while maintaining high leaf quality are produced by introducing loss-of-function or null mutations into Nic1 locus or Nic2 locus via targeted genome editing technologies. Examples of genome editing techniques are Transcription activator-like effector nucleases (TALENs), meganuclease, zinc finger nuclease, and CRISPR, as described in Example 10. Genome modifications are made in commercial tobacco varieties such as TN90, K326 and Narrow Leaf Madole. Additional tobacco lines with suppressed expression of one or more NDGs, one or more ERF genes at Nic2 locus, or a combination thereof are generated via gene silencing (e.g., RNAi, artificial/synthetic microRNA or other small RNA-mediated techniques). Exemplary RNAi cassette sequences targeting NDG1 to NDG15 are listed in Table 15.

For example, protoplasts are prepared as described in Example 10. One or more entry vectors containing sequences for transcription activator like effector proteins, specific for the target sequences of Nic1 (e.g., NDG1 or NDG2), ERF-39 like, and Nic2 (e.g., ERF189 or another ERF gene from Table 11) are synthesized and transformed into the isolated protoplasts. Protoplasts are cultured into calli. Alternatively, Nic1 and Nic2 loci mutations are achieved through CRISPR and without the use of plasmids. In this case, protoplasts are transformed with Cas9, guide RNA and polyethylene glycol (PEG).

The plants created contain a gene mutation (e.g., null mutation or deletion) in Nic1, Nic2, or both loci, and constitute a low-nicotine variety. Alternatively, a variety containing a Nic1 mutant allele is crossed to another variety containing a Nic2 mutant allele. This cross will result in cultivars with desirable genetic backgrounds having an even lower nicotine content but high leaf quality. As an alternate option, gene silencing and genome editing techniques can be utilized as described in Example 10 to introduce Nic1 and Nic2 mutations or deletions at the same time.

TABLE 15

Details of the location of the coding sequence (CDS) within Nic1 locus, and BLAST hit with the lowest E-value of the corresponding protein are provided in this Table. Sequences of inverted repeat-containing RNAi cassettes are listed as SEQ ID Nos. The T-DNA cassette sequences of the RNAi vector can be found in SEQ ID Nos. 69 and 70.

| Name | Position coordinates on SEQ ID NO: 85 | BLAST Hit Description | Blast Hit ID | Genomic sequence (SEQ ID) | cDNA sequence (SEQ ID) | Amino acid sequence (SEQ ID) | Corresponding genes from Table 10 | RNAi cassette sequence (SEQ ID) |
|---|---|---|---|---|---|---|---|---|
| NDG1 | join(385015...385449, 37135...387299, 387383...387795, 387857...389264) | PREDICTED: putative late blight resistance protein homolog R1A-3 [*Nicotiana*] | XP_009624787.1 | 86 | 101 | 116 | g100614_Scaffold0002504 | 148 and 149 |
| NDG2 | complement(join(73886...74311, 74491...74680, 74794...74934, 75026...76149, 76285...76524)) | PREDICTED: putative late blight resistance protein homolog R1B-16 [*Nicotiana*] | XP_009589795.1 | 87 | 102 | 117 | g100631_Scaffold0002504 | 150 and 151 |
| NDG3 | join(323943...323949, 324085...324464) | PREDICTED: uncharacterized protein LOC104090758 [*Nicotiana tomentosiformis*] | XP_009594228.1 | 88 | 103 | 118 | | 152 |
| NDG4 | 315634...316095 | PREDICTED: uncharacterized protein LOC104106516 [*Nicotiana tomentosiformis*] | XP_009613372.1 | 89 | 104 | 119 | | 153 |
| NDG5 | complement(join(179863...179982, 180074...180152, 180839...181455)) | PREDICTED: uncharacterized protein LOC104091789 [*Nicotiana tomentosiformis*] | XP_009595504.1 | 90 | 105 | 120 | g100618_Scaffold0002504 | 154 |
| NDG6 | complement(join(233956...234093, 234729...235030, 235166...235378, 235496...236068, 236374...236438, 236633...236874)) | PREDICTED: uncharacterized protein LOC104093328 [*Nicotiana tomentosiformis*] | XP_009597352.1 | 91 | 106 | 121 | g100617_Scaffold0002504 | 155 |
| NDG7 | join(36266...36629, 36753...36911, 37083...37384, 37655...37736, 37857...38347, 39697...39783) | PREDICTED: uncharacterized protein LOC107001234 [*Solanum pennellii*] | XP_015054850.1 | 92 | 107 | 122 | g100619_Scaffold0002504 | 156 |
| NDG8 | join(114418...114612, 115436...115956, 116268...116427, 116558...116749, 116833...117003) | PREDICTED: uncharacterized protein LOC104086561 [*Nicotiana tomentosiformis*] | XP_009589152.1 | 93 | 108 | 123 | g100620_Scaffold0002504 | 157 |

TABLE 15-continued

Details of the location of the coding sequence (CDS) within Nic1 locus, and BLAST hit with the lowest E-value of the corresponding protein are provided in this Table. Sequences of inverted repeat-containing RNAi cassettes are listed as SEQ ID Nos. The T-DNA cassette sequences of the RNAi vector can be found in SEQ ID Nos. 69 and 70.

| Name | Position coordinates on SEQ ID NO: 85 | BLAST Hit Description | Blast Hit ID | Genomic sequence (SEQ ID) | cDNA sequence (SEQ ID) | Amino acid sequence (SEQ ID) | Corresponding genes from Table 10 | RNAi cassette sequence (SEQ ID) |
|---|---|---|---|---|---|---|---|---|
| NDG9 | complement(join(262599 . . . 262791, 264178 . . . 264595, 264677 . . . 264995)) | PREDICTED: uncharacterized protein LOC107029976 [Solanum pennellii] | XP_015086886.1 | 94 | 109 | 124 | g100621_Scaffold0002504 | 158 |
| NDG10 | 335270 . . . 336187 | PREDICTED: uncharacterized protein LOC104217532 [Nicotiana sylvestris] | XP_009766114.1 | 95 | 110 | 125 | g100623_Scaffold0002504 | 159 |
| NDG11 | complement(join(196787 . . . 197330, 197459 . . . 197772, 197860 . . . 198026, 198131 . . . 198293)) | PREDICTED: uncharacterized protein LOC104107887 [Nicotiana tomentosiformis] | XP_009615097.1 | 96 | 111 | 126 | g100622_Scaffold0002504 | 160 |
| NDG12 | complement(join(340626 . . . 340850, 340943 . . . 341242, 341377 . . . 342443, 342827 . . . 342891, 345833 . . . 346446, 346782 . . . 347228)) | PREDICTED: uncharacterized protein LOC104225535 [Nicotiana sylvestris] | XP_009775660.1 | 97 | 112 | 127 | g100626_Scaffold0002504 | 161 |
| NDG13 | join(79509 . . . 79744, 79863 . . . 80141, 80301 . . . 80715) | PREDICTED: uncharacterized protein LOC104095512 [Nicotiana tomentosiformis] | XP_009599950.1 | 98 | 113 | 128 | g100627_Scaffold0002504 | 162 |
| NDG14 | complement(join(297606 . . . 297727, 299439 . . . 299551, 300249 . . . 300331, 300629 . . . 300802, 301088 . . . 301258, 301326 . . . 301450, 301535 . . . 301636, 301731 . . . 301859, 301942 . . . 302392)) | PREDICTED: uncharacterized protein LOC104215965 [Nicotiana sylvestris] | XP_009764210.1 | 99 | 114 | 129 | g100628_Scaffold0002504 | 163 |
| NDG15 | join(291110 . . . 291242, 291376 . . . 291556, 291665 . . . 292004) | PREDICTED: DNA ligase 1-like [Nicotiana sylvestris] | XP_009785055.1 | 100 | 115 | 130 | g100632_Scaffold0002504 | 164 |

TABLE 16

SNP markers flanking Nic1 or Nic2 deletion region. REF refers to the sequence of a reference TN90 allele. ALT refers to an alternative allele associated with the corresponding deletion region. Genotype in the 4 varieties (BU21, HI, LI, and LA) are shown where "00" refers to homozygous for the reference TN90 allele while "11" refers to homozygous for the ALT allele. The polymorphic site in the sequence is denoted by an "X".

| SNP Marker (SEQ ID No.) | Assc'd Locus | Relative Position to the deletion | REF | ALT | BU21 | HI | LI | LA | Sequence |
| --- | --- | --- | --- | --- | --- | --- | --- | --- | --- |
| 131 | Nic1 | Upstream | C | A | 00 | 00 | 11 | 11 | ATCATGTCTAATTGATTTAATTGCTGTATTTGCTCAAA CTGCCTTATTTGGACTATGTGAXACATGCTAGGTTAGA AATATATGTTTTAACTTGGTGTGAAATTTAATTTAATT GAGTATT (SEQ ID NO. 131) |
| 132 | Nic1 | Upstream | C | T | 00 | 00 | 11 | 11 | GCGGCTGTATACCATTTTGTACGGACCGCAGTGGGCTC ACCGTGGCCTCAATCGAGTTTGXGCGGTTCATAAAGAT GGGGGTTCAGAGAGTTGGGAGTTTAGAGATTAAGACCA ATACGGT (SEQ ID NO. 132) |
| 133 | Nic1 | Upstream | T | G | 00 | 00 | 11 | 11 | GGAAGCACTCAAGCATCCACTCTTGGAGGTGGTGGGGG AGGGTCTGGAATATTATCATTGXCCTGGTGGCTTCTCC TTTGTCTTTGAGGTACAATAGGAACCTCATCATCAATA TTGTCAT (SEQ ID NO. 133) |
| 134 | Nic1 | Downstream | T | C | 00 | 00 | 11 | 11 | ACGAAGGATAAAGTGTTTGGGTAGCAGAACAAAATGCC TTCGTCATTCCAGTCTTTAACAXATGCCAAGTGCAAAC AATACAATTTAAATTTGTAGTCTCTTCTGATGGTGTTG GACTTAC (SEQ ID NO. 134) |
| 135 | Nic1 | Downstream | C | T | 00 | 00 | 11 | 11 | ACACCTTCTTCCGGGTTAACAGAATTCCATACTCGGAT TTCTGGTTCGCAGACTGTAATAXGGAGTCAATCTTTTC CTCGATTTGGGATTTGAACCGGTGATTTGGGAAATCAT AATTATC (SEQ ID NO. 135) |
| 136 | Nic1 | Downstream | A | G | 00 | 00 | 11 | 11 | TAGCTAACAAGGAATTGGATCAATTGAGAGATTGATTA ACCCAATTAAAGAGTTTAACCTXGAGATAGTAACAACA TGACTTGAGCTCTTATCAACAGTTTTGGTTGATACCTT TTGGTCT (SEQ ID NO. 136) |
| 137 | Nic2 | Upstream | T | C | 00 | 11 | 00 | 11 | TTACATAAATATAAAGGTTTAATTGAAAGTTATACTTT TTGGTCAAACACAAATACCGTAXCAAAATAGTTCGATA CGGTTAGGTATTTTCTTGTTTGGTTCGGTACGGCTTCG ATATTAT (SEQ ID NO. 137) |
| 138 | Nic2 | Upstream | G | A | 00 | 11 | 00 | 11 | GAAAATACCGACCGAAAACGGTCGAAAATAACATATTT TTTAATTATTCCAACCGACTTCXGTCGGTTTGTTAAGA TTTAAAAAGAAATGCAAAATTATCACATAATTATATTT CCGACCG (SEQ ID NO. 138) |
| 139 | Nic2 | Upstream | G | A | 00 | 11 | 00 | 11 | GTCTGCACTTTTCTTATTGCTTATTGTTTACCCGAAAA ATGGATAGAGTTGAATTTATACXTAGTTTTAAGGGTAT GTGGTATAATTTAATACAAATCGTAAGAATAAGTAGAA ATATCAA (SEQ ID NO. 139) |
| 140 | Nic2 | Downstream | G | A | 00 | 11 | 00 | 11 | TAGGATTTTGACCGTGGTTGGGAACTATGTGAAGACAA CTCCGGAATAGAGTTATGTCGXTTCTGTTAGCTCCATT AGATGATTTTGGACTTAGGGGCGTGTCCGGATTATGTT TTGGAG (SEQ ID NO. 140) |
| 141 | Nic2 | Downstream | A | G | 00 | 11 | 00 | 11 | GTCCCTTACGAATTTGTCTTCAAATTGATACTTCTCCT TGCTAAAACACCACGATCCTTAXCCACAACTCACCCCA CGAACCCTAGCATAGAACCACACCACCCTACGGCCCTT AAGAAAC (SEQ ID NO. 141) |
| 142 | Nic2 | Downstream | T | C | 00 | 11 | 00 | 11 | GCCTCCCAGCTTAGCAAGAGTTCATCCGGCATTTCATT TTTCGATGCTACAAAGGTATCAXGGCAATCCGTCTCAT GTGTTGGATTTCAGCTCAGTCCAGTTGGACAAGGATCT ATCTTAT (SEQ ID NO. 142) |

TABLE 17

SNP markers flanking the ERF-39 like gene which is associated with Nic1 deletion region. Listed are relative positions (Pos, Upstream/Downstream), Reference allele in TN90 (REF), Alternate allele (ALT), Genotype in the 4 varieties (BU21, HI, LI, and LA BU21(, and sequence of the SNO with flanking position are provided in this table. "00" refers to homozygous for the reference TN90 allele while "11" refers to homozygous for the ALT allele and "01" refers to heterozygous. The polymorphic site in the sequence is denoted by an "X".

| SNP Marker (SEQ ID No.) | Assc'd Locus | Relative Position to ERF-39 | REF | ALT | BU21 | HI | LI | LA | Sequence |
|---|---|---|---|---|---|---|---|---|---|
| 143 | ERF-39 | Upstream | A | G | 00 | 00 | 01 | 01 | CCAAATTATTTTTGACTGTTTGACCAAAATAGCGACCAACGTTGGTCGCCATTTTTGATCXTTTGACCAAAATGGCGACCAACTTTGGTCGCTATATTTGAAAATAAATAAATAAAATAAT (SEQ ID NO. 143) |
| 144 | ERF-39 | Downstream | TG | T | 00 | 00 | 11 | 11 | TTGTTTCTCAAGAAAATCAGCATCGATCTTTTTCTTTATTATAAAGGTAATATAGATGCTXXGGGTATTAAAAGAGGACAAAATATTCTGGCATCATTTGAGATTTGCTGAGTGCAATAACA (SEQ ID NO. 144) |

TABLE 18

A comparison of gene-specific primers and flanking SNP markers for genotyping the $F_2$ population of Example 11 (segregating for nic1 and nic2 ((LA Burley 21 × TN 90 LC) (X)), F2_1 to F2_72 plants refer to plant No. 1 to 72 of Table 12).

Genotyping of Nic1 locus using gene-specific primers for g100614 Scaffold0002504 as in Table 5.

|   | 1 | 2 | 3 | 4 | 5 | 6 | 7 | 8 | 9 |
|---|---|---|---|---|---|---|---|---|---|
| A | F2_1 | F2_9 | F2_17 [a,c] | F2_25 [a,c] | F2_33 | F2_41 | F2_49 | F2_57 | F2_65 |
| B | F2_2 | F2_10 | F2_18 | F2_26 | F2_34 | F2_42 | F2_50 [a,c] | F2_58 [a,c] | F2_66 |
| C | F2_3 [a,c] | F2_11 | F2_19 [a,c] | F2_27 | F2_35 [a,c] | F2_43 | F2_51 [a,c] | F2_59 | F2_67 |
| D | F2_4 | F2_12 | F2_20 | F2_28 | F2_36 | F2_44 | F2_52 | F2_60 | F2_68 |
| E | F2_5 | F2_13 | F2_21 | F2_29 | F2_37 | F2_45 [a,c] | F2_53 | F2_61 | F2_69 [a,c] |
| F | F2_6 | F2_14 | F2_22 | F2_30 | F2_38 [a,c] | F2_46 | F2_54 | F2_62 | F2_70 |
| G | F2_7 | F2_15 | F2_23 | F2_31 | F2_39 [a,c] | F2_47 | F2_55 | F2_63 | F2_71 |
| H | F2_8 | F2_16 | F2_24 [a] | F2_32 | F2_40 | F2_48 | F2_56 | F2_64 | F2_72 [a,c] |

KASP genotyping of Nic1 using SNP marker SEQ ID No. 135

|   | 1 | 2 | 3 | 4 | 5 | 6 | 7 | 8 | 9 |
|---|---|---|---|---|---|---|---|---|---|
| A | F2_1 * | F2_9 [b] | F2_17 [a,c] | F2_25 [a,c] | F2_33 | F2_41 [b] | F2_49 | F2_57 [b] | F2_65 * |
| B | F2_2 [b] | F2_10 [b] | F2_18 | F2_26 | F2_34 | F2_42 [b] | F2_50 [a,c] | F2_58 [a,c] | F2_66 [b] |
| C | F2_3 [a,c] | F2_11 [b] | F2_19 [a,c] | F2_27 | F2_35 [a,c] | F2_43 [b] | F2_51 [b] | F2_59 [b] | F2_67 [b] |
| D | F2_4 | F2_12 [b] | F2_20 | F2_28 [b] | F2_36 [b] | F2_44 [b] | F2_52 [b] | F2_60 [b] | F2_68 [b] |
| E | F2_5 [b] | F2_13 [b] | F2_21 [b] | F2_29 [b] | F2_37 | F2_45 [a,c] | F2_53 [b] | F2_61 [b] | F2_69 [a,c] |
| F | F2_6 [b] | F2_14 | F2_22 [b] | F2_30 | F2_38 [a,c] | F2_46 [b] | F2_54 [b] | F2_62 | F2_70 [b] |
| G | F2_7 * | F2_15 [b] | F2_23 [b] | F2_31 [b] | F2_39 [a,c] | F2_47 [b] | F2_55 [b] | F2_63 [b] | F2_71 [b] |
| H | F2_8 [b] | F2_16 * | F2_24 * | F2_32 [b] | F2_40 [b] | F2_48 [b] | F2_56 * | F2_64 [b] | F2_72 [a,c] |

Genotyping of Nic2 locus using gene-specific primers for ERF 189 as in Table 5.

|   | 1 | 2 | 3 | 4 | 5 | 6 | 7 | 8 | 9 |
|---|---|---|---|---|---|---|---|---|---|
| A | F2_1 | F2_9 [a,c] | F2_17 [a,c] | F2_25 | F2_33 [a,c] | F2_41 [a,c] | F2_49 [a,c] | F2_57 | F2_65 |
| B | F2_2 | F2_10 | F2_18 | F2_26 | F2_34 | F2_42 | F2_50 | F2_58 | F2_66 |
| C | F2_3 | F2_11 [a,c] | F2_19 [a,c] | F2_27 | F2_35 | F2_43 [a,c] | F2_51 | F2_59 | F2_67 |
| D | F2_4 | F2_12 [a,c] | F2_20 | F2_28 | F2_36 | F2_44 | F2_52 [a,c] | F2_60 | F2_68 |
| E | F2_5 [a,c] | F2_13 | F2_21 [a,c] | F2_29 [a,c] | F2_37 [a] | F2_45 [a,c] | F2_53 | F2_61 | F2_69 |
| F | F2_6 | F2_14 [a,c] | F2_22 [a,c] | F2_30 | F2_38 | F2_46 [a,c] | F2_54 | F2_62 | F2_70 |
| G | F2_7 | F2_15 | F2_23 | F2_31 | F2_39 [a,c] | F2_47 | F2_55 | F2_63 | F2_71 |
| H | F2_8 | F2_16 | F2_24 [a] | F2_32 | F2_40 [a] | F2_48 [a,c] | F2_56 | F2_64 | F2_72 [a] |

KASP genotyping of Nic2 using SNP marker SEQ ID No. 137

|   | 1 | 2 | 3 | 4 | 5 | 6 | 7 | 8 | 9 |
|---|---|---|---|---|---|---|---|---|---|
| A | F2_1 * | F2_9 [a,c] | F2_17 [a,c] | F2_25 | F2_33 [b] | F2_41 [a,c] | F2_49 [a,c] | F2_57 [b] | F2_65 |
| B | F2_2 [b] | F2_10 [b] | F2_18 [b] | F2_26 [b] | F2_34 [a,c] | F2_42 [b] | F2_50 [b] | F2_58 [b] | F2_66 [b] |
| C | F2_3 [b] | F2_11 [a,c] | F2_19 [a,c] | F2_27 | F2_35 | F2_43 [a,c] | F2_51 [b] | F2_59 [b] | F2_67 [b] |
| D | F2_4 | F2_12 [a,c] | F2_20 [b] | F2_28 | F2_36 [b] | F2_44 [b] | F2_52 [a,c] | F2_60 | F2_68 [b] |
| E | F2_5 [a,c] | F2_13 [b] | F2_21 [a,c] | F2_29 [a,c] | F2_37 [b] | F2_45 [a,c] | F2_53 [b] | F2_61 | F2_69 |

TABLE 18-continued

A comparison of gene-specific primers and flanking SNP markers for genotyping the $F_2$ population of Example 11 (segregating for nic1 and nic2 ((LA Burley 21 × TN 90 LC) (X)), F2_1 to F2_72 plants refer to plant No. 1 to 72 of Table 12).

| F | F2_6 * | F2_14 $a, c$ | F2_22 $a, c$ | F2_30 $b$ | F2_38 | F2_46 $a, c$ | F2_54 $b$ | F2_62 $b$ | F2_70 |
| G | F2_7 | F2_15 $b$ | F2_23 $b$ | F2_31 | F2_39 $a, c$ | F2_47 $b$ | F2_55 $b$ | F2_63 | F2_71 $b$ |
| H | F2_8 $b$ | F2_16 $b$ | F2_24 * | F2_32 $b$ | F2_40 $b$ | F2_48 $a, c$ | F2_56 * | F2_64 $b$ | F2_72 * |

* genotype not resolved;
$a$ homozygous for either nic1 or nic2;
$b$ heterozygous for either nic1 or nic2.
$c$ shows plants where genotyping results match between gene-specific primers and flanking SNPs.

SEQUENCE LISTING (164 sequences)

SEQ ID NO: 1 - DNA, 544860 bp, Nicotiana tabacum
  modified_base (508)..(665): a, c, t, g, unknown or other
  modified_base (774)..(1022): a, c, t, g, unknown or other
  modified_base (1504)..(1710): a, c, t, g, unknown or other
  modified_base (2323)..(2605): a, c, t, g, unknown or other
  modified_base (2788)..(3952): a, c, t, g, unknown or other
  modified_base (4449)..(4733): a, c, t, g, unknown or other
  modified_base (6404)..(6636): a, c, t, g, unknown or other
  modified_base (6765)..(7184): a, c, t, g, unknown or other
  modified_base (7413)..(7736): a, c, t, g, unknown or other
  modified_base (8050)..(11807): a, c, t, g, unknown or other
  modified_base (14157)..(15925): a, c, t, g, unknown or other
  modified_base (16020)..(16319): a, c, t, g, unknown or other
  modified_base (19590)..(20795): a, c, t, g, unknown or other
  modified_base (68611)..(68644): a, c, t, g, unknown or other
  modified_base (88771)..(89748): a, c, t, g, unknown or other
  modified_base (94428)..(95530): a, c, t, g, unknown or other
  modified_base (96949)..(97002): a, c, t, g, unknown or other
  modified_base (97945)..(98909): a, c, t, g, unknown or other
  modified_base (101464)..(102314): a, c, t, g, unknown or other
  modified_base (103393)..(103743): a, c, t, g, unknown or other
  modified_base (105387)..(106289): a, c, t, g, unknown or other
  modified_base (108528)..(108951): a, c, t, g, unknown or other
  modified_base (109543)..(109603): a, c, t, g, unknown or other
  modified_base (110901)..(111323): a, c, t, g, unknown or other
  modified_base (112813)..(113267): a, c, t, g, unknown or other
  modified_base (115857)..(115922): a, c, t, g, unknown or other
  modified_base (116209)..(116310): a, c, t, g, unknown or other
  modified_base (117427)..(117479): a, c, t, g, unknown or other
  modified_base (119018)..(119094): a, c, t, g, unknown or other
  modified_base (120014)..(120128): a, c, t, g, unknown or other
  modified_base (121693)..(122657): a, c, t, g, unknown or other
  modified_base (132002)..(132825): a, c, t, g, unknown or other
  modified_base (133595)..(133774): a, c, t, g, unknown or other
  modified_base (137845)..(138347): a, c, t, g, unknown or other
  modified_base (139038)..(139117): a, c, t, g, unknown or other
  modified_base (149767)..(149850): a, c, t, g, unknown or other
  modified_base (151818)..(152000): a, c, t, g, unknown or other
  modified_base (154629)..(154687): a, c, t, g, unknown or other
  modified_base (164010)..(164826): a, c, t, g, unknown or other
  modified_base (165105)..(165134): a, c, t, g, unknown or other
  modified_base (165669)..(166416): a, c, t, g, unknown or other
  modified_base (169484)..(170438): a, c, t, g, unknown or other
  modified_base (182347)..(183449): a, c, t, g, unknown or other
  modified_base (193814)..(194946): a, c, t, g, unknown or other
  modified_base (197432)..(197915): a, c, t, g, unknown or other
  modified_base (198748)..(198845): a, c, t, g, unknown or other
  modified_base (199018)..(199233): a, c, t, g, unknown or other
  modified_base (201794)..(203047): a, c, t, g, unknown or other
  modified_base (204610)..(204717): a, c, t, g, unknown or other
  modified_base (205585)..(205642): a, c, t, g, unknown or other
  modified_base (211349)..(212585): a, c, t, g, unknown or other
  modified_base (216854)..(217196): a, c, t, g, unknown or other
  modified_base (218376)..(218438): a, c, t, g, unknown or other
  modified_base (219439)..(219576): a, c, t, g, unknown or other
  modified_base (220972)..(221047): a, c, t, g, unknown or other
  modified_base (222205)..(223290): a, c, t, g, unknown or other
  modified_base (228932)..(229903): a, c, t, g, unknown or other
  modified_base (230004)..(232230): a, c, t, g, unknown or other
  modified_base (234518)..(237200): a, c, t, g, unknown or other
  modified_base (238461)..(238515): a, c, t, g, unknown or other
  modified_base (238748)..(239016): a, c, t, g, unknown or other
  modified_base (239161)..(239550): a, c, t, g, unknown or other
  modified_base (239647)..(241873): a, c, t, g, unknown or other
  modified_base (241994)..(241994): a, c, t, g, unknown or other
  modified_base (242098)..(242427): a, c, t, g, unknown or other
  modified_base (243115)..(243587): a, c, t, g, unknown or other
  modified_base (243791)..(243931): a, c, t, g, unknown or other
  modified_base (244196)..(244386): a, c, t, g, unknown or other
  modified_base (244734)..(244734): a, c, t, g, unknown or other
  modified_base (245291)..(246331): a, c, t, g, unknown or other
  modified_base (261356)..(261470): a, c, t, g, unknown or other
  modified_base (261805)..(261881): a, c, t, g, unknown or other
  modified_base (262761)..(262827): a, c, t, g, unknown or other
  modified_base (274208)..(275208): a, c, t, g, unknown or other
  modified_base (276915)..(277615): a, c, t, g, unknown or other
  modified_base (279243)..(279618): a, c, t, g, unknown or other
  modified_base (280628)..(281578): a, c, t, g, unknown or other
  modified_base (287404)..(288600): a, c, t, g, unknown or other
  modified_base (290909)..(292327): a, c, t, g, unknown or other
  modified_base (294402)..(295585): a, c, t, g, unknown or other
  modified_base (298514)..(298581): a, c, t, g, unknown or other
  modified_base (299346)..(299610): a, c, t, g, unknown or other
  modified_base (301550)..(302780): a, c, t, g, unknown or other
  modified_base (308417)..(309059): a, c, t, g, unknown or other
  modified_base (310980)..(311332): a, c, t, g, unknown or other
  modified_base (312445)..(312598): a, c, t, g, unknown or other
  modified_base (314180)..(315423): a, c, t, g, unknown or other
  modified_base (321543)..(322781): a, c, t, g, unknown or other
  modified_base (327748)..(328908): a, c, t, g, unknown or other
  modified_base (333707)..(334801): a, c, t, g, unknown or other
  modified_base (338255)..(339081): a, c, t, g, unknown or other
  modified_base (339984)..(341017): a, c, t, g, unknown or other
  modified_base (344149)..(344523): a, c, t, g, unknown or other
  modified_base (344734)..(344873): a, c, t, g, unknown or other
  modified_base (346593)..(347724): a, c, t, g, unknown or other
  modified_base (355561)..(356719): a, c, t, g, unknown or other
  modified_base (358194)..(358614): a, c, t, g, unknown or other
  modified_base (366613)..(367695): a, c, t, g, unknown or other
  modified_base (371793)..(372851): a, c, t, g, unknown or other
  modified_base (377135)..(377651): a, c, t, g, unknown or other
  modified_base (377862)..(378553): a, c, t, g, unknown or other
  modified_base (381600)..(382511): a, c, t, g, unknown or other
  modified_base (384042)..(384393): a, c, t, g, unknown or other
  modified_base (395768)..(396876): a, c, t, g, unknown or other
  modified_base (399586)..(400615): a, c, t, g, unknown or other
  modified_base (401567)..(402709): a, c, t, g, unknown or other
  modified_base (405116)..(406246): a, c, t, g, unknown or other
  modified_base (409149)..(409797): a, c, t, g, unknown or other
  modified_base (411401)..(411589): a, c, t, g, unknown or other
  modified_base (412051)..(412160): a, c, t, g, unknown or other
  modified_base (414073)..(414312): a, c, t, g, unknown or other
  modified_base (414797)..(414885): a, c, t, g, unknown or other
  modified_base (415068)..(415289): a, c, t, g, unknown or other
  modified_base (418244)..(418467): a, c, t, g, unknown or other
  modified_base (418650)..(418723): a, c, t, g, unknown or other
  modified_base (418937)..(419148): a, c, t, g, unknown or other
  modified_base (419495)..(419668): a, c, t, g, unknown or other
  modified_base (420008)..(421110): a, c, t, g, unknown or other
  modified_base (432509)..(432891): a, c, t, g, unknown or other
  modified_base (432993)..(433066): a, c, t, g, unknown or other
  modified_base (436502)..(436952): a, c, t, g, unknown or other
  modified_base (437206)..(437580): a, c, t, g, unknown or other
  modified_base (440701)..(441893): a, c, t, g, unknown or other
  modified_base (443655)..(444784): a, c, t, g, unknown or other
  modified_base (457155)..(458243): a, c, t, g, unknown or other
  modified_base (460874)..(462043): a, c, t, g, unknown or other
  modified_base (464829)..(465614): a, c, t, g, unknown or other
  modified_base (483881)..(484645): a, c, t, g, unknown or other
  modified_base (486091)..(486184): a, c, t, g, unknown or other
  modified_base (488257)..(488334): a, c, t, g, unknown or other
  modified_base (488661)..(489517): a, c, t, g, unknown or other
  modified_base (494395)..(494941): a, c, t, g, unknown or other
  modified_base (495363)..(495432): a, c, t, g, unknown or other
  modified_base (496364)..(496399): a, c, t, g, unknown or other
  modified_base (500803)..(500897): a, c, t, g, unknown or other
  modified_base (503744)..(503859): a, c, t, g, unknown or other
  modified_base (505824)..(506859): a, c, t, g, unknown or other
  modified_base (509081)..(510327): a, c, t, g, unknown or other
  modified_base (514371)..(515119): a, c, t, g, unknown or other
  modified_base (517650)..(518789): a, c, t, g, unknown or other
  modified_base (522430)..(522898): a, c, t, g, unknown or other
  modified_base (523198)..(523265): a, c, t, g, unknown or other
  modified_base (525100)..(525164): a, c, t, g, unknown or other
  modified_base (525344)..(525422): a, c, t, g, unknown or other
  modified_base (525886)..(525952): a, c, t, g, unknown or other
  modified_base (527049)..(528417): a, c, t, g, unknown or other
  modified_base (531439)..(532580): a, c, t, g, unknown or other
  modified_base (540671)..(541760): a, c, t, g, unknown or other
  See specification as filed for detailed description of substitutions and preferred embodiments
ttgggtctgtctagggctagcaacctgaaatgaaaaagaccatcttgatgcatcctatgtgctacatgttgcattccttcaagggtaaaagtgtcatttggcggaccaatgataattgagagtgaatgaaaaggaaaaaaaaagagggtgaagtgcgaagataaagcaaatagggcccggttatgttttgttacatttttatttaaaaaaaacaaatttaaaaaaaaatgaaaattttttaaaaaaaaattctttgcactttttatcatttttgaaaaatcaaaaataaaaaaaagggaaaagaaaatccaaaagattttacatgtttcatcaccttttaagaaaaagcaaaagaaaaaaaagatatgttttctctgaattagttatttttttaatttctcacccgtatccaatcggcccgaactacgtgggtttgattctcaccggatgtgagatacgtaggcaaccctcatcgggtccaaccccaccttttgctaaaatagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccaaaaaaaataaaatatgtcaaattttaattttgtcataaagaagtcgggtgacgctgttttatcaagacatagccgaatgttcccgaaggggacgccggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgaagcgttgaaaggtcgtgtttgcaacaccaggtttttattgtaatttgaaaaaaaaacaaaaaaaaaacaaagagtgagcggtcaggtatttttagtcaaaaataagccaagccagcttcgaccgcgtcttaaaccgttcttgccgaaatagccttagagtatctttcagtcgttgaaaggctattttcgtaaaagaatgagaagtttgtaaagtgtcataaaataatcctccccggcctcaaaattcatatgaaattgggaaggggccacatttgagaaataaccgtttggttgtctttgccaaacgggaaaagaagctggtcgtttgtttttggagtttgtaaatcttttaattagaatatgtgggttgtttgatttttgagtttgtaggtcatcttcaaacctttgaaacccagttttgtttaatatgaaaattgaaaaaaaatgattagtattgtttatcttttattggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacaaaaaaaatatgaaaaaatttttgaagaaaaaaatcaaaaaaaaaatcaaaaaaaaaatcgaaaaaagaagaaaaatgaaaaaaaagggaagagtgttgttaataatgaggaccgactgagtccattctaacctgttttgctttgaatcacaaagaaagttaggtggttggtttgtggtaagccggaaatacaagacccagaagcacactttgcggggatcaggccttataacagaagcactcgaatcctattgggacttgttgactaaggttgatgatatcgaagttggaaatggtctggacaatactgatgcaaaactcagtggctaaagatgtcaattttgataaagtgggaggacactccgttccttggttagcaaaagagaagctggtggtggcttattttgttgtcatttctgttgtccggattattcttcgggttgtaatccgaatatggtcttgtgtcaaaccttcttatctttccattttgtcatatcagtttgtttaagttttgtctaggctattttaggattttattctggtttgttttgtttgttttattattcaaaccatttcgccggtagtctaaaacaaaagccggtctttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttaatcataaaaccctgggaagatgatcaaagcatttaaaggaaataagaacggtttgagattgtttgaagcccgagtcatgtgaaaccggggcaagtaaaacataaagaaaaccgttaaatgcaagattcgccaaattagcatgagggtcgttcatgagagtgagagtgtcgcccagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggaatcaatagcaacgactaggaaatacgagcctggaaggtaaagaaaaaaaaatcaaaaaaaaaattgataacaaaaaaaaaacaaaggaaagtcaaatgaaaacagaggaattgggaactacgtttgacctgattcctcaaagaggatacgtaggcttttcacggctcggtcatagttttgaaaaatgaaaaatcaattaaaatatccctaagcaagaaactgggacaaaggttgcaaataaatctagtttccgaaagttgtaattttgaacccagaatttattttgtatttttgagccttttataccctttctttctagccctatccaaaaacctacattacggtccaaagaaagaccttctgatcagttttcaaaagatgctaagttagacaaacgagagtcttaccggcgaacataacattctgttccacagcagaaaggactctaatctccagcagagagggtcataccggcaacactccaaatccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacagcagaggataggccacatgtgcatgtcatgaccattagagtcggtatctgcgtttgataggtttttatttaaagtttcttttgttaaagagtcatcgttttcctttgtcttttattctgttccttttatctttttcctttcatagaaaaattccccagtagagcctgtttggtcaaaaccagtgggaaatgacttcaaaatgggccatcaactctccaatcatgcaagatgagatctgactagtacatccaagtggtatagtcagcaaggaacaagcgcgaggccagtgtcaaaaaaaaaatatccccagcaaaagggagttgacaaaaggattgacgagtgtcaagaaggatatcccagccgaaatcaaaggttgttaaacctcaagaccaaggcctgtggacaaagcaaggagagcagtgagcatgatttgggaaattcatacgatactaaaagatcggtgaagtgcaagtttccaggctatgtaacaaaagaaagggattatccccagcaaataatatcatccccaacaagttgtggaacaaagagcaaggaaggagaaagggaaaaccagcccaacaggagtatcacaaccaaccaccgcgttttgaactaacaaattttgtttgatttgaaacaggtaaaggaaatggcattgatgacaaaaatgcatgccacaagggatgttgtcaaactggggcagaaaattttcttttcatttagaaaattttctggaagtcaggtacccattcggggaagaataaagataatgccagtctcaagggaagtggtcttagaaccagtgttgcccccaacataataagtttcaatggaggaagttgttccccagcaaagggatgaaacttgagctcagaaaaagcaagaggccagcatcattcccaacagcctttcgaagagtgaagcactagttctgaaggaatcaaaatcccccagcggtgttatcctcgacagtgttatccccagctgataatattttaccccccaacaggtaagtaaataattccccaacagtgttatccccagcagtttcgaggagtccaacacaagtttgatgaaagtcggtatcctcagcggttcctttcggggaaagacaaaacgagtcttaagggaggtagtcttcgaaggaagaagctatgcaaaaaaaaaaagagaataaaaaaaaaagtttcgggcaacctagagtgggtaagtaaaaaaagggggaaaagtcatccccatcaaaataatccccagcagtttcgagggaagacaacacatgtaagtaaataattccccaacagtgttatccccagcagtttcgagggaagacaacacatgtaagtaaataattcaggaagaaggaaatggttcacgcataggaaatgcatttcctcctaagtttattttttttacccataggagatgcatttcctcctaaagtttagttttacccataggagatgcatttcctcctaagtttatttttacgcataggaaatgcatttcctcctaagtttagcttcattcataggagatgcatttcctcctaagtttaatttcacccataggagaggcatttcctcctaagtttgtttttacccataggagatgcatttcctcctaagtttagttttacccataggagatgcatttcctcctaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcctaagtttaattttacctctaggagatgcacttcctcctaagtttgtttttacccataggagaggcatttcctcctaagtttgtttttacccataggagatgcatttcctcctaagtttagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctataggagagacatttcctcctaagtttgtttttacccataggagatttcctcttaagtttgtttcacccattggagaggcatttcctcctaagtttagtttcatttataggagatgcatttcctcctaagtttagttttacccataggagaggcatttcctcctaagttgttgttgaaatcaggagtccgcctggagaatagagacattcaattttcaatttagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaataacagaatggcgatttattggttgaagttgggagcccgcccgtataacagaggaatacattcagcattaattttcaagtattgaagttgggagcccacccatataatagaggaatacatttcagtctttaattttcaaacattgaagttgggagcccgcccagataacagaggcatacatttcagtctttatatttcaagcattgaagttggaaacccgcccagataacagaggcatacatttcagtctttacatttcaagcattgaagttgggagcccgcccatagaacagaggcatacatttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtcgacccagtccagtaccaataacccaactccccctcttcatttttcatttttatttttaaaaaacaaaaacaaaaaaacaaaaaaatgaagaaaaccctaaaaaactaagaaaccatccccccctatttttgcttcttcttctccaaaataccaaacaccccaagcatccatggcagcccttctgcctccccatcgacaacacacacacacacatcaaacacacacaagctccaccaccctcgcatccaaatagaccccgtcgcgtttgccttcatcgtcttcgtcgagctcaagcttgagctcgacatccatggtcgcctctgctgcttcgtcgtctttcttcggcaccaacaaaaacgtcaagctgcgtcagcttcaaaggactgcttaaaatagtccatcgccgagttcatatgctgtcatggctgatgcctcgccgtgcctcggctccttcatcgtcttctgcttcacctcctatgctgccgcgtccagcttcgacgagcagccatggctgctccaaacggatgttgctgctactgttttagtcttcttcctcatcgacgaccttagttgttgaacacagcagcatgtcgatgaccatagttgcttcagctgcgtcgaccactgccttcctgcgaccactcgtttccatggctgaaaacaggagaacaccctcgccatggccggtcgctactgctgctcacgcagctgctacagcgtcagccttctgctccgcctcccagctgcttttgttttgttccctgctgccagcacccttaagttggcgttgcttcagtttgcttcttagattcgttcgtcgtcgtttggtcgagcttttgtcgaggtttgtcgaaatagtccgtacatattcgtttcaatccggtgagtatattttgagttttattttgtccgtatttttgttttgacattttcgaatctaaaatcggcaaatgtttgttttgttcaagtccatcgtttgaattatatttttagtttgttcatgtgctttgttaaattaatttttcagatttcaaatgaaagattaattaattgtttttcatgttatttcatgtttgtaggtaatttgttagtttaatgtttgatagattcaaattgaaatttaattaattatttcttcaatttgtttcatgttatatattttccagaaattattaatgttgtttgagtcatttaatccgtcatgtttgttgttttaaaaaaatggattcattcgtgttcatactttgtttggttgatctagaatccgaaatttgtatagtttgatttcttgtttatcatttatgattatttcttgaatttgtctcataatcttgtttaagtttaatataggaattgttggttgtaatgttgttagagttgattttaagttcaatattattgaattaagaaatctaaatatacttgtttgttgttattattgttgaatctgaaaataggttgtttgttgctaaaaaaaaatattgttcaatcaaattttagttgttctttgttgttcaatttgtgttcatgtgatttgttgttgaaatgttgaagaaatcatgttcatgtgatttgttgtttaaatttctgtagaaattggtcatattggctatattttggttgagtgtgattaattgatttgttatagctgatgggttagtttggtaatttgcagtacgttcaggggtagtttggtaatttcagtaaggtcggaggggtagtttaggaattgtacattttgtaattttttatgtgaagcatggggacaaaatgtaatggggtgggttgtgatatagttgtttaatataaaggggggacaagacaaaatttagtggggaggaatcttgtatttgtttagtgaagcatgggggacaaaatataatggggtggtgtgatatatttatttaatgtaatggggatgagtgggaagataatgggtttggtaggaaaagggattgattttaattgattaaagggttgagattatatataggaagtcttgaacacacagaagaacaagaaaaaagaacgaatctgaaaaagaaagagaaaagaaagagagaaaaaaaaggctgaatatttaagagagagaaaaattccgaaaaatattcaaactttcaaataaaaaaaaagaaaaaaaatctttggctttctttcattgtttgaaatcagcattaattgtagttgtttcgtaaaagttggaagcatttgttttgggattactactccaccggtctgttactgggttgttattgttgctgggctgttgttgttgtgttgtactgttattactgctgctgattctcatcttcattttcttttgcttccaatatcaggtacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataaaaataaaataaataatgataaaagcggtaaaaagataaaacttgcacataagttcatatttgtataaaaatcagataatcaagccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtcctttaattggaaaaaactcccttgtaccctcgcggggcggaaaaatgaggtgtgacaaaccctataggcacgatctctattattaaagccattttagatcctataggcatggtttctaattgtgtgggagtaaagcaaacataacaaatacatttgaatccacatggaccctatgggcatgatatctacccaatttgcccaatatacataactaccctccctttttcacttatcaccccactgtttatttacaaataattagtacaggccaatgaattgaatagaaattacatataaaagaaattaatctatagggagcctgaagtaggcccaagtgatttccaagcctccagtagtctcaaatacccaaagttacatagccaaattcatgtctaggtgtatcagagttccctaaggacctcaatgatcccgagcaatactcacacctagacctttttcaaaaataattggtttaggtgcagtgtggaaatgccagctctgacatgccagagttcagagagatctcaagggtctcaaggcagtacacatatcagaggggcaggacatagtattctaatagtaaatggaagtgcatagtggtttgaaagagtttaatagaaaggttttaggactgaaaagaacttctgaaaaccattggtgataaaatagtttgagggaaagtataaagaagcaattttgtaatcagaaaacaagacaaagatcaaacaagctttaggaagcaactttggcaagcagctttcacacaaagggaagagggattgggaagatagagagtacaccttaatgaaccatacaaacaataggatatagagagttttgagggggctctacagatgtagcaaagatcacatcagaaacatgctaaagacatctaaaccacacaactagaaccactttaaggagactgactggcttagtaggagtgaaacagaacatgcaaggacttaaatggacatactaggtaagtgctaacaagtgtaggcatgctagttacatagaagcagagtctaaaaagaaacagtagctagttaaacacgcttaagttgtatatgtagacatgttaaacaagatagcaaacatgcaagtaaagtggaagtacactaatcacaatttgaataggcagtattagacatgcttgaacaagcagtaaacagaaacaagaatggacattaggccacttgaactaaagcagtaagtaaagacataggttttgatttaaaaattaatcagaagcatacctaattaaagaatgaaaaacacaagatgtgagaaaggcagtgtgcaacttccagcctgggcttgcagccggctagaatggcaaatatcacaagtagcaaagagagcagaaatagagcctttttgagtgaaaaagtagtagttttgaactattgttcgttctccagaagttaaaataagagggagtttatatagtaatcaaaagctttaaaaaataaggcaagggatcaattaagttgcaatcatgaaattcatggaatcaatcacacatgtaaatcagtaagtcttttctttaatcacgggataaccaattaacgataaaagcctgatagatatttaaggaaaagaatcaagtaaagtttggggtatagagtaggtaattaaaggtaaatgaacagaattttctattaagggaacaatcgataagaatcgacaaataacaaaaaaggcaagggaaaactaattaaggcaagaaattcaatcaaactgagtagagaggtaagaatcaaaagttttgttaagaaaaagagttcaaatcaacccaggaaataagaacttcagaacagtcaagggtgaaatcaaagagaaaatcacgtaaagatcagcaagttttgctgacaacttaaataaagcaagaaataatagttagaataaatataggcatatagaatcaatggaaaagttgaaccaagtactcagtagaggcatattagggtaagtaaaccacgagacatctatatggctaaagaacaattacaggaaccaaggcaagaatacaattagtacacgagtactcagaaaccaaacaaagaatgtcaaaaaattaaggcttttagaataaacgagttgaaattagagaaacctaatgaaatcggttaaacatacatgaaacagaagattaaacacccaaatcatcaaatgttttttggaaaaagagatttctggaaaccctagtttagagaaagatgaaaaatcattcgaaaatcagacgatccttgtaaataatcaaaggttattgtaaaaatcatatgaaataggtccaaacatctcagatcagtatagatctaagaagttcagaagaaagaaaatatggtttcgagaagaacaatcacagagatgaagaatcaaaccaagaaacccatagatataggaatatctcacttggaatcaaactaggacatgctgaaataggcgagaaatggccatagatgcaatcaaactaaccctgatcccttaagaaccctgaagatggtgataccagtacaagagaggatactagaggcctcggggtggtgaggaacaacatggaaggtagcaaacgactggtgatgtaggtagattagggttagctttaagagcatttgagagagaagagggatttccgggcggcggacggtggcaaaatgaaaggattttggggggtcgtttggtttattttaggtaagggtcaatctggaccattgatcacaatgatcaacgaccaggatttgcccgggttattgggttggggcagatgggtattaggctgcgtatattttggatttaaaattgggcttgggtagtgggttgaattaggaccaaaattgaaataaaaataggacagattttaaatagccacttttaataactaaataaattataaaaataataagtgagttccaaaaatatttttttgtatactaaaatgattaaaaatagttatttaatattttaaaaatataaaagactattttatgcataaataatgtaattatacattagtaagggatattattgcaaagatgtgcaatttagcttaaaaatgtaaatataattacgaaaaatgcacaaaaaataattaaacactatgttggaataaataataaatttaaatggataaatcaccacaaaagtaatttgaaggataattattggattatataaataaaagagaagaaataaattgatttggagcttttaaaattatagaaaaattataaaaatacttatgcatgcttataactgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtactattttgaaagtatatatatatatatatatatatatatatatatatataatatgtgaaacaaaattgggtatcaacaataagactcctcatagcctttgttgcttacatggaatttactcttaccagatggacataaagagtgccttcctcaatggctatttaaaagaagaagtgtttgtcaagcaatctccagggtttgaaagcaagtagtgtccgaattatgtgtacaaacttgataaagcactctatgggctcaagcaggctcctagagcatggtatgaaagattatcaaaattcctgcttgagcatgactacaagagaggtaaaattgataacactttattcttgaaggaaaaaagtaaagaccttctagtagtacaaatatatgttgatgatattatctttggagcaactactgataaattaagtaaggaatttgctaaatcgaaatgagtatgatgggtgagcttaatttctttttaggcttataaattaaacaaaattcagatagaactacgatccatcagtagaaatatgtgaaagagttgcataaaaggtttaaaatggaagaataaaaagaaatcgatacttctatagcaacaaccataaaattggatatagatgaaccaggttcatctattgaatagaagttgtattgggaaatgattggttctctttttgtatcttactgctagcaaacatggcattgtttgcagtgtaggtctttgtgctcgatttcaggtaaattcaatggagtcccacttgcctaatgtcaagagaatattgagacacttgaaaggcaccactaacctttgcctttagtatccaaaaggtaataattttaacctagtgggatatgctgatgctaattatgcaggttttcttgtggataggaagagcacctcaggtatgacacactttcttgatttatgtcttgtgtcatgggatattaaaaagcaaagttcagtagccttatctactgctgaagctgagtatgttgctgctgcttcatgttgtgctcaattgttgtggatcaaacaacaattaatggactttggaatctatgttagttgtatccccattttttgtaataacactagtgcaataagtatgacaaagaagtcaattcatcataagaggactaagcacatagatgttagtcatccttttttgagggataactatgagaaaggcttgattactatacaattttgtgctactaacaagcaaattgctgacatcttcacaaatgccttaagtagagatgattaaaatcacctaaagggccagttcaaggttaaacaaaaaaaaacaaaaaaaaacaacaaaattttggttagaaagtctgtacattgtacataagtagattaaatcttgatcagtctcatacattcaatagtatatcttgttccatgtgttaaaataactcattaatctctaatgttattttctttattttacaaatttagatttacacaagaaaattattagagaagaacctggtttatcaagataacacggtatgctttctacactctgcatattttgaaataataatatttgaatcatgagcaaagtcctacctaagctaaatttcctttgaacttatccaataagtgaaccagttcagtgcatagattcccacccaaattaagtcacctagattctaaggaatactccatcgtctagtcaaaaactgaaatttcagtttcattagacttctaagagtctgaaaaagcctattgttacccattaattactctctttaaattgatcatcatcatccctgccttcactccctaattttcaaaccgtcaaaaccttctccatcttctctcattctccaaaattcaatctatctttcttcattcttccaaatccaagatactaacccctctgataatcatggtactcccccaccaaactcttcatcttcaaccactccttagcctaagaaatggagagttaagatgcttgctcacaagaacattgctgggaaggaattatcaaagaaattgaatgcacaattaaaatctagccaagcccaggaaccctagaaatttgacaactccttcaagtcagctactgagggggaagaaacggggtcttctaatactgaacaggtaacttctggaataaatactatgaatgaggttatttctgtgttagttgaaaatttggagaataggtttgttttagttggatctgttgtggatgtagaaactccaaagtctagaaagagaggtgctaaaaatagaaaggaaaaagactaggagagtgagggtattcgaagtgaagaaatgggaatggtaacaaaagtggttgactcttcacccacttctgatgaaggaagaatgactaattgtggagcagaatcagataatttagaggaaaacgtcaagaaaatagggggaggtgggtctagcgaagccgttgaagggctggctaaaattgggtaaaatatagataaacctggttcaacagttgatgaaaccctcacagacctattaaagaaggtgagtgatagctacaacccaaagaattagagaacttcactggctaagacccgtggcactgctagggctaacaagaaaaggaaggttgtccccctctgacactgttgaagttcctccaatggcaagagccacaagaagtcaattaaagcagaatgaggaagatctacagagagccttagaataaagcaaaaagaaaaggatggataaagggtagaagaagataggaaagtctgttgagactattgatgtggatgagatggatctggtccatcaagatgaagatgtgactgctgaactggaggttcagactcctaagcccaagaaatccaagactttctccaagaagtctacttctatgtcaaagtctgctgaactatccaccctggcaaaaaggaccaggtccacagtgaaaaccatacaagcaaaagttactgaaggagaggcgtggagtagtgaagaggaagatgaatcagacagtgaaaaggacaagatggctaagtttggcaaaagaactattctgaagggtagattcctcaaggatttggaggaggaagggatagtattgctgttggaaaaattagaagtacaaggctggaaggacatggtcctttagatggatggcaagttggctagggatgaaatagttgaatttatggcaaatgctgcagtgctagatggaagggatactagcttagtgaaaggggtgcaaatctcttttgatatgaaggagttgggtggaattctaggtgtacatgatgaagggtacaataattacaaaaagcttaagtggcaaagcctagaaaattttcctactgcccttgccatcaccagaaaattcagtgatcatgagaaggaaagtgtgcccaagactgtgtacaagagtgaaatgaagtcaccccacaaggttttgtttgaatttgtcatcaaatatgttctgcctaggtatgagaggaggcacactgcaaacttcatggacttggttctaatggagtgtctagattgtgggaagtagataaattggcctggatttataatccagtttcttgatagggttatcaatggtaccaagtctcattctattccctatggtttcattcttacaactgtgctttcttgttttaaggtgcctttgaataagtgtgaggtggctacaagcaaagatcactttggggcgaaaactttgattgcttgtgactatgaggtccatgccactcctaatgaacctggttcacatccaagaagataccagtaaatagctcttggtataggaaagtgaggcaaaggaagctaagatagcaaggatgaagacacggttggctgaggtagaatctgagagagatgctctcagaacaaaacttgcaagacaaaaggagaagaatgatggaatttttcaagacatgctgaaacttctccaagaaaataacccagcacctcgttcttccaagcctaaagttcctagcctagtgtagttccttcagtgacccagcttgggatgtttcttttgttgatgtttgctcatgttttcaatatttttatttccttttatgtattgtggaagaatcatatcaactatcaatgaaatcaatgaaatctactggtttttgttctaactgtttgtttttatttctttgatggttgaaattcttagcttaatcaatgatgattaatccatgattgcatttgggatagcccgagtgtacatgagtaagttttacaatccgggtattgcacatttttatgcactttttctatgatgccaaaagggggaaaataagttgtgctttaaacaagcgatatttagctttgaacatgtgatatttataaccttatgaacctggtccttgatgataagtgataacaaggaaaaatatttctaacattttgttgatattaagctgagtttaaacagggcctaagcttatgaaaagcacatagtttgtcatcatcaaaaaggaaaaatttattggcccaagtgaaggtttgttttgaagactgacaaaggaactcaggcatgagccaggtctatcctttgtgaacacgggcagagttgtgcatgtgggatgcacgtgatggagataaacttaacttggcacaattgatatctcctgatcggaaaggttgtataattgattaggagaaggacttcttactcaaagagaacattatccaagatagggaaggagtcagaagttgggatcaactagaacttttccactaaggaagagtagtattagaactctagttatttgttcatatactaactctatatattgtaggatgttctcatttacaggtaatgtacaaatgcagaagttaaacaagaattgagagcaaaatagcaaggcattttgcaagcagtttgtgtgtgattcaagtgtgcaaatatgaatctacatgaaccagatagaagaaccagttccaagtgtctctcttttattctagttcaattatagtaggtgttttcatattgtacctttcagctttatgtagaggcaattgtaatatatactcaaaatattcaatttagagttaacttgaagttgccacaataattagaggttgtgtgctacaacgtgattagagttagtcctaggtttacaaatatttttttgtaaatgcagtttttggttcagtgattttagtggagagtttggaaaaatcctactggaaagtaggtcgtggttttttcaccctttgagccaaatattttcacgtaaaatacttgtgttttttacttttcgcatttactatttctgcaatagtaggttaaggatcacttagaagaatcacgttcttccataatcagtttaagtaaaaaattggacaccacacaaattatcctttgtgtggtattgaagttgaaacatcaatgttatgcgtatgatcttcccacaaagtttaacaaggatctgttcaaaaaattaccctgatttagacccgtggagttctatctccttgttttgtatgacttttcttgtgggaaggtggatggtgttgcgtgtggcagtgttggtggggagagataaggagaaagtagatggtggtgaaaggtgttccatgtctgcaatgtgtgcatatctaatagtaatatacgttaacttaggttcaggtgttcaataggaataaagtttagtttaggtatctaaattaaaaaggcggacaagttccaggggagcatatgtatttgaccttggataaagatgcagattctattttatacaattatgacatgtatcaatcgcctattttgtacattgcacttcctttctgtagtagtaagtgtattcctagcagtttctcttttacgtatttagttttctcattgtcttaagaggtctttggggaattcagttttcctgcgaggatactctatggagtatatgtaatgtttatgatcactgcgactgtttcttaacttaatactagtaaggcaagcccgtgctacgcacgggtccaacactattaacataacttttctgatacaaaagatattttctgtattaagttcaattaacacataaaaacttgagagtttgaaaattggatacaacttctaatgcaattttatttttcgtcatctgaagccaccttcccgttgcaatctcaataaagggaaacctttgaagaaaaaatgagttgaaatctctttatttcatgacggagtaatataaaattataaattataaggttggaaaatcattctaaataacaaaagtgatgaaattcacttgcttgaaaaatgcggaagacaaaataaaagaataacagggttctggttcaaaacattgcgtatacttaaaaaggaaataatacattcaataaatatcactttctcaactttcctaaaacatttggacataaaaaagatacatttactatctcatattaaattcttctaggcacttgatgcgattatataccgcccttttgttggtttcctttacactacaatcacgtaagaacagatcaatataacgcatcaactcttgatgccttaacattatcctctgaactcttatggcagatcaaaggaaactattccaaaaatattttattgaccattatcttcgtattttggagctttgtaaatttgctttatagatgacacaatgttattcctcttaacattattccaaagtttggcgaacttgatattttcacttattaagtccttatatgaagagctagcttacaaagatcaaatgatttgtcttcaacctgcagtaaagagcaacaacttaatgagagaacacaagtgaactcataaagagccattttacaactttcaacaatgtggccgtttagaaatcaaatattccatgtccaaaaaaaccttaaagtacaagaactatttgattatctaataattttggattttatatttcatccaagagtttctaaataaagatataaaatgtcagaatgaaaattcgatgaccaacaacttatgacagaatatgtgtattcattgtgtgtgatgatccaaagggtcataaccggttttctacctttttctgggctttcgaggtcttgaaaacctcatctttagttgcctcgatttgcgtgcatagtccaggcgcgtagccggaaaagcttatgtgttaaattatgtgaaatttgataaattgtggctttaaaatggttaaagttgattttggtcaacattttgggtgaacgaacccggacccatgatttgatggtcccgaaggatctgtagaaaaatatgggactcgggcgtatgcctggaatcgaaattcgaggtcccgagcccgagaaatgaatttttaaaagaaattgttttttgaaatttaatatgaaaatttgaaataaaaatgaattagaaagcattggtatcaggcccgtattttggttcaggcactcgatacaggtattatatgtggtttaagcgctttctatgaaatttggttgaaatcggacgtcatttgacgtgtttcggacctaaaactctaaatttgaaagtttatgaagtttgatagaaaaaaatgatgattttgaggcttgattcattgattttgatgttattttggcgatttgatcgcttgagtaagttcataggatgttattgagttagtgtgtgtgtttggttaggagccccgagggctcgggagtgattcagaggcggttcggggtgtttttgaccttaggaagtgttgcagaatttctgcagtcagtgcccagtcattttcttctatgcgatcacataggtatgtctgcaatcgcgtagagttattttggagtcgcccagttttgttctatgcgatcgcgttataggccatgcaatcgcgtacctctgtaaactcattctatgcgatcacacactcccttctgcgttcgcaattcacaaaaggcctagccccgctttgaccctctatgcgatcgcactcgtcatcccgtgattgcagtgaccagcctaccttcccctatgcgatcgcattccctttcccgcgatcgcatagggcaattccgcccagttattttaaaagtccaaaacagacccattacgggagttctaccatttttcataaaacttgtcttctccaagctctaggggcgatttttgaagctcttcttcatcaaagtcttttgggtaagtaatttcccacctatttccttcactcttcttcattaattactgaaattctaaacctaaatcatgaaatcaaagtagaaattaggagttttgggtagagttatgtttttggaaattttgagtgattcaacctgaatttggggtcggatcttaaaataaattatatatttgaactcgtggggttatgggtaatcaggttttggtccgaccctcgtgtttggaccatgtgggcccggggtctaattttggtatttttggaagaatgctaggaacttcatatctaagctatgtgattttgttatcgagtctttattgatattattgaattaattatgcctagatatcgttgtttcggagtcggattataaaggaaaggcggtatttgagggttgattgctattctttggaccgaggtaagtgtttgttctaactttggcttgagggaataggattagagtgttgtttgctatttgctaattgttgagtacggtgtataggcatggtgacgagtatctatacaccggagtctagcatgaccgtgagtcttatttgtgtttattcggattttgtgatacctcttccttgttaaattgataaatttcatataatgtgaagagtttgaggaagaattatgatttgtacattcttggagcattggctcgagtatatcataaagcgtgaaagtatatgaaatgattgaacccctttggagcgttggctcaggtggtaaagtgagataagaggtaaaagtgaaagaaagagaaagaattattgaattgctcccttgccgggatgcttgttgctttgttgactatctcttgccgggatgctattgttgacccttgcctgagattattgatattgttcccttgccgggtttttaactgcttaattgtgctcccttgccgggagttagctgtttatttgtattcccttgccgggatttctatcattatttgtctactcccttgccccttgtttgtgattgttgcttgggtgaggaagagtgataaagcacgaagggtgatgccgtgcattgtttgctattgtgaggaaagagtgtaaagcactgatgtgatgaaattgagtgtaaagcacgaagggtgatgccgtgattgattgatatggtgaggaaagagagtaaaagcacgaagggtgatgccgtgcatatttcatttatatgattgctttggtgaggacgagagtaaaagcacgaagggtgatgccgtgcatttgttgctttctgattctttgttgatatccgagttatgttgtttctttcattacttgttcttatttgatttacttcgaggttatagatttccttaccctatttgccttgtgattgttgtttgggtgaggaagagcgtaaagcacgaagggtgatgccgtgcaaattgttgacttttgattcttgttgacattctggctttgttacttctttctgttattgaggatttctatttgaaactgttagctccccatagcatgctcccccctcttagctgtttaaattctgtatatttccttttattgcatatatctgcacaggttgtttttggtaggtcctgtctagcctcgtcactacttcgccggggttaggccaggcacttaccagcacatggggtcggttgtgctgatgctacactctgtgcatctttttgcacagatccaggagcagcttttggacctcagcagtaggatttgatcgggagctgacttcagtccagagacaccgaggtagccttgctgacgtccgcaggcccggagtctctctctctttattcagtttgttatcttttgtaccgaaacaaacagtttataattttctttcagacgattgtatttagtaaatcttagaagttcgtgagcattgtgacaccaatcttgggtagaggattatgttaaactttccgcatttctattcagtttttatataagttaagacttccgcttgaaatttttaattatgttgcctttattacatgttgataattatggaaaagaatgtgtgttaaacggaaggtaatttaagttggcttgcctagctcctattagtaggcgccatcacgaccccgagggtgggaaatccgggtcgtgacaagttggtatcagagcactaggttacttaggtctcacaactcacggacaagctcggtagagtctgagggatcggtacggagacgtctgtatttatcccgcagaggctactgagttaggaaaacttcacatctgttctttcttgtcgtgcggttctgtttccccaatactgattgaatttctactccgttctttcgcagatggcgaggacacgcgcttcctcatcgaccgcgcagcagcccgagcccccagtagcagctcctattaggggcagagggggcgaggccgtgccagaggccgaggcaggggcagagctcagccccgagcagcagttccagaggtggagcctcatgttgattatgatgaggaggttccagctccagcagctccggtgggcccagctcaggtcccagagggtttcattgccaccccagttcttcaggacgccctggttcgattggtgggccttatggagagagtcacccgaacaggtttgcttcctgtagcaccagccacttctcaggctggaggaggggctcagactcctgctacacgcactccggagcaggtagctccccagattcagactccagcggttcagccagttggggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatggtagaggccatcctcctaggccctttcagtcagctctccaggtatcacatggtatctcaggtggtcgtggttctcagacgcattatttggatcagcagtccttcagtgcaccaccagctcccatcagtgcaccgccgcttcagagtttccgaggtggtcattcaggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgttgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccttagagtggagagggagactcccctgttatttctatgtgaaggcgtatggtcgagaaggggtgtttggcctacttggcttatgttcgtgattccagtgctgagattccctctattgattctgtgcccgtggttcgtgagtttcctgaggttttcccatcagacttgccagggatgccacccgatagggatattgatttttgcatcgatttggctccgggcactcagcccatttctattccgccatatcgcatggccccgccagagttgaaagagttgaaagagcagttgcaagacttgcttgagaagggtttcattagacccagcgtatcgccttggggtgcgccggttctgtttgtaaagaaaaaggatggctcgatgagaatgtgcattgattaccggcaattgaacaaggttacaattaagaataagtatccactgccgaggattgatgatttgttcgatcagcttcagggtgccaaggtattttcaaagattgacttgagatctggctaccatcagttgaggattagggcatccgatgtccctaagacagcattccgcactcggtacgggcattatgagttcttggttatgtcatttgggttgaccaatgccccagcagcctttatggatttgatgaaccgagtgttcaggccttatttggactcgttcgtgatagtcttcattgatgatattttgatatattcccgcagccgggaggagcacgagcagcatcttagagtggttcttcagaccttgagggatagtcagttatatgctaagttctcgaagtgtgagttctggttgagctcagttgcatttctgggtcatgttgtatcagcagagggtattcaggttgatccaaagaagattgaggcagtcaagaactggcctagaccagcatcagcctagagattcggagtttcttggggttagcaggttactatcgtcggttcgtggaggggttctcatctattgcagccccgatgaccaggttgacccagaagggagcccagttcagatggtcggacgagtgtgaggcgagctttcagaagctcaagacagctctgactacggcaccggtattggttttgcccacaggttcagggccttatacagtctattgtgatgcatctcgtattggacttggtgcagtgttgatgcaggatggcaaggtcattgcctatgcttcgaggcagttgaaggttcatgagaagaactatccagtgcatgatttggagttggcagccattgttcacgcattgaagatttggaggcactatctgtatggcgtggcgtgtgaggtgttcacggatcataagagtcttcagtatttgttcaagcaaaaggagttgaatttgaggcagaggaggtggttggagttgttgaaagattatgacatcactatcctatatcacccgggaaaggccaatgtggtggccgatgccttgagtaggaagtcagccagtatgggcagtcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtacagcgtggaggtgccaagcaggttaccttagatgctgatggagttttgagattgcagggtcgagtttgtgtgcctaatgtggatgggcttcgagagttgattttagaggaggcccatagctcccggtactctattcatccgggcgccgcgaagatgtatcaggacttgcggcagcattattggtggcgtagaatgaagaaggatatcgttgcctatgtggctcggtgtttgaattgtcagcaggttaagtatgagcatcagaggcctggtggtttatttttggagtggaagtgatcactatggacttcgttgttgggctcccgcagactcggaggaagttcgacgcagtttgggtcattgttgataggctgaccaagtcagcgcatttcattcctgtggcagtctcctattcatccgagaggttagctgagatctatatccgggagattgttcgccttcatggtgtgccggtatctatcatttcggaccgaggtacgcagtttacctcgcgtttctggaaagcagtcagcgagagttaggcacccaggttgagttgagtacaacatttcatcctcagacggacgggcagtccgagcggactattcagatattggaggatatgctccgagcttgtgtcattgactttggaggttcgtgggatcagttcttgcctttagcagagtttgcctacaacaacagctaccagtcgagtatccagatggctccttatgaggctttgtatggtaggcgatgtcgatctccggttggatggtttgagccgggagaggctcggttgttgggtacagatttggttcaggaggcttggacaaggtcaggatcattcaggataggcttcgtacagctcagtccaggcaaaagagctatgcagatcgaaaggttcgagatgtggctttcatggttggtgagcgggtattgctccgagtgtcgcctatgaagggcgtgatgagatttgggaagaagggcaagcttagccctaggttcattggtccatttgagattcttgatcgagtgggagaggtggcttatagacttgcattgccaccgagcttatcagccgtacatccagtgtttcatgtgtccatgcttcggaaatatcacggcgatccatcccacgtgttagatttcagcactgtccagttggacaaggacttatcttatgaggaggagccggtagctattctagaccggcaggttcgccagttgaggtcgaagagttttccttcggttcgtgttcagtggagaggtcagcctcctgaggcatcgacctgggagtccgagtccgatatgcgggaccgttatcctcaccttttccccgactcaggtacttccttcttatgtccgttcgaggacgaacggttgttttagaggtggagaatgtgacgacccaaagggtcatcaccggttttctccctttttcgtgcttccgaggccttgaaaacctcacctttagttgcctcgatttgcgtgcgcagtccgggcgcgtagccggaaaagcttatgtgttaaattatgtgaaatttgataaattgtggctttaaaatggttaaagttgactttggtcaacattttgggtaaacggacccggacccgtgatttgacggtcccggagggtccgtagaaaaatatgggactcgggcgtatgcccggaatcgaaatccgaggtcccgagcccgagaaatgaatttttaaaagaaattgttttctgaaatttaatatgaaaatttgaaataaaaatgaattagaaagcattggtatcgggcccgtattttggttccggcgcccggtacaggtcttatatgtggtttaagcgctttctgtgaaatttggttgaaatcggacgtcgtttgacgtgattcggacttgaattcctaaatttgaaacttgatgaagtttgagaaaaactcttgattttgaggtttgattcattgtttttgaagttatttaggcgatttgatcgcacggataagttcgtatgatgttgttgagttagtgcatgtgtttggttaggagccccgagggctcgggtgtttgtttcggaatggttttagacttagaaaaattgcagaactgctgtctgctggtgtccagtcttttgtgctatgcgatcgcatagctatgtccgcgatcgcatagtgtaaattttcagggttttagtttgttctatgcgatcgcatagttagtagttagcctgagaggtcctatattttgctctacgcgatcgcattatttcctctgcgatcgcagtgtgttagccagccttcactatttcctttatgcgatcgcatagtgtcattcgcgatcgcagagccctgtcccatttactctatgcgatcgcactcctttgtccgcgatcgcataggccaaattcgcccagttaaattttaaaatccagaacagtagccttacgggattcttacaaaatttcacaaactctttcttctccaaagttctagggcgatctttgaagcattctttcaccataaactcttgggttagtaatctttaacttattctcttccattttcatcaacatctattgaatttcttggcctaaaacatgtaatttagggtagaaattgggggagtgggtagagttagggctttttactttttcttgatttggacctcgttttggggtcgaatttgaaaaaattatatattcgggctcgtggatgaatgggtgatatggttttggtccgaacctcgtgtttggaccatgtgggcccggggtcgaattttggtatttttggaagaatgctaggaacttcatatctaagctatgggattttgttatcgagtctttattgatattattgaattaattatgcctagatatcgttgtttcggagtcgggttataaaggaaaggcaatatttgagggttgattgctattctttggaccgaggtaagtgtttgttctaactttggcttgagggaatatgattaaagtattgtttgctatttgctaattgttgagtacggtgtataggcatggtgacgagtatctatacaccggagtctagcatgaccgtgcctcttatttgttttttttcggatttaatgatacctcttccttgttaaattcataaatttcatataatgtgaagagtttgaggaagagttatgatttgtacattcttggagcgttggctcgagtgtatcataaatcatgaaagtatatgaaatgattaaacccctttggagcgttggctcaggtggtaaagtgagataagaggtaaaagtgaaagaaagagaaagaattattgaattgctcccttgccgggatgcttgttgctttgttgactatctcccttgccgggatgcttgttgttttgttgactatctcccttgccgggatgcttgttgctttgttgactatctcccttgccggaatgctgagattattgttattgttcccttgctgggttttttttaactgcttaattgtgctcccttgccgggagttagctgtttatttgtattcccttgccgggatttctatcattatttgtctactcccttgccccttgtttgtgattgttgcttgggtgaggaagagtgataaagcacgaagggtgatgccgtgcattgtttgctattgtgaggaaagagtgtaaagcactgatgtgatgaaattgagtgtaaagcacgaagggtgatgccgtgattgattgatatggtgaggaaagagagtaaaagcacgaagggtgatgccgtgcatatttcatttatatgattgctttggtgaggacgagagtaaaagcacgaagggtgatgccgtgcatttgttgctttctgattctttgttgatatccgagttatgttgtttctttcattacttgttcttatttgatttacttcgaggttatagatttccttaccctatttgccttgtgattgttgtttgggtgaggaagagcgtaaagcacgaagggtgatgccgtgcaaattgttgacttttgattcttgttgacattctggctttgttacttctttctgttattgaggatttctatttgaaactgttagctccccatagcatgctcccccctcttagctgtttaaattctgtatatttccttttattgcatatatctgcacaggttgtttttggtaggtcctgtctagcctcgtcactacttcgccggggttaggccaggcacttaccagcacatggggtcggttgtgctgatgctacactctgtgcatctttttgcacagatccaggagcagcttttggacctcagcagtaggatttgatcgggagctgacttcagtccagagacaccgaggtagccttgctgacgtccgcaggcccggagtctctctctctttattcagtttgttatcttttgtaccgaaacaaacagtttataattttctttcagacgattgtatttagtaaatcttagaagttcgtgagcattgtgacaccaatcttgggtagaggattatgttaaactttccgcatttctattcagtttttatataagttaagacttccgcttgaaatttttaattatgttgcctttattacatgttgataattatggaaaagaatgtgtgttaaacggaaggtaatttaagttggcttgcctagctcctattagtaggcgccatcacgaccccgagggtgggaaatccgggtcgtgacaagttggtatcagagcactaggttacttaggtctcacaactcacggacaagctcggtagagtctgagggatcggtacggagacgtctgtatttatcccgcagaggctactgagttaggaaaacttcacatctgttctttcttgtcgtgcggttctgtttccccaatactgattgaatttctactccgttctttcgcagatggcgaggacacgcgcttcctcatcgaccgcgcagcagcccgagcccccagtagcagctcctattaggggcagagggggcgaggccgtgccagaggccgaggcaggggcagagctcagccccgagcagcagttccagaggtggagcctcatgttgattatgatgaggaggttccagctccagcagctccggtgggcccagctcaggtcccagagggtttcattgccaccccagttcttcaggacgccctggttcgattggtgggccttatggagagagtcacccgaacaggtttgcttcctgtagcaccagccacttctcaggctggaggaggggctcagactcctgctacacgcactccggagcaggtagctccccagattcagactccagcggttcagccagttggggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatggtagaggccatcctcctaggccctttcagtcagctctccaggtatcacatggtatctcaggtggtcgtggttctcagacgcattatttggatcagcagtccttcagtgcaccaccagctcccatcagtgcaccgccgcttcagagtttccgaggtggtcattcaggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgttgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccttagagtggagagggagactcccctgttatttctatgtgaaggcgtatggtcgagaaggggtgtttggcctacttggcttatgttcgtgattccagtgctgagattccctctattgattctgtgcccgtggttcgtgagtttcctgaggttttcccatcagacttgccagggatgccacccgatagggatattgatttttgcatcgatttggctccgggcactcagcccatttctattccgccatatcgcatggccccgccagagttgaaagagttgaaagagcagttgcaagacttgcttgagaagggtttcattagacccagcgtatcgccttggggtgcgccggttctgtttgtaaagaaaaaggatggctcgatgagaatgtgcattgattaccggcaattgaacaaggttacaattaagaataagtatccactgccgaggattgatgatttgttcgatcagcttcagggtgccaaggtattttcaaagattgacttgagatctggctaccatcagttgaggattagggcatccgatgtccctaagacagcattccgcactcggtacgggcattatgagttcttggttatgtcatttgggttgaccaatgccccagcagcctttatggatttgatgaaccgagtgttcaggccttatttggactcgttcgtgatagtcttcattgatgatattttgatatattcccgcagccgggaggagcacgagcagcatcttagagtggttcttcagaccttgagggatagtcagttatatgctaagttctcgaagtgtgagttctggttgagctcagttgcatttctgggtcatgttgtatcagcagagggtattcaggttgatccaaagaagattgaggcagtcaagaactggcctagaccagcatcagcctagagattcggagtttcttggggttagcaggttactatcgtcggttcgtggaggggttctcatctattgcagccccgatgaccaggttgacccagaagggagcccagttcagatggtcggacgagtgtgaggcgagctttcagaagctcaagacagctctgactacggcaccggtattggttttgcccacaggttcagggccttatacagtctattgtgatgcatctcgtattggacttggtgcagtgttgatgcaggatggcaaggtcattgcctatgcttcgaggcagttgaaggttcatgagaagaactatccagtgcatgatttggagttggcagccattgttcacgcattgaagatttggaggcactatctgtatggcgtggcgtgtgaggtgttcacggatcataagagtcttcagtatttgttcaagcaaaaggagttgaatttgaggcagaggaggtggttggagttgttgaaagattatgacatcactatcctatatcacccgggaaaggccaatgtggtggccgatgccttgagtaggaagtcagccagtatgggcagtcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtacagcgtggaggtgccaagcaggttaccttagatgctgatggagttttgagattgcagggtcgagtttgtgtgcctaatgtggatgggcttcgagagttgattttagaggaggcccatagctcccggtactctattcatccgggcgccgcgaagatgtatcaggacttgcggcagcattattggtggcgtagaatgaagaaggatatcgttgcctatgtggctcggtgtttgaattgtcagcaggttaagtatgagcatcagaggcctggtggtttatttttggagtggaagtgatcactatggacttcgttgttgggctcccgcagactcggaggaagttcgacgcagtttgggtcattgttgataggctgaccaagtcagcgcatttcattcctgtggcagtctcctattcatccgagaggttagctgagatctatatccgggagattgttcgccttcatggtgtgccggtatctatcatttcggaccgaggtacgcagtttacctcgcgtttctggaaagcagtcagcgagagttaggcacccaggttgagttgagtacaacatttcatcctcagacggacgggcagtccgagcggactattcagatattggaggatatgctccgagcttgtgtcattgactttggaggttcgtgggatcagttcttgcctttagcagagtttgcctacaacaacagctaccagtcgagtatccagatggctccttatgaggctttgtatggtaggcgatgtcgatctccggttggatggtttgagccgggagaggctcggttgttgggtacagatttggttcaggaggcttggacaaggtcaggatcattcaggataggcttcgtacagctcagtccaggcaaaagagctatgcagatcgaaaggttcgagatgtggctttcatggttggtgagcgggtattgctccgagtgtcgcctatgaagggcgtgatgagatttgggaagaagggcaagcttagccctaggttcattggtccatttgagattcttgatcgagtgggagaggtggcttatagacttgcattgccaccgagcttatcagccgtacatccagtgtttcatgtgtccatgcttcggaaatatcacggcgatccatcccacgtgttagatttcagcactgtccagttggacaaggacttatcttatgaggaggagccggtagctattctagaccggcaggttcgccagttgaggtcgaagagttttccttcggttcgtgttcagtggagaggtcagcctcctgaggcatcgacctgggagtccgagtccgatatgcgggaccgttatcctcaccttttccccgactcaggtacttccttcttatgtccgttcgaggacgaacggttgttttagaggtggagaatgtgacgacccaaagggtcatcaccggttttctccctttttcgtgcttccgaggccttgaaaacctcacctttagttgcctcgatttgcgtgcgcagtccgggcgcgtagccggaaaagcttatgtgttaaattatgtgaaatttgataaattgtggctttaaaatggttaaagttgactttggtcaacattttgggtaaacggacccggacccgtgatttgacggtcccggagggtccgtagaaaaatatgggactcgggcgtatgcccggaatcgaaatccgaggtcccgagcccgagaaatgaatttttaaaagaaattgttttctgaaatttaatatgaaaatttgaaataaaaatgaattagaaagcattggtatcgggcccgtattttggttccggcgcccggtacaggtcttatatgtggtttaagcgctttctgtgaaatttggttgaaatcggacgtcgtttgacgtgattcggacttgaattcctaaatttgaaacttgatgaagtttgagaaaaactcttgattttgaggtttgattcattgtttttgaagttatttaggcgatttgatcgcacggataagttcgtatgatgttgttgagttagtgcatgtgtttggttaggagccccgagggctcgggtgtttgtttcggaatggttttagacttagaaaaattgcagaactgctgtctgctggtgtccagtcttttgtgctatgcgatcgcatagctatgtccgcgatcgcatagtgtaaattttcagggttttagtttgttctatgcgatcgcatagttagtagttagcctgagaggtcctatattttgctctacgcgatcgcattatttcctctgcgatcgcagtgtgttagccagccttcactatttcctttatgcgatcgcatagtgtcattcgcgatcgcagagccctgtcccatttactctatgcgatcgcactcctttgtccgcgatcgcataggccaaattcgcccagttaaattttaaaatccagaacagtagccttacgggattcttacaaaatttcacaaactctttcttctccaaagttctagggcgatctttgaagcattctttcaccataaactcttgggttagtaatctttaacttattctcttccattttcatcaacatctattgaatttcttggcctaaaacatgtaatttagggtagaaattgggggagtgggtagagttagggctttttactttttcttgatttggacctcgttttggggtcgaatttgaaaaaattatatattcgggctcgtggatgaatgggtgatatggttttggtccgaacctcgtgtttggaccatgtgggcccggggtcgaattttggtatttttggaagaatgctaggaacttcatatctaagctatgggattttgttatcgagtctttattgatattattgaattaattatgcctagatatcgttgtttcggagtcggattataaaggaaaggcggtatttgagggttgattgctattctttggaccgaggtaagtgtttgttctaactttggcttgagggaataggattagagtgttgtttgctatttgctaattgttgagtacggtgtataggcatggtgacgagtatctatacaccggagtctagcatgaccgtgagtcttatttgtgtttattcggattttgtgatacctcttccttgttaaattgataaatttcatataatgtgaagagtttgaggaagaattatgatttgtacattcttggagcattggctcgagtatatcataaagcgtgaaagtatatgaaatgattgaacccctttggagcgttggctcaggtggtaaagtgagataagaggtaaaagtgaaagaaagagaaagaattattgaattgctcccttgccgggatgcttgttgctttgttgactatctcccttgccgggatgctgagattattgatattgttcccttgccgggtttttaactgcttaattgtgctcccttgccgggagttagctgtttatttgtattcccttgccgggatttctatcattatttgtctactcccttgccccttgtttgtgattgtttcttgggtgaggaagagtgataaagcacgaagggtgatgtcgtgcattgtttgctattgtgaggaaagagtgtaaagcatgaagggtgatgtcgtgccgcatgatgtactattctgtgccgattttattgattatatggtgagtaaagagagtaaaagcacgaagggtgatgccgtgcatatttcatttatatgattgctttggtgaggacgagagcgtaaagcacgaagggtgacaacaatcacaaacaaggggcaagggagtagacaaataatgatagaaatcccggcaagggaatacaaataaacagctaactcccggcaagggagcacaattaagcagttaaaaacccggcaagggaacaatatcaataatctcagcatcccggcaagggagatagtcaacaaagcaacaagcatcccggcaagggagcaattcaataattctttctctttctttcacttttacctcttatctcactttaccacctgagccaacgctccaaaggggttcaatcatttcatatactttcacgctttatgatatactcgagccaatgctccaagaatgtacaaatcataattcttcctcaaactcttcacattatatgaaatttatcaatttaacaaggaagaggtatcacaaaatccgaataaacacaaataagactcacggtcatgctagactccggtgtatagatactcgtcaccatgcctatacaccgtactcaacaattagcaaatagcaaacaacactctaatcctattccctcaagccaaagttagaacaaacacttacctcggtccaaagaatagcaatcaaccctcaaataccgcctttcctttataatccgactccgaaacaacgatatctaggcataattaattcaataatatcaataaagactcgataacaaaatcccatagcttagatatgaagttcctagcattcttccaaaaataccaaaattcgaccccgggcccacatggtccaaacacgaggctcggaccaaaacccgattacccataaccccacgagttcaaatatataatttattttaagatccgaccccaaattgaggttgaatcactcaaaattcccaaaaacctaactctacccaaaacccctaatttctactctaaattacatgtttaggcttaggaattcaatattaatgatggaaaatgaagaaaataagggaatttactaacccaagaagtttggtgaaagaagcttcaatggacgcctaagaccttggagaagaaaagagctcgtgtgttttatgaaaatcccgtaactactgtttctggaagttttaaaaatttaactgggcgaaactatgcgatcgctcatgcgatcgcggaagaagcaatgcgatcgcatagaagaaaaggctgggctgcgacggaacaggatgcgatcgcatagagaaaatataggcttctcaggctaacactatgcgatcgcgggaggactatgcgatcgcatagaacaaactggaccctgaaatttacactatgcgatcgcggaatagctatgcgatcgcatagcacaaagactggacaacagcagacagcagttctgcaattttctaaggctaaaaccacccgaaacactccgaaacactcccgagccctcggggctcctaaccaaacacacacactaactcaacaacatcctacgaacttaaccatgcgattaaatcgccaaaataacatcataaacgaggaatcaaacctcaaaatcatcactttttcatcaaacttcataaactttcaaacttagagttttagtccgaaacacgtcaaatgacgtccgatttcaaccaaatttcacagaaagcgcttaaaccacatataagacctgtaccgggcgccggaaccaaaatacgggcccgataccaatgctttctaatcattttcatttcaaatttccaaataaatttcagaaaaacaatttcttttaaaaattcatttctcgggctcgggacctcggatttcgattccgggcatacgcccgagtcccatatttttctacggaccctccgggaccgtcaaatcacgggtccgggtccgtttacccaaaatgttgaccaaagtcaactttaaccattttaaagccaaattttcaaatttcacataatttcacacataagcttttccggctacgcgcccggactgcgcacgcaaatcgaggcaactaaaatgaggttttcaaggcctcggaagcacaaaaaagggagaaaaccggtgatgaccctttgggtcgtcacattctccacctctaaaacaaccgttcgtcctcgaacggacataagaaggaagtacctgagtcggggaaaaggtgaggataacggtcccgcatatcggactcggactcccaggtcgatgcctcaggaggctgacctctccactgaacacgaaccgaaggaaaactcttcgacctcaactgcgaacctgccggtctagaatagctaccggctcctcctcataagacaagtccttgtccaactggacagtgctgaaatctaacacgtgggatggatcgccgtgatatttccgaagcatggacacatgaaacactggatgcacggctgataagctcggtggcaatgcaagtctataagccacctctcccactcgatcaagaatctcaaatggaccaatgaacctagggctaagcttgcccttcttcccaaatctcatcacgcccttcataggcgacactcggagcaatacccgctcaccaaccatgaaagccacatctcgaaccttcgatctgcatagctcttttgcctggactgagctgtacgaagcctatcctgaatgatcctgaccttgtccaaggcctcctgaaccaaatctgtacccaacaaccgagcctctcccggctcaaaccatccaaccggagatcgacatcgcctaccatataaagcctcataaggagccatctggatactcgactggtagctgttgttgtaggcaaactctgctaaaggcaagaactgatcccacgaacctccaaagtcaatgacacaagctcggagcatatcctccaatatctgaatagtccgctcggactgcccgtccgtctgaggatgaaatgttgtactcaactcaacctgggtgcctaactctcgctgaactgctctccagaaacgcgaggtaaactgcgtacctcggtccgaaatgatagggcacaccatgaaggcgaacaatctcccggatatagatctcagctaacctctcggatgaataggagactgccacaggaatgaaatgcgctgacttggtcagcctatcaacaatgacccaaactgcgtcgaacttcctccgagtctgcgggagtccaacaacgaagtccatagtgatccgctcccacttccactcgggaagctcaatcctctgaaataaaccaccaggcctctgatgctcatacttaacctgctgacaattcaaacaccgagccacatatgcaacgatatccttcttcattctacgccaccaataatgctgccgcaaatcctgatacatcttcgcggcgcccggatgaatagagtaccgggagctatgggcctcctctaaaatcaactctcgaagcccatccacattaggcacacaaactcgaccctgcaatctcaaaactccatcatcatctaaggtaacctgcttggcacctccacgctgcaccgtgtctctaaggacacacaaatggggatcatcaaactgccgatcacggatacgctccaataacgaagaacgagcgaccgtgcaagctaatactctactaggctcagaaatatccaacctcactaactgattggccaaagcctgaacgtccaaagcaagcggtctctcaccgaccggaatataagcaagactgcccatactggctgacttcctactcaaggcatcggccaccacattggcctttcccgggtgatatagatagtgatgtcataatctttcaacaactccaaccacctcctctgcctcaaattcaactccttttgcttgaacaaatactgaagactcttatgatccgtgaacacctcacatgccacgccatacagatagtgcctccaaatcttcaatgcgtgaacaatggctgccaactccaaatcatgcactggatagttcttctcatgaatcttcaactgcctcgaagcataggcaatgaccttgccatcctgcatcaacactgcaccaagtccaatacgagatgcatcacaatagactgtataaggccctgaacctgtgggcaaaaccaataccggtgccgtagtcagagctgtcttgagcttctgaaagctcgcctcacactcgtccgaccatctgaactgggcacccttctgggtcaacctggtcatcggggctgcaatagatgagaacccctccacgaaccgacgatagtagcctgccaaccccaagaaactccgaatctctgtagctgatgctggtctaggccagttcttgactgcctcaatcttctttggatcaacctgaataccctctgctgatacaacatgacccagaaatgcaactgaactcaaccagaactcacacttcgagaacttagcatataactgactatccctcaaggtctgaagaaccactctaagatgctgctcgtgctcctcccggctgcgggaatatatcaaaatatcatcaatgaagactatcacgaacgagtccaaataaggcctgaacactcggttcatcaaatccataaaggctgctggggcattggtcaacccaaatgacataaccaagaactcataatgcccgtaccgagtgcggaatgctgtcttagggacatcggatgccctaatcctcaactgatggtagccagatctcaagtcaatctttgaaaataccttggcaccctgaagctgatcgaacaaatcatcaatcctcggcagtggatacttattcttaattgtaaccttgttcaattgccggtaatcaatgcacattctcatcgagccatcctttttctttacaaacagaaccggcgcaccccaaggcgatacgctgggtctaatgaaacccttctcaagcaagtcttgcaactgctctttcaactctttcaactctggcggggccatgcgatatggcggaatagaaatgggctgagtgcccggagccaaatcgatgcaaaaatcaatatccctatcgggtggcatccctggcaagtctgatgggaaaacctcaggaaactcacgaaccacgggcacagaatcaatagagggaatctcagcactggaatcacgaacataagccaagtaggccaaacaccccttctcgaccatacgccgagccttcacatacgaaataacactgcgggtagaatgaccaggagtccctctccactctaaacggggcaaatccggtaaggctaaagtcacagtcttggcatgacaatccaagatcgcatgatacggggacaaccaatccatccctaatataacgtcgaaatccaccatatctaagagcaacaaatcaacacgggtctcaagtcccctaaacaccacaacacaggaacgatgaacccgatcaaccactatagaatcacccactggtgtagatacatacacaggaatactcaaggcctcactaggcataaccaggtagggtgcaaaataggacgacacatatgaatacgtagatccagggtcaaatagcactgaagcatctctatcacagaccaaaatagtacctgtaataacagcatcggatgactcagcctctggcctggctggcaaagcataacatcggggctgggccccacctccctgaatcacatccctgggacgatcggctgctggctgacccctacctctggcggtctgagctccacctctatgacctctacctccacctctatgtcctctacccccgcctctagctggctgggcaggctgtggagcaactggtgcctgaatcataggacgaggaccctgctgctgagaactacccgaagctcgagggcaaaacctggcaatgtgacccatatcaccacaagtgtaacaagccctcggctgctgagactgctgaccctgtcgccctgaatgaccacctcggaaactctgaagcggcggtgcactgatgggagctggtggtgcactgaaggactgctgatccaaataatgcgtctgagaaccacgaccacctgagataccatgtgatacctggagagctgactgaaagggcctaggaggatggcctctaccatacgaatctctacctccagacgaggtaccactgaatctgcctgaatgacggggcctcttatccgacccatgaccacctccctgtgacagaaccatctcaactctgcgggccacattggccgcctcctgaaatgtgatctcgctcccggcctccttggccatctgaagacgaatcggcagaataagaccatcaataaaccttctcaccctctctctctcggtgggaagtatgatgagagcatggcgagctaaatcgatgaacctggtctcatactgggtaacagtcatagaaccctgctggaggcgctcaaactgcctccgataggcctctctctgagtaacggggagaaacttctctagaaacaacactgtaaactgctcccaagtcaaagatggcgatccggctggtctcgctaagcaataatccctccaccaagtcttggcggatccagacaagcgaaatgtagcaaaatcaaccccattggtctcaacaatacccatgtttctgagaacctcgtggcagctgtctagataatcctggggatcctcagtagatgcaccgcaaaagtagaagtgaagagcttggtgaacctatccaatctccacaaagcatcggcggacatagccgctccatcgccggtctgagctatacccggctgaacccactgctggctgaaccaccggaacctgaacctggggagctacctgctccggagtgtacgtgtagcaggagtctgacccctcctccagcctgagaagtggctggtgctactggaagcaaacccgctcgtgacgctctccatgaaggcctaccaatcggaccaaagcgtcctgaagaactggagtggcaatgaaaccctctgggacctgagctgggcccaccggagctgctggagctggaacctcctcatcataatcaacatgaggctccacctctggaactgctgctcggggctgagctctgcccctgcctcggcctctgggcctcgcctcgccctctgcccctaataggagctgctgctgggggctcgggctgctgcgcggtcgatgaggaagcgcgtgtcctcgccatctgcgaaagaacggagtagaaattcaatcagtattggggaaacagaaccgcacgacaagaaagaacagatgtgaagttttcctaactcagtagcctctgcgggataaatacagacgtctccgtaccgatccctcagactctaccgagcttgtccgtgagttgtgagacctaagtaacctagtgctctgataccaacttgtcacgacccggatttcccaccatcgggagtcgtgatggcgcctactattggagctaggccagccaagtattaaaacatttctgataacattcgcaacaatataacaaaacgagacaattaaataaaagcggaagtcttaacttatataaaactgaatagaaatgcggaaagtttaacataatcctctacccaagattggtgtcacaatgctcacgaacttctaagatttactaaatacaatcgtctgaaagaaaattataaactgtttgtttcggtacaaaagataacaaactgaataaagagagagagactccgggcctgcggacgtcagcaaggctacctcggtgtctctggactgaagtcagctcccgatcaaatcctactgctgaggtccgcgtaaagcacgaaaggtgattccatgtattgttttggtgaggacgagagtaaaagcacgaagggtgatgctgtgcaaattgttgactttttattcttcttgacattctggctttgttacttctttctgttattgaggatttctatttgaaacttttagctccccatagcatgctccccccttcttagctgtttaaattctgtatatttccttttattgcatatatctgcataggttgtttttggtaggtcctgtctagcctcgtcactacttcgcctgggttaggccaggcacttaccagcacatggggtcggttgtgctgatgctacactctgtgcatctttttgcacagatctaggagcagctttttcttcctcacccaaacaacaatcacaaggcaaatagggtaaggaaatctataacctcgaagtaaatcaaataagaacaagtaatgaaagaaacaacataactcggatatcaacaaagaatcagaaagcaacaaatacacggcatcacccttcgtgcttttactctcgtcctcaccaaagcaatcatataaatgaaatatgcacggcatcacccttcgtgcttttactctctttcctcaccatataatcaataaaatcggcacggaatggtacatcgtgcggcacgacatcacccttcgtgctttacactctttcctcacaatagcaaacaatgcacggcatcacccttcgtgctttatcactcttcctcacccaagcaacaatcacaaacaaggggcaagggagtagacaaataatgatagaaatcccggcaagggaatacaaataaacagctaactcccggcaagggagcacaattaagcagttaaaaacccggcaagggaacaatatcaataatctcagcatcccggcaagggagatagtcaacaaagcaacaagcatcccggcaagggagcaattcaataattctttctctttctttcacttttacctcttatctcactttaccacctgagccaacgctccaaaggggttcaatcatttcatatactttcacgctttatgatatactcgagccaatgctccaagaatgtacaaatcataattcttcctcaaactcttcacattatatgaaatttatcaatttaacaaggaagaggtatcacaaaatccgaataaacacaaataagactcacggtcatgctagactccggtgtatagatactcgtcaccatgcctatacaccgtactcaacaattagcaaatagcaaacaacactctaatcctattccctcaagccaaagttagaacaaacacttacctcggtccaaagaatagcaatcaaccctcaaataccgcctttcctttataatccgactccgaaacaacgatatctaggcataattaattcaataatatcaataaagactcgataacaaaatcccatagcttagatatgaagttcctagcattcttccaaaaataccaaaattcgaccccgggcccacatggtccaaacacgaggttcggaccaaaaccatatcacccattcatccacgagcccgaatatataattttttcaaattcgaccccaaaacgaggtccaaatcaagaaaaagtaaaaagccctaactctacccactcccccaatttctaccctaaattacatgttttaggccaagaaattcaatagatgttgatgaaaatggaagagaataagttaaagattactaacccaagagtttatggtgaaagaatgcttcaaagatcgccctagaactttggagaagaaagagtttgtgaaattttgtaagaatcccgtaaggctactgttctggattttaaaatttaactgggcgaatttggcctatgcgatcgcggacaaaggagtgcgatcgcatagagtaaatgggacagggctctgcgatcgcgaatgacactatgcgatcgcataaaggaaatagtgaaggctggctaacacactgcgatcgcagaggaaataatgcgatcgcgtagagcaaaatataggacctctcaggctaactactaactatgcgatcgcatagaacaaactaaaaccctgaaaatttacactatgcgatcgcggacatagctatgcgatcgcatagcacaaaagactggacaccagcagacagcagttctgcaatttttctaagtctaaaaccattccgaaacaaacacccgagccctcggggctcctaaccaaacacatgcactaactcaacaacatcatacgaacttatccgtgcgatcaaatcgcctaaataacttcaaaaacaatgaatcaaacctcaaaatcaagagtttttctcaaacttcatcaagtttcaaatttaggaattcaagtccgaatcacgtcaaacgacgtccgatttcaaccaaatttcacagaaagcgcttaaaccacatataagacctgtaccgggcgccggaaccaaaatacgggcccgataccaatgctttctaattcatttttatttcaaattttcatattaaatttcagaaaacaatttcttttaaaaattcatttctcgggctcgggacctcggatttcgattccgggcatacgcccgagtcccatatttttctacggaccctccgggaccgtcaaatcacgggtccgggtccgtttacccaaaatgttgaccaaagtcaactttaaccattttaaagccacaatttatcaaatttcacataatttaacacataagcttttccggctacgcgcccggactgcgcacgcaaatcgaggcaactaaaggtgaggttttcaaggcctcggaagcacgaaaaagggagaaaaccggtgatgaccctttgggtcgtcacattctccacctctaaaacaaccgttcgtcctcgaacggacataagaaggaagtacctgagtcggggaaaaggtgaggataacggtcccgcatatcggactcggactcccaggtcgatgcctcaggaggctgacctctccactgaacacgaaccgaaggaaaactcttcgacctcaactggcgaacctgccggtctagaatagctaccggctcctcctcataagataagtccttgtccaactggacagtgctgaaatctaacacgtgggatggatcgccgtgatatttccgaagcatggacacatgaaacactggatgtacggctgataagctcggtggcaatgcaagtctataagccacctctcccactcgatcaagaatctcaaatggaccaatgaacctagggctaagcttgcccttcttcccaaatctcatcacgcccttcataggcgacactcggagcaatacccgctcaccaaccatgaaagccacatctcgaacctttcgatctgcatagctcttttgcctggactgagctgtacgaagcctatcctgaatgatcctgaccttgtccaagcctcctgaaccaaatctgtacccaacaaccgagcctctcccggctcaaaccatccaaccggagatcgacatcgcctaccatacaaagcctcataaggagccatctggatactcgactggtagctgttgttgtaggcaaactctgctaaaggcaagaactgatcccacgaacctccaaagtcaatgacacaagctcggagcatatcctccaatatctgaatagtccgctcggactgcccgtccgtctgaggatgaaatgttgtactcaactcaacctgggtgcctaactctcgctgactgctttccagaaacgcgaggtaaactgcgtacctcggtccgaaatgatagataccggcacaccatgaaggcgaacaatctcccggatatagatctcagctaacctctcggatgaataggagactgccacaggaatgaaatgcgctgacttggtcagcctatcaacaatgacccaaactgcgtcgaacttcctccgagtctgcgggagcccaacaacgaagtccatagtgatcacttccactccaaaaataaaccaccaggcctctgatgctcatacttaacctgctgacaattcaaacaccgagccacataggcaacgatatccttcttcattctacgccaccaataatgctgccgcaagtcctgatacatcttcgcggcgcccggatgaatagagtaccgggagctatgggcctcctctaaaatcaactctcgaagcccatccacattaggcacacaaactcgaccctgcaatctcaaaactccatcagcatctaaggtaacctgcttggcacctccacgctgtaccgtgtctctaaggacacacaaatggggatcatcaaactgccgatcacggatacgctccaataacgaagaacgagcgaccgtgcaagctaatactctactaggctcagaaatatccaacctcactaactgattggccaaagcctgaacgtccaaagcaagcggtctctcaccgaccggaatataagcaagactgcccatactggctgacttcctactcaaggcatcggccaccacattggcctttcccgggtgatataggatagtgatgtcataatctttcaacaactccaaccacctcctctgcctcaaattcaactccttttgcttgaacaaatactgaagactcttatgatccgtgaacacctcacacgccacgccatacagatagtgcctccaaatcttcaatgcgtgaacaatggctgccaactccaaatcatgcactggatagttcttctcatgaaccttcaactgcctcgaagcataggcaatgaccttgccatcctgcatcaacactgcaccaagtccaatacgagatgcatcacaatagactgtataaggccctgaacctgtgggcaaaaccaataccggtgccgtagtcagagctgtcttgagcttctgaaagctcgcctcacactcgtccgaccatctgaactgggctcccttctgggtcaacctggtcatcggggctgcaatagatgagaacccctccacgaaccgacgatagtaacctgctaaccccaagaaactccgaatctctaggctgatgctggtctaggccagttcttgactgcctcaatcttctttggatcaacctgaataccctctgctgatacaacatgacccagaaatgcaactgagctcaaccagaactcacacttcgagaacttagcatataactgactatccctcaaggtctgaagaaccactctaagatgctgctcgtgctcctcccggctgcgggaatatatcaaaatatcatcaatgaagactatcacgaacgagtccaaataaggcctgaacactcggttcatcaaatccataaaggctgctggggcattggtcaacccaaatgacataaccaagaactcataatgcccgtaccgagtgcggaatgctgtcttagggacatcggatgccctaatcctcaactgatggtagccagatctcaagtcaatctttgaaaataccttggcaccctgaagctgatcgaacaaatcatcaatcctcggcagtggatacttattcttaattgtaaccttgttcaattgccggtaatcaatgcacattctcatcgagccatcctttttctttacaaacagaaccggcgcaccccaaggcgatacgctgggtctaatgaaacccttctcaagcaagtcttgcaactgctctttcaactctttcaactctggcggggccatgcgatatggcggaatagaaatgggctgagtgcccggagccaaatcgatgcaaaaatcaatatccctatcgggtggcatccctggcaagtctgatgggaaaacctcaggaaactcacgaaccacgggcacagaatcaatagagggaatctcagcactggaatcacgaacataagccaagtaggccaaacaccccttctcgaccatacgccttcacatagaaataacaggggagtctccctctccactctaaggggcaaatccggtaaggctaaagtcacagtcttggcatgacaatccaagatcgcatgatacggggacaaccaatccatccctaatataacgtcgaaatccaccatatctaagagcaacaaatcaacacgggtctcaagtcccctaaacaccacaacacaggaacgatgaacccgatcaaccactatagaatcacccactggtgtagatacatacacaggaatactcaaggcctcactaggcataaccaggtagggtgcaaaataggacgacacatatgaatacgtagatccagggtcaaatagcactgaagcatctctatcacagaccaaaatagtacctgtaataacaacatcggatgactcagcctctggcctggctggcaaagcataacatcggggctgggccccacctccctgaatcacatccctgggacgatcggctgctggctgacccctacctctggcggtctgagctccacctctatgacctctacctccacctctatgtcctctacccccgcctctagctggctgggcaggctgtggagcaactggtgcctgaatcataggacgaggaccctgctgctgagaactacccgaagctcgagggcaaaacctggcaatgtgacccatatcaccacaagtgtaacaagccctcggctgctgagactgctgaccctgtcgcctgaatgaccacctcggaaactctgaagcggcggtgcactgatgggagctggtggtgcactgaaggactgctgatccaaataatgcgtctgagaaccacgaccacctgagataccatgtgatacctggagagctgactgaaagggcctaggaggatggcctctaccatacgaatctctacctccagacgaggtaccactgaatctgcctgaatgacggggcctcttatccgacccatgaccacctccctgtgacagaaccatctcaactctgcgggccacattggccgcctcctgaaatgtgatctcgctcccggcctccttggccatctgaagacgaatcggcagaataagaccatcaataaaccttctcaccctctctctctcggtgggaagtatgatgagagcatggcgagctaaatcgatgaacctggtctcatactgggtaacagtcatagaaccctgctggaggcgctcaaactgcctccgataggcctctctctgagtaacggggagaaacttctctagaaacaacactgtaaactgctcccaagtcaaagatggcgatccggctggtctcgctaagcaataatccctccaccaagtcttggcggatccagacaagcgaaatgtagcaaaatcaaccccattggtctcaacaatacccatgtttctgagaacctcgtggcagctgtctagataatcctggggatcctcagtagatgcaccggcaaaagtagaagtgaagagcttggtgaacctatccagtctccacaaagcatcggcggacatagccgctccatcgccggtctgagctatggcacccggctgaactaccccaactggctgaaccgctggagtctgaatctggggagctacctgctccggagtgcgtgtagcaggagtctgagcccctcctccagcctgagaagtggctggtgctacaggaagcaaacctgttcgggtgactctctccataaggcccaccaatcgaaccagggcgtcctgaagaactggggtggcaatgaaaccctctgggacctgagctgggcccaccggagctgctggagctggaacctcctcatcataatcaacatgaggctccacctctggaactgctgctcggggctgagctctgcccctgcctcggcctctggcacggcctcgccccctctgcccctaataggagctgctactgggggctcgggctgctgcgcggtcgatgaggaagcgcgtgtcctcgccatctgcgaaagaacggagtagaaattcaatcagtattggggaaacagaaccgcacgacaagaaagaacagatgtgaagttttcctaactcagtagcctctgcgggataaatacagacgtctccgtaccgatccctcagactctaccgagcttgtccgtgagttgtgagacctaagtaacctagtgctctgataccaacttgtcacgacccggatttcccaccctcggggtcgtgatggcgcctactaataggagctaggcaagccaacttaaattaccttccgtttaacacacattcttttccataattatcaacatgtaataaaggcaacataattaaaaatttcaagcggaagtcttaacttatataaaaactgaatagaaatgcggaaagtttaacataatcctctacccaagattggtgtcacataacaataggatttgatcgggagctgacttcagtccagagacaccaaggcagccttgctgacgtttgcaggcccgaagtcactctctctttattcagtttgttatcttttgtaccgaaacaaacaatttataattttctttcagacgattgtatttagtaaatcttagaagttcgtgagcattgtgacaccaatcttgggtagaggattatgttaaactttccgcatttctattcagtttttatataagttaagacttccgcttgaaatttttaattatgttgcctttattacatgttgataattatggaaaagaatatgtgttaaacggaaggtaatttaagttggcttgcctagctcctattagtaggcgccatcacgaccccgagggtgggaaatttgggtcgtgacaagttggtatcagagcactaggttacttaggtctcacaactcacggacaagctcagtagagtttgagggattggtacggatacgtctatatttatccctcagaggctactgagttaggaaaacttcacatctgttctttcttgtcgtgcggttctgtttccccaatactgattgaatttctactccgttctttcgcaaatggcgaggacacgcgcttccttatcgaccgagcagcagcccgagcccccagcagcagctcctattaggggcagagggcgaggccatgctagaggccgaggtaggggcagagctcagccccgagcagcagttccagaggtggagcctcatgttgattatgatgaggaggttccagctccagtaactttggtgggcctaactcaggtcccagagggttttattgccaccctagttcttcaggacgccctggttcaattggtgggccttatggagagagtcacccgaatatgttttcttcctgtagcaccagccacttctctggctggaggaggggctcagactccttctacacgcactccggagtaggtagctccccagattcagattccagcggtttagctagttagggtagttcagccgggtgccatagctcagaccggcgatggagcggctatgttcgtcgatgctttgtggagactggataggttcaccaagctcttcacttctacttttgccggtgcatttactgaggatccccaggattatctagaaagcttccacgaggttctgagaaacatgggtattattgagaccaatggggttgattttgctacatttcgcttgtctggatccgccaagacttggtggagggattattgcttagcgagaccagccggatctccatctttgacttgggagcagtttacagtgttgtttctagagaagtttctccccgttacttagagagaggcctatcggaggcactttgagcgcctccagtagggttctatgactgttacccagtatgagaccaggttcaacgatttagctcgccatgctctcatcatacttcccaccgagagagagagggtgagaaggtttattgatggtcttattctgccaattcgtcttcagatggccaaggagggcgggagcgagatcacatttcaggaggcggtcaatgtggcccgcatagttgagatggttatgtcatatggaggtggtcataggtcggataagaggccccgtcattcaggaagattctgtggtattgcgtctggaggtagagattcgtatggtagaggccatcctcctaggctcgttcagtcagctcaccaggtatcacatggtatctcaggtggtcgtggttctcagatgcattatttggatcagtagtctttcagtgcaccaccatctcccatcagtgcaccgccacttcagaatttctgaggtggtcattcagggcaatagggtcagcagtctcagcagccgagggcttgttacacttgtggtgatatgggtcacatttctaagttttacccttgagcttcgggtagttctcaacaacagggtcctcgccttatgattcaggcaccagttgctccatagcctgcccagccagctagaggcgggggtagaggacatagaggtggaggtagaggtcatagaggtggagctcagaccgccagaggtaggggtcagccagcagccgatcgtcccagggttgtgatttagggaggtagggcccaaccccgatgttatgctttgctagccaggccagaggctaagtcatccgatgctgttattacaggtactattttggtctgtgatagagatgcttcagtgctatttgaccctggatctacgtattcacatgtgtcgtcctattttgcaccctacttggttatacgtagtgaggccttgagtattcctgtgtatgtatctacactagtaggtgattctatagtggttgattgggttcatcgttcctgtgttgtggtgtttaggggacttgagacccgtgttgatttgttgctcttagatatggtggattttgacattatattagggatggattggttgtccccgtatcatgcgatcttggattgtcatgccaagattgtgactttagccttatcggattttccccatttagagtggagagggactcctggtcattctacccgtagtgttatttcgtatgtgaaggctcggtgtatggtcgagaaggggtgtttggcctactcagcttatgttcgtgattccagtgctgagattccctctattgattctgtgaccttggttcgtgaatttcctgtggttttcccatcagacttgccaaggatgccacccgatagggatattgatttttgcatcgatttggctccgggcactcagcccatttctattccaccatatcacatgtccctgctagagttgaaagagttgaaagagcagttgcaagacttgcttgagaagggtttcattagacccagcatatcgccttggggtgcgccgactttgtttgtaaagaaaaaggatggctcgatgagaatgtgcattgattaccggcaattgaacaaggttacaattaagaataagtatccactaccgaggattgataatttgttcgatcagcttcagggtgccaaggtattttcaaagattgacttgagatgtggctaccatcagttgaggactagggcatccgatgtccctaagacagcattccgcactcggtacgggcattataagttcttggttatgtcatttgggttgaccaatgcccctgcagcctttatggatttgatgaaccgagtgttcaggacttatttggactcgttcgtgatagtcttcattgatgatattttgatatattcccgcagccgggaggagcacgagcaacatcttagattggttcttcagaccttgaggtatagtcagttatatgctaagttctcgaagtgtgagttctggttgagctcggttgcatttctgggtcacgttgtatcagcagagggtattcaggtgggcccgaagaagatagaggtagtcaagaattagcctcgaccagctttaactacagagattcagagtttcttggggttagaaggttactaccgtcggtttgtggaggggttttcatccattgcagccccgatgaccaggttgacccagaagggagcccagttcagatggccggacgagtgtgaggcgaactttcagaagctcaagaccgctctgactacgacaccggtattggttttgcccgcaggctcagggccttatacagtctattatgatgcatctcgtattggacttgatgcagtgttgatgtaggatggcaaggtcattgcctatgcttcgaggcagttgaaggttcatgagaagaactatcctgtgcatgatttggagttggcagccattgttcacgcattgaagatttggaggcactatctgtatggcgtggcgtgtgaggtgttcacggatcataagcgtctttagtatttgttcaagcaaaaggagttgaatttgaggcagaggaggtggttgaagttgttgaaagattatgacatcactatcctatatcacccgggaaagtccaatgtggtggccgataccttgagtaggaagtcagccagtatggtcagtcttgcttatattccggtcggcgagagacctcttgctttggacgttcaggatttggccaatcagttaatgaggttggatatttctgagcctagtagagtattagctagcacggtcgcccgttcttcgttattagagcgtatccatgatcgacagtttgatgatccccatttgtgtgtccttagggacacggtacagcgtggaggtgccaagaaggttaccttagatgctgatggatttttgagattgcagggtcaagtttgtgtgcctaatgtggatgggcttcgagagttgattttagaggaggcccatagctcccgatactctaatcatccgggcgccgcgaagatgtatcaggacttgcgacagcattattggtggcgtagaatgaagaaggatatcgttgcctatgtggctcggtgtttgaattgtcaacaggttaagtatgagcatcagaggcctggtggtttatttcagaggattgagcttcccgagtggaagtggaagcggatcactatggacttcgttgttgggctcccgcaggctcggaggaagtttgacgcagtttgggtcattgttggtaggctgaccaagtcagcgcatttcattcctgtggcagtctcctattcatccgagaggttagctgatatttatatctgggagattttttgccttcatggtatgccagtatctatcatttcggaccgaggtacgcagtttatctcgcgtttatggaaagcagtccagcgagagttaggcacctaggttgagttgagtacaacatttcgtcctcagacggacgggcagtccgagcggactattcagatattggaggatatgctccgagcttgtgtcattgactttggaggttcgtgggatcagttcttgcctttagcagagtttgcctacaacaacagctaccagtcgagtatccagatggctccttatgaggctttgtattgtaggcgatgtcgatctccggttggatggtttgagccgggagaggctcagttgttgggtacagatttggttcaggaggctttggacaaggtcaggatcattcaggatagacttcgtacaactcagtccaggaaaaagagctacgcagatcgaaaggttcgagatgtggctttcatggttggtgagcgggtattgctccgagtgtcgcctatgaagggcgtgatgagatttgggaagaagggcaagcttagccctaggttcattggtccatttgagattcttgatcgagtgggagaggtggcttatagacttgcattgccaccgagcttatcagccgtacatccagtgtttcatgtgtccatggttcagaaatatcacggcgatccatcccacgtgttagatttcagcactgtccagttggataaggacttatcttatgaggaggagtcggtagctattctagaccggcaggttcgccagttgaggtcgaagagtattcctttggttcatgttcagtggagaggtcagcctcttgaggcatcgacctgggagtccgagtccgatatgcaggaccgttatcctcaccttttccccgactcaggtacttccttcttatgtccgttcgaggacgaacggttgttttagaggtggagaatgtgannnnnnnnnnnnnnnnnnnnnnnnnnnnnnnnnnttccccctttttctgtgcttctgaggtcttgaaaacctcacctttaattgcctcaatttgcgtgcatagtccaggtgcgtagccggaaaagcttatatgttaaattatgtgaaatttgataaattgtggctttaaaatgattaaagttgactttggtcaacattttaggtaaacgggctcggacccgtgatttgacggtcccggagggtccgtagaaaaatatgggactcgggcgtatgcccggaatcgatatccgaggtcccgagcccgagaaatgaatttttaaaagaaattgttttatgaaatttaatatgaaaatttgaaataaaaatgaattagaaagcattggtatcaggcccgtattttggttccggcgcccggtacaggtcttatatgtggtttaaggactttctgtgaaatttggttgaaatcggacgtcatttgacgtgtttcagacctaaaactctaagtttgaaagtttatgaagtttgataaaaaaatgatgattttgaggcttgattcattgattttgatgttattttcacgatttgatcgctcgagtaagttcgtaggatgttattgagttagtgtgtgtgtttggttaggagccccgagggctcgggagtgatttagaggaggttcggggtgtttttggccttaggaagtgttgcagaatttctgtagtcagtgcccagtcattttcttctatgcgatcacataggtatgtctgcgatcacgtagagttattttggagtcgcccagttttgttctatgcgatcgcgttataggacatgcgatcgcgtacctctgcaaactcattttatgcgatcacacactcccttctgcgatcgcaattcacaaaaggcccagccccgctttgaccctctatgcgatcgcaatcgtcatcccgcgatcgcagtgactagcctaccttcctctatgcgatcgcattccctttcccgtgatcgcatagggcaattctgcccagttattttaaaagtccaaaacatacccattacgggagttctaccatttttcataaaacttgtcttctccaagctctaggggtgatttttgaagctcttcttcgtcaaagtcttttgggtaagtaatttcccacctatttccttcactcttcttcattaattactgaaattctaaacctaaatcatgaaatcaaagtagaaattaggggttttgggtagagttaggcttttgggaattttgagtgattcaacctcaatttaaggtcggatcttaaaataaattatatatttgaactcgtggggttatggttaatcgggttttggtccgagcctcgtgtttggaccatgtgggcccggggtcgaattttggtatttttggaagaatgctaggaacttcatatctctacccaaaacccctaatttctactttgatttcatgatttaggtttagaatttcagtaattaatgaagaagagtgaaggaaataggtgggaaattacttacccaaaagactttgatgaagaagagcttcaaaaatcgcccctagagcttggagaagacaagttttatgaaaaatggtagaactcccgtaatgggtctgttttggacttttaaaataactgggcggaattgccctatgcgatcgcaaagggaatggatcggggaaggtaggtcactgcgatcgcgggatgacgagtgcgatcgcatagagggtcaaagcggggctgggccttttgtgaattgcgatcgcagaagggagtgtgcgatcgcatagaatgagtttgcagaggtacgcgatcgcatggcctataacgcgatcgcatagaacaaaactgggcgactccaaaataactctacgcgatcgcagacatacctatgcgatcgcatagaagaaaatgactgggcactgactgcagaaattctgcaacacttcctaaggccaaaaacaccccgaaccgcctccgaatcactcccgagccctcggggctcctaaccaaacacacacactaactcaataacatcctacgaacttactcgagcgatcaaatcgccaaaataacatcaaaatcaatgaatcaagcctcaaaatcatcatttttttatcaaacttcataaactttcaaatttaggaattttaagtccgaaacacgtcaaacgacgtccgatttcaaccaaatttcacagaaagcgcttaaaccacatataagacctgtaccgggcgccggaaccaaaatacgggcccgataccaatgctttctaattcattttcatttcaaatttccaaataaatttcagaaaacaatttcttttaaaaattcatttctcgggctcgggacctcggatttcgattccgggcatacgcccgagtcccatatttttctacggaccctccgggaccgtcaaatcacgggtccgggtccgtttacccaaaatgttgaccaaagtcaactttaaccattttaaagccacaatttatcaaatttcacataatttaacacataagcttttccggctacgcgcccggactgcacacgcaaatcgaggcaactaaaggtgaggttttcaaggcctcgaaagcacggaaaaagggagaaaaccggtgatgaccctttgggtcgtcacattctccacctctaaaacaaccgttcaaaacggacataagaaggaagtacctgagtcggggaaaaggtgaggataacggtcccgcatatcggactcggactcccaggtcgatgcctcaggaggctgacctctccactgaacacgaaccgaaggaaaactcttcgacctcaactggcgaacctgccggtctagaatagctaccggctcctcctcataagataagtccttgtccaactggacagtgctgaaatctaacacgtgggatggatcgccgtgatatttccgaagcatggacacatgaaacactggatgtacggctgataagctcggtggcaatgcaagtctataagccacctctcccactcgatcaagaatctcaaatggaccaatgaacctagggctaagcttgcccttcttcccaaatctcatcacgcccttcataggcgacactcggagcaatacccgctcaccaaccatgaaagccacatctcgaacctttcgatctgcatagctcttttgcctggactgagctgtacgaagtctatcctgaatgatcctgaccttgtccaaagcctcctgaaccaaatctgtacccaacaaccgagcctctcccggctcaaaccatccaaccggagatcgacatcgcctaccatacaaagcctcataaggagccatctggatactcgactggtagctgttgttgtaggcaaactctgctaaaggcaagaactgatcccacgaacctccaaagtcaatgacacaagctcggagcatatcctccaatatctgaatagtccgctcggactgcccgtccgtctgaggatgaaatgttgtactcaactcaacctgggtgcctaactctcgctggactgctttccagaaacgcgaggtaaactgcgtacctcggtccgaaatgatagataccggcacaccatgaaggcgaacaatctcccggatatagatctcagctaacctctcggatgaataggagactgccacaggaatgaaatgcgctgacttggtcagcctatcaacaatgacccaaactgcgtcgaacttcctccgagtctgcgggagcccaacaacgaagtccatagtgatccgctcccacttccactcgggaagctcaatcctctgaaataaaccaccaggcctctgatgctcatacttaacctgctgacaattcaaacaccgagccacataggcaacgatatccttcttcattctacgccaccaataatgctgtcgcaagtcctgatacatcttcgcggcgcccggatgaatagagtaccgggaactatgggcctcctctaaaatcaactctcgaagcccatccacattaggcacacaaactcgaccctgcaatctcaaaactccatcagcatctaaggtaacctgcttggcacctccacgctgtaccgtgtccctaaggacacacaaatggggatcatcaaactgccgatcacggatacgctccataacgaagaacgagcgaccgtgcaagctaatactctactaggctcagaaatatccaacctcacaactgattggccaaagcctgaacgtccaaagcaagcggtctctcaccgaccggaatataagcaagactgcccatactggctgacttcctactcaaggcatcggccaccacattggcctttcccgggtgatataggatagtgatgtcataatctttcaacaactccaaccacctcctctgcctcaaattcaactccttttgcttgaacaaatactgaagactcttatgatccgtgaacacctcacacgccacgccatacagatagtgcctccaaatcttcaatgcgtgaacaatggctgccaactccaaatcatgcactggatagttcttctcatgaaccttcaactgcctcgaagcataggcaatgaccttgccatcctgcatcaacactgcaccaagtccaatacgagatgcatcacaatagactgtataaggccctgaacctgtgggcaaaaccaataccggtgccgtagtcagagctgtcttgagcttctgaaagctcgcctcacactcgtccgaccatctgaactgggcacccttctgggtcaacctggtcatcggggctgcaatagatgagaacccctccacgaaccgacgatagtaacctgctaaccccaagaaactccgaatctctgtagctgatgctggtctaggccagttcttgactgcctcaatcttcttcggatcaacctgaataccctctgctgatacaacatgacccagaaatgcaactgagctcaaccagaactcacacttcgagaacttagcatataactgactatccctcaaggtctgaagaaccactctaagatgctgctcgtgctcctcccggctgcgggaatatatcaaaatatcatcaatgaagactatcacgaacgagtccaaataaggcctgaacactcggttcatcaaatccataaaggctgtggggcattggtcaacccaaatgacataaccaagaactcataatgcccgtaccgagtgcggaatgctgtcttagggacatcggatgccctaatcctcaactgatggtagccagatctcaagtcaatctttgaaaataccttggcaccctgaagctgatcgaacaaatcatcaatcctcggcagtggatacttattcttaattgtaaccttgttcaattgccggtaatcaatgcacattctcatcgagccatcctttttctttacaaacagaaccggcgcaccccaaggcgatacgctgggtctaatgaaacccttctcaagcaagtcttgcaactgctctttcaactctttcaactctggcggggccatgcgatatggcggaatagaaatgggctgagtgcccggagccaaatcgatgcaaaaatcaatatccctatcgggtggcatccctggcaagtctgatgggaaaacctcaggaaactcacgaaccacgggcacagaatcaatagagggaatctcagcactggaatcacgaacataagccaagtaggccaaacaccccttctcgaccatacgccgagccttcacatacgaaataacactgcgggtagaatgaccaggagtccctctccactctaaacggggcaaatccggtaaggctaaagtcacagtcttggcatgacaatccaagatcgcatgatacggggacaaccaatccatccctaatataacgtcgaaatccaccatatctaagagcaacaaatcaacacgggtctcaagtcccctaaacaccacaacacaggaacgatgaacccgatcaaccactatagaatcacccactggtgtagatacatacacaggaatactcaaggcctcactaggcataaccaggtagggtgcaaaataggacgacacatatgaatacgtagatccagggtcaaatagcactgaagcatctctatcacagaccaaaatagtacctgtaataacagcatcggatgactcagcctctggcctggctggcaaagcataacatcggggctgggccccacctccctgaatcacatccctgggacgatcggctgctggctgacccctacctctggcggtctgagctccacctctatgacctctacctccacctctatgtcctctacccccgcctctagctggctgggcaggctgtggagcaactggtgcctgaatcataggacgaggaccctgctgctgagaactacccgaagctcgagggcaaaacctggcaatgtgacccatatcaccacaagtgtaacaagccctcggctgctgagactgctgaccctgtcgccctgaatgaccacctcggaaactctgaagcggcggtgcactgatgggagctggtggtgcactgaaggactgctgatccaaataatgcgtctgagaaccacgaccacctgagataccatgtgatacctggagagctgactgaaagggcctaggaggatggcctctaccatacgaatctctacctccagacgaggtaccactgaatctgcctgaatgacggggcctcttatccgacccatgaccacctccctgtgacagaaccatctcaactctgcgggccacattggccgcctcctgaaatgtgatctcgctcccggcctccttggccatctgaagacgaatcggcagaataagaccatcaataaaccttctcaccctctctctctcggtgggaagtatgatgagagcatggcgagctaaatcgatgaacctggtctcatactgggtaacagtcatagaaccctgctggaggcgctcaaactgcctccgataggcctctctctgagtaacggggagaaacttctctagaaacaacactgtaaactgctcccaagtcaaagatggcgatccggctggtctcgctaagcaataatccctccaccaagtcttggcggatccagacaagcgaaatgtagcaaaatcaaccccattggtctcaacaatacccatgtttctgagaacctcgtggcagctgtctagataatcctggggatcctcagtagatgcaccggcaaaagtagaagtgaagagcttggtgaacctatccagtctccacaaagcatcggcggacatagccgctccatcgccggtctgagctatggcacccggctgaactacccaactggctgaaccgctggagtctgaatctggggagctacctgctccggagtgcgtgtagcaggagtctgagcccctcctccagcctgagaagtggctggtgctacaggaagcaaacctgttcgggtgactctctccataaggcccaccaatcgaaccagggcgtcctgaagaactggggtggcaatgaaaccctctgggacctgagctgggcccaccggagctgctggagctggaacctcctcatcataatcaacatgaggctccacctctggaactgctgctcggggctgagctctgcccctgcctcggcctctgggcctcggcctcgccctctgcccctaataggagctgctgctgggggctcgggctgctgcgcggtcgatgaggaagcgcgtgtcctcgccatctgcgaaagaacggagtagaaattcaatcagtattggggaaacagaaccgcacgacaagaaagaacagatgtgaagttttcctaactcagtagcctctgcgggataaatacagacgtctccgtaccgatccctcagactctaccgagcttgtccgtgagttgtgagacctaagtaacctagtgctctgataccaacttgtcacgacccggatttcccaccatcgggagtcgtgatggcgcctactattggagctaggccagccaagtattaaaacatttctgataacattcgcaacaatataaacaaaacgagacaattaaataaaagcggaagtcttaacttactagaaaactgaataaatgcggaaagtttaacataatcctctacccaagattggtgtcacaatgctcacgaacttctaagatttactaaatacaatcgtctgaaagaaaattataaactgtttgtttcggtacaaaagataacaaactgaataaagagagagagagactccgggcctgcggacgtcagcaaggctacctcggtgtctctggactgaagtcagctcccgatcaaatcctactgctgaggtccaaaagctgctcctggatctgtgcaaaaagatgcacagagtgtagcatcagcacaaccgaccccatgtgctggtaagtgcctggcctaaccccggcgaagtagtgacgaggctagacaggacctaccaaaaacaacctgtgcagatatatgcaataaaaggaaatatacagaatttaaacagctaagaggggggagcatgctatggggagctaacagtttcaaatagaaatcctcaataacagaaagaagtaacaaagccagaatgtcaacaagaatcaaaaatcaacaatttgcacggcatcacccttcgtgcttttactctcgtcctcaccaaaacaatacacggcatcacccttcgtgctttacgctcttcctcacccaaacaacaatcacaaggcaaatagggtaaggaaatctataacctcgaagtaaatcaaataagaacaagtaatgaaagaaacaacataactcggatatcaacaaagaatcagaaagcaacaaatgcacggcatcacccttcgtgcttttactctcgtcctcaccaaagcaatcatataaataaaatatgcacgacacccttcgtgcttttactctctttcctcaccatataatcaataaaatcggcacggaatggtacatcgtgcggcacacatcacccttcgtgctttacactctttcctcacaatagcaaacaatgcacgacatcacccttcgtgctttatcactcttcctcacccaagcaacaatcacaaacaaggggcaagggagtagacaaataatgatagaaatcccggcaagggaatacaaataaacagctaactcccggcaagggagcacaattaagcagttaaaaacccggcaagggaacaatatcaataatctcagcatcccggcaagggagatagtcaacaaagcaacaagcatcccggcaagggagcaattcaataattctttctctttctttcacttttacctcttatctcactttaccacctgagccaacgctccaaaggggttcaatcatttcatatactttcacgctttatgatatactcgagccaatgctccaagaatgtacaaatcataattcttcctcaaactcttcacattatatgaaatttatcaatttaacaaggaagaggtatcacaaaatccgaataaactgaattataaaggaaaggcggtatttgagggttgattgctattctttggaccgatgtaagtgtttgttctaactttgacttgagggaataggattaaagtgttgtttgctatttgctaattgttgagtacggtgtataggcatggtgacgagtatctatacaccgaagtctagcatgaccgtgagtcttattccgactccgaaacaacgatatctaggcataattaattcaataatatcaataaagactcgataacaaaatcccatagcttagatatgaagttcctagcattcttccaaaaataccaaaattcgaccccgggcccacatggtccaaacacgaggttcggaccaaaaccatatcacccattcatccacgagcccgaatatataattttttcaaattcgaccccaaaacgaggtccaaatcaagaaaaagtaaaaagccctaactctacccactcccccaatttctaccctaaattacatgttttaggccaagaaattcaatagatgttgatgaaaatggaagagaataagttaaagattactaacccaagagtttatggtgaaagaatgcttcaaagatcgccctagaactttggagaagaaagagtttgtgaaattttgtaagaatcccgtaaggctactgttctggattttaaaatttaactgggcgaatttggcctatgcgatcgcggacaaaggagtgcgatcgcatagagtaaatgggacagggctctgcgatcgcgaatgacactatgcgatcgcataaaggaaatagtgaaggctggctaacacactgcgatcgcagaggaaataatgcgatcgcgtagagcaaaatataggacctctcaggctaactactaactatgcgatcgcatagaacaaactaaaaccctgaaaatttacactatgcgatcgcggacatagctatgcgatcgcatagcacaaaagactggacaccagcagacagcagttctgcaatttttctaagtctaaaaccattccgaaacaaacacccgagccctcggggctcctaaccaaacacatgcactaactcaacaacatcatacgaacttatccgtgcgatcaaatcgcctaaataacttcaaaaacaatgaatcaaacctcaaaatcaagagtttttctcaaacttcatcaagtttcaaatttaggaattcaagtccgaatcacgtcaaacgacgtccgatttcaaccaaatttcacagaaagcgcttaaaccacatataagacctgtaccgggcgccggaaccaaaatacgggcccgataccaatgctttctaattcatttttatttcaaattttcatattaaatttcagaaaacaatttcttttaaaaattcatttctcgggctcgggacctcggatttcgattccgggcatacgcccgagtcccatatttttctacggaccctccgggaccgtcaaatcacgggtccgggtccgtttacccaaaatgttgaccaaagtcaactttaaccattttaaagccacaatttatcaaatttcacataatttaacacataagcttttccggctacgcgcccggactgcgcacgcaaatcgaggcaactaaaggtgaggttttcaaggcctcggaagcacgaaaaagggagaaaaccggtgatgaccctttgggtcgtcacattctccacctctaaaacaaccgttcgtcctcgaacggacataagaaggaagtacctgagtcggggaaaaggtgaggataacggtcccgcatatcggactcggactcccaggtcgatgcctcaggaggctgacctctccactgaacacgaaccgaaggaaaactcttcgacctcaactggcgaacctgccggtctagaatagctaccggctcctcctcataagataagtccttgtccaactggacagtgctgaaatctaacacgtgggatggatcgccgtgatatttccgaagcatggacacatgaaacactggatgtacggctgataagctcggtggcaatgcaagtctataagccacctctcccactcgatcaagaatctcaaatggaccaatgaacctagggctaagcttgcccttcttcccaaatctcatcacgcccttcataggcgacactcggagcaatacccgctcaccaaccatgaaagccacatctcgaacctttcgatctgcatagctcttttgcctggactgagctgtacgaagcctatcctgaatgatcctgaccttgtccaagcctcctgaaccaaatctgtacccaacaaccgagcctctcccggctcaaaccatccaaccggagatcgacatcgcctaccatacaaagcctcataaggagccatctggatactcgactggtagctgttgttgtaggcaaactctgctaaaggcaagaactgatcccacgaacctccaaagtcaatgacacaagctcggagcatatcctccaatatctgaatagtccgctcggactgcccgtccgtctgaggatgaaatgttgtactcaactcaacctgggtgcctaactctcgctgactgctttccagaaacgcgaggtaaactgcgtacctcggtccgaaatgatagataccggcacaccatgaaggcgaacaatctcccggatatagatctcagctaacctctcggatgaataggagactgccacaggaatgaaatgcgctgacttggtcagcctatcaacaatgacccaaactgcgtcgaacttcctccgagtctgcgggagcccaacaacgaagtccatagtgatcacttccactccaaaaataaaccaccaggcctctgatgctcatacttaacctgctgacaattcaaacaccgagccacataggcaacgatatccttcttcattctacgccaccaataatgctgccgcaagtcctgatacatcttcgcggcgcccggatgaatagagtaccgggagctatgggcctcctctaaaatcaactctcgaagcccatccacattaggcacacaaactcgaccctgcaatctcaaaactccatcagcatctaaggtaacctgcttggcacctccacgctgtaccgtgtctctaaggacacacaaatggggatcatcaaactgccgatcacggatacgctccaataacgaagaacgagcgaccgtgcaagctaatactctactaggctcagaaatatccaacctcactaactgattggccaaagcctgaacgtccaaagcaagcggtctctcaccgaccggaatataagcaagactgcccatactggctgacttcctactcaaggcatcggccaccacattggcctttcccgggtgatataggatagtgatgtcataatctttcaacaactccaaccacctcctctgcctcaaattcaactccttttgcttgaacaaatactgaagactcttatgatccgtgaacacctcacacgccacgccatacagatagtgcctccaaatcttcaatgcgtgaacaatggctgccaactccaaatcatgcactggatagttcttctcatgaaccttcaactgcctcgaagcataggcaatgaccttgccatcctgcatcaacactgcaccaagtccaatacgagatgcatcacaatagactgtataaggccctgaacctgtgggcaaaaccaataccggtgccgtagtcagagctgtcttgagcttctgaaagctcgcctcacactcgtccgaccatctgaactgggctcccttctgggtcaacctggtcatcggggctgcaatagatgagaacccctccacgaaccgacgatagtaacctgctaaccccaagaaactccgaatctctaggctgatgctggtctaggccagttcttgactgcctcaatcttctttggatcaacctgaataccctctgctgatacaacatgacccagaaatgcaactgagctcaaccagaactcacacttcgagaacttagcatataactgactatccctcaaggtctgaagaaccactctaagatgctgctcgtgctcctcccggctgcgggaatatatcaaaatatcatcaatgaagactatcacgaacgagtccaaataaggcctgaacactcggttcatcaaatccataaaggctgctggggcattggtcaacccaaatgacataaccaagaactcataatgcccgtaccgagtgcggaatgctgtcttagggacatcggatgccctaatcctcaactgatggtagccagatctcaagtcaatctttgaaaataccttggcaccctgaagctgatcgaacaaatcatcaatcctcggcagtggatacttattcttaattgtaaccttgttcaattgccggtaatcaatgcacattctcatcgagccatcctttttctttacaaacagaaccggcgcaccccaaggcgatacgctgggtctaatgaaacccttctcaagcaagtcttgcaactgctctttcaactctttcaactctggcggggccatgcgatatggcggaatagaaatgggctgagtgcccggagccaaatcgatgcaaaaatcaatatccctatcgggtggcatccctggcaagtctgatgggaaaacctcaggaaactcacgaaccacgggcacagaatcaatagagggaatctcagcactggaatcacgaacataagccaagtaggccaaacaccccttctcgaccatacgccttcacatagaaataacaggggagtctccctctccactctaaggggcaaatccggtaaggctaaagtcacagtcttggcatgacaatccaagatcgcatgatacggggacaaccaatccatccctaatataacgtcgaaatccaccatatctaagagcaacaaatcaacacgggtctcaagtcccctaaacaccacaacacaggaacgatgaacccgatcaaccactatagaatcacccactggtgtagatacatacacaggaatactcaaggcctcactaggcataaccaggtagggtgcaaaataggacgacacatatgaatacgtagatccagggtcaaatagcactgaagcatctctatcacagaccaaaatagtacctgtaataacaacatcggatgactcagcctctggcctggctggcaaagcataacatcggggctgggccccacctccctgaatcacatccctgggacgatcggctgctggctgacccctacctctggcggtctgagctccacctctatgacctctacctccacctctatgtcctctacccccgcctctagctggctgggcaggctgtggagcaactggtgcctgaatcataggacgaggaccctgctgctgagaactacccgaagctcgagggcaaaacctggcaatgtgacccatatcaccacaagtgtaacaagccctcggctgctgagactgctgaccctgtcgcctgaatgaccacctcggaaactctgaagcggcggtgcactgatgggagctggtggtgcactgaaggactgctgatccaaataatgcgtctgagaaccacgaccacctgagataccatgtgatacctggagagctgactgaaagggcctaggaggatggcctctaccatacgaatctctacctccagacgaggtaccactgaatctgcctgaatgacggggcctcttatccgacccatgaccacctccctgtgacagaaccatctcaactctgcgggccacattggccgcctcctgaaatgtgatctcgctcccggcctccttggccatctgaagacgaatcggcagaataagaccatcaataaaccttctcaccctctctctctcggtgggaagtatgatgagagcatggcgagctaaatcgatgaacctggtctcatactgggtaacagtcatagaaccctgctggaggcgctcaaactgcctccgataggcctctctctgagtaacggggagaaacttctctagaaacaacactgtaaactgctcccaagtcaaagatggcgatccggctggtctcgctaagcaataatccctccaccaagtcttggcggatccagacaagcgaaatgtagcaaaatcaaccccattggtctcaacaatacccatgtttctgagaacctcgtggcagctgtctagataatcctggggatcctcagtagatgcaccggcaaaagtagaagtgaagagcttggtgaacctatccagtctccacaaagcatcggcggacatagccgctccatcgccggtctgagctatggcacccggctgaactaccccaactggctgaaccgctggagtctgaatctggggagctacctgctccggagtgcgtgtagcaggagtctgagcccctcctccagcctgagaagtggctggtgctacaggaagcaaacctgttcgggtgactctctccataaggcccaccaatcgaaccagggcgtcctgaagaactggggtggcaatgaaaccctctgggacctgagctgggcccaccggagctgctggagctggaacctcctcatcataatcaacatgaggctccacctctggaactgctgctcggggctgagctctgcccctgcctcggcctctggcacggcctcgccccctctgcccctaataggagctgctactgggggctcgggctgctgcgcggtcgatgaggaagcgcgtgtcctcgccatctgcgaaagaacggagtagaaattcaatcagtattggggaaacagaaccgcacgacaagaaagaacagatgtgaagttttcctaactcagtagcctctgcgggataaatacagacgtctccgtaccgatccctcagactctaccgagcttgtccgtgagttgtgagacctaagtaacctagtgctctgataccaacttgtcacgacccggatttcccaccctcggggtcgtgatggcgcctactaataggagctaggcaagccaacttaaattaccttccgtttaacacacattcttttccataattatcaacatgtaataaaggcaacataattaaaaatttcaagcggaagtcttaacttatataaaaactgaatagaaatgcggaaagtttaacataatcctctacccaagattggtgtcacaatgctcacgaacttctaagatttactaaatacaatcgtctgaaagaaaattataaactgtttgtttcggtacaaaagataacaaactgaataaagagagagagactccgggcctgcggacgtcagcaaggctacctcggtgtctctggactgaagtcagctcccgatcaaatcctactgctgaggtccaaaagctgctcctggatctgtgcaaaaagatgcacagagtgtagcatcagcacaaccgaccccatgtgctggtaagtgcctggcctaaccccggcgaagtagtgacgaggctagacaggacctaccaaaaacaacctgtgcagatatatgcaataaaaggaaatatacagaatttaaacagctaagaggggggagcatgctatggggagctaacagtttcaaatagaaatcctcaataacagaaagaagtaacaaagccagaatgtcaacaagaatcaaaagtcaacaatttgcacggcatcacccttcgtgctttacgctcttcctcacccaaacaacaatcacaaggcaaatagggtaaggaaatctataacctcgaagtaaatcaaataagaacaagtaatgaaagaaacaacataactcggatatcaacaaagaatcagaaagcaacaaatgcacggcatcacccttcgtgcttttactctcgtcctcaccaaagcaatcatataaatgaaatatgcacggcatcacccttcgtgcttttactctctttcctcaccatatcaatcaatcacggcatcacccttcgtgctttacactcaatttcatcacatcagtgctttacactctttcctcacaatagcaaacaatgcacggcatcacccttcgtgctttatcactcttcctcacccaagcaacaatcacaaacaaggggcaagggagtagacaaataatgatagaaatcccggcaagggaatacaaataaacagctaactcccggcaagggagcacaattaagcagttaaaaacccggcaagggaacaatatcaataatctcaggcaagggtcaacaatagcatcccggcaagtgatacctcttccttgttaaattcataactttcatataatgtgaagagtttgaggaagaattatgatttgtacatttttggagcgttggctcgagtatatcataaagtgtgaaagtataatgattgaacccctttggagcattggctcaggtggtaaagtgagataagaggtaaaaatagaaagaaagagaaagaattattgaattgctcccttgccgggatgcttgttgctttgttgactatctcccttcccaggatgcttgttgctttgttgactatataccttgccagaatgcttgttgctttgttgactatctcccttgccggaatgctgatattattgatattgttcccttgtcgggtttttttaactgcttaattgtgctcccttgccgggagttagctgtttatttgtattcccttgccgggatttctatcattatttatctactcccttgccccttgtttgtgattgttgcttgggtgaggaagagtgataaagcatgaagggtgatgtcatgcattgtttgctattgtgaggaaagactgtaaaacacgaagggtgatgtcatgccgcacgatgtaccactcggtgccgattttattgattatatggttaggaaagagagtaaaagcacgaaggatgatgctgtgtatatttcatttatatgattgctttggtgaggacgagagcgtaaagcacgaagggtgatgcagcgtatttgttgctttttgattctttgttgatattcgagttatgttgtttctttcattacttgttcttatttggtttacttcgaggttatagatttatttaacctatttgccttgtgattgttgtttgggtgaggaagagcgtaaagcacgaagggtgatgccgtgtattattttggtgaggacgagagtaaaagcacgaagggtgatgccgtgcaaattgttgacttttgattcttgttgacattctggctttgttacttctttcagttattaaggatttccatttgaaactggtagctccccatagcatgctcccctctcttagttgtttaaattctgtatatttccttttattgcatatatctgcacaggttgtttttggtaggtcctgtctagcctcatcactacttcgtcgaggttaggccagacacttaccaacacatggggtcggttgtgctgatgttacatctgtgcatctttttgcacagttccaggagcagcttttggacctcagcagtaggatttgatcgggagctgacttgagtccacagacaccgaggtagccttactgatgtccgcaggcccggagtctctctctctctctattcagtttgttatattttgtaccgaaataaacagtttataatttactttcagatgattgtatttagtaaatcttagaagttcgtgagcattgtgacaccaatcttggatagaggattatgttaaactttccacatttctattaagtttttatataagttaagacttccgcttgaaattttaattatgttgcctctattacatgttgataattatggaaaggaatgtgtgttaaacggaaggtaatttaagttggcttgcctagctcctattagtaggtgccatcacgaccccgatggtgggaaattcgggtcgtaactttgtgattttactttctcaagcaattcaatatcttctagagcttgatgtgacctattgatgtttttggtggtgacataacttcttttatcatgtttgaagaaaaattattaaatgagataaagtggttgtaagatggttaattagagtaaaataacaatggacgaggaacataatctcgttacctatactcaatcataaaaataagaaagaattttacctcttcccttttttttgtaccagcaagtgaagctccaaggcaagctttgtatagacaaaaagagaagaaaacttgttatgctttaggaaccactttcttcttactgttaccaagtagttatgctctaggaactctttctttttactgtaccatgtaagaatatttatagaagataaatggccatccagttccctctgcaagcaaaaaaacttgaaagtacctaacttatttaactaaattctggagccaaagcgaagcctaacttactgactaaaatcattgggaatacagtttggtgttgaatttattaaacatctcctaatgctgaacttgatcatccatctcctgtaacatgcatattcacagaaagaggcttctatgaatgctacaataatatctatgaatactacaataatatatgaaaattataatgatcgaacagtcggattaagcatctacttaactgatataagaaaaataaagtatattaattagaagaaattcaaggcaatattcagttactcatcgtgaaagacctttgctatgaggctttatttagcttggactttatgccaattactatttctttttatcctttttctctttttttatatttaagtagatttagaatatatacttttcaacaccaaatctcattagattctgacattagcttctaatcctctatcatacttttcttaatcaagagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctgatgaaaattactaaccctttatcccacttttcttaatgagatttagaatatttttcgacaacataactcgtaagatttcaatagaaagatcaaattatttcttctacaaaaaattgtgaaacttctaaatctgagcaggtaaggaggacagggcactgctaaaacttttctcaaaccagggtcggctccatagtgatgagaggtaaaggcatgtgccttaggcccccaaatttgggggtcccattttaaaaaaataataagttcataagtattttaaaaataatatttaatatttttaatacaaaaatagagtatttaatataaaagaaaagaaaactttttagatatataaatgaggtaataatttgacttacttaaaaataggtagatgaatactttttccaattttttactttttcactttttacttctttaaaaatttgctctctcttccttaatttgtccaagtcactctttcttttttctaatctcttcatatctcggaaaatcctatatattttctgtctttctatgtgatattcttactcactttctttcttcaagatttcattactcacctttttctcaaagatgtcattagttcaagtgttcaacaatacttttaagttttcaatagttctatacttctattgctctgtaaaatctcatctaatatcagcaatatctcaagaaagattaaataagctagttatgttatcaattgaacatgaactattagagaaaatcgattataaaagaattattaacaattttgtatctcaaaaagttagaagaataaacttcaaataaaaagatatcttataacttttttttaaaaaaaaattaggcctcatattaaactatggctttaggccccgtatgtgcttgagctgcccctgcctcaaacatcaaaacaccaatccattaaaagtctataaaagatattaaaagaagcaacattggactacatgaaaatcttaaaattgttctactatatcaaagcacaattaacctcaaactctcaaagaatctgaagatatctctgatttattttgataaaaattgtctataatgagacacatccacaataaaaacacaaatctagcaaaaaattacaactaattacatttgttcttattaacaataatgcacaaaaatgtagacaacatataagtcaaaagcatgagtatgatgaattaattttggtagtaacaattatatttaacccataaaatttatcttacgctggatgaaaaaatacaacaaaatatgcgaattgagttcaccttggcgtgtgaaactaacaaaacctaaggtgaattagtggagaatacatcatgtagttctgcaactgattttgtaggagaaccaaaaacaaattaacaaaaaggatgtactccaagttgcttcaataattgtgacgacccggatttctcaccctcgggagtcgtgatggcgcctactaatgtgagctaggcaagccgactgtttgaactaattacctttttaccccttttatattctttaacaattttaaagcaataaagtgtagacaacggaatttacaataagcggaagaaaagcaatgaactatctaaatatgtatccaatacaaccgcttgaacctcgactacccagaactggtgtcacagtttcacagacggtctaagaatactatatacaaagtctgaaagataaaagatacactgattctgaaataagtaaaggaaacaggataaagaaaagataggaggtgatgccaaggcccgcggacgtttgcaggactacctcgggtcacctgtgtgaactgaagacagcaccctcactacggtccaagcgctccggaatcagtatctgcacacagtgtagagtgtagtataagcacaaccgaccccatgtgctggtaagtgcctagcctaacctcggcgaagtagtgacgaggctaggaccagactaccaaataaacctgtgcagttaaatcatatacaacggaaatataaaagcagataattacatttaaagatgggagggggaaacatgtttcggggaataacagacaacaacagaatatcaagaggaatataaataaaccaaaatccaattactaacaaggataaggaaaacaaatgcagaattcactttcatttcacatcttgttgtaggcgtgcaacccgatcccatttcatatatctcgttgcaggcatgcaacccgatcccatttcatatatctcattacaggtgtacaacccgctcccatttcatatatcttgttgcaagcatgcaaccccttcctatttcatatatttccgtggtggcgtgccacccgatcccatttacaaatcaataataatcacaaaagaatcctggcaagggaacaagagcaatatagcatcatcccaacaagggaacaataatattttaacaacatcctggtaaggaaacaataatatcaaaacaaacatcccggcaagggaacaataataataataacatccgggaaagggaacaatattggtaatcctcatatgaaatacaataaaccacaacgtgtcataacaattacaatacaagactcacgggcatgcttgacaccaacgtatagatactcgtcaccatgcctatatgtcgtactccacagttacctcatagaaaataagacacgactcctaatccttcaagctaaggttagacaaaacacttaactcgatgccacgaacacaattcaagtctcaattattgctttacctcttgatcccaccaccaattcgctcgtatctagccacaagttacttaattacgtcaataaatgctaaatgaattaattctaatgtatgaaaataagttttccaaaggtttacccaaaaagtcaaaaatcgctctcggacccacatggtcaaaattcgaggttcgaaccaaaacccggctacccattcccctaagaacccaaatatataatttgttttaaaatcggacctaaaattgaggttcaaatccccaatttttaaaaaatctaggttctaccaaaaacacctaattttccccatgaaaattattgattttgagttgaaatcatgtgaaaagatgttaacgattgaagaaaacgacttaaaattgacttacaatcgatttggaagaagagttgtctttgaaaattgcccaagggtgttttggttttgaaagactgtgaaaaatgaaagattttcggctaagttataaaattggaggttgcagatgttgcaattgcgacaagtgttcgcaattgcgaacccagacttctgctaagctcacatttgcgaagtggccctcgcatttgtgaggttggaattgtgaacatacaatcgcatttgcgataacaggcccaaatggggagtatcgcatttgcgaaggaaaaatctcgcatttgcgaagaagggctagcctgagatgtttcgcatttgcgactcagcctttgcatttgcgaaggaaaaatctcgcatttgcgaagaagggctatcctgggatgtttcgcatttgcgatgcgaagcctgcaggcctgcaatgaaacagctgaagcctgcaatttctcaagtccaaaatccaccccgtggcgtatccaaaactcacccgacccctcgggactccaaaccaaacatgtacaccaacctaaaaacatcatacggacttgcttgtgcattcaaatcaccaaaagaacgtcaacaactacgaatttagcatcaaaatcataaaatttcttaagaacatcaaatttcccaatttcctcaaataaggtccgattcatatcatatcaagtccgtttcttaccaaatttcacaggttcgactcaaatcatatataagacctataccggggtccggaacctaaatacgggcccgatactatcaaactttaaacacatttcactttcaaaaactcataaatattccagaaaataattttcttcaaaaattcaatgctcgggcttgggacctcagaattcgattttgggcattcgcccacgtcccatattttcctacggaccctccaggaccgtttacccaaaatgttgacagaagtcaacttaaatccattttaaagtcaaaattcatcatttttcacagattttcacataatggctttccgactacgcgatcggactgcgcacacaaatcgaggcaagacaaaaagaggtttttaaggccgcagaacacataattcatttttaaaacaagtgatgacccaaaaggtctacattctccacctctaaaacaaccgttcaccctcgaacggacataagaaggaagtacctgagtcagagaaaagatggggataacgccttcgcatatcggactcggactcccaggtcgatgcctcagcaggttgacctctccactgaacacaaatagagggaaaactcttcgatctcaactgacaaacctgccggtctaggatagctaccggctcttcctcataagacaagtccttgtccaactcacagtgccgaaatctaacacgtgagatgtatcaccgtgatacttccgaagcatggacacatgaaacactggatgcacggctgataagctcggtggcaacgcaagactataatccacctctcccactcgatcaagaatctcaaacgggccaatgaacctagggctaagcttgcccttcttcccaaatctcatcacgctcttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgaccatgaatgccaaatctcgaaccttacgatcggtataacttttttgcctggactgagctgtatgaagcctatcctgaatgattctgaccttgtccaaagcatcctgtactagatacttacccaataaccgagcttcccctggctcgaaccatctaaccggcgaccgacaccgcctaccatacaaagcctcataaggagccatctggatactctactagtagttgttgttgtaggcaaactctgctaaaggcaaaaactgatcccacgagcctccaaagtcaattacacaagcttggagcatatcctccaaaatctgaatagtccgctcggactgcccgtctgtatgaggatgaaacattgtgctcaactcaacccgtatgctcatctctcgctgaaatgctctccagaaataggaggtaaattgcgtacctcagtatgaaatgatagacatgggcacaccatgaagacgaactatctcccagatatagatctcagctaacctgtcggaagaaaaggagactgccacaggaatgaaatgtgctgacttggtcagcctatcaacaataacccatactgcgtcgaacttcctccgagtttgtcggagtccaacaatgaaatccatagtgatccgctcccatttccactcgggaatctcaatcttctagaacaaaccaccaggtctctaatgctcgtacttaacctgctgacaattcaaacaccgagccacatatgcaacgatgtccttcttcattctcctccaccaataatgttgttgtaaatcctgaaacatcttagcggcacctggatgaattgagtacctggagctatgggcctcctctaaaatcaactatcgaagcccatctacattaggcacacaaacttgaccctgcaatctcaaaactccatcatcccgtaaggtaacttgcttggcacctccgtgctgcaccgtgtctctaaggacacataaatgaggatcatcatattgccgatctcggataagctccaacaaagaaaaatgagcgactgtgcaagctaacacacggctggggtcagcaacatccaacctcatgaactggttggccaaagcctgaacatccaaagcaagcggtctctcactgaccggaatataagcaagattgcccatactggctgacttcctactcaaagcatcggccaccacattggcctttcccggatgatataagatggtgatatcatagtctttcaacagctccaaccaccttctctacctcaaagttatctccttctgcttgaacaagtactgtagactcttgtgatccgtgaacacctcacatgccattccatatagataatgcctccaaatcttcaatgcgtgaacaatggctgccaactccaaatcatgaaccggatagttcttctcatgaatcttcannnnnnnnnnnnnnnnnnnnnnnnnnnnnnnnnnnnnnnnnnnnnnnnnnnnnnttgtcgcgaaacataggtgatgaccttgccatcctgcatcaacaccgcaccaagtccaacacgagatgcatcagaataaactgtataaggccctgaacctgtgggcaaaaccaacactagtgccatagtcaaaatgtcttgagcttctgaaagcttgactcacactcgtcagaccatctaaattgggcacctttctgggtcaacctggtcattggggctacaatagacgagaacccctccacaaaccaatgttaatagcctgccaatcccaagaaactccgaatctctggagctgatgctggtctacgctagtttttgactgcctcaatattcttcggatcaacctgaataccctctgcggatacaacatgacccaggaatgcaactgaactcaaccaaaactcgcacttcgaaaacatggcatacaactgactatccctcaaagtctaaacaaccactctaatatgttgctcatactcctcctggctacgggaatagatcaaaatatcatcaatgaagactatcacgaacgaatccaagtaaggcctgaacattcggtccaccaaatccgtaaaagttgctggggcatttgtcaacccgaatgacattaccaagaactcataatgcatgtaccgagtgtggaaagttatcttagggacatcggatgccctaatactcaactgattgtagccagatctcaagtcaatcttcaaaaataccttggcaccatgaagttgatcaaacaaatcatcaattctcggcaatggatacttattcttgattgtaaccatgttcaactgccggtaatcaattcacattcttatcaatccgtccttcttcttaaaaaacaccaccggcgcaccccaaggcgagacactaggtctaatgaagcctttttcaagcaagtcttgcaactgctccttcaactctttcaactcaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggtagaaataggctgagtgctcggagccaaatcaatgcataagtcaatatccttgtcgggtagcatacccggcaggtctaaaggaaatacctcagggaactcacgaacagcaggcacaaaatcaatagaaggaacctcagcactagaatcatgaacataggccaaataggccaaacaccccttctcgaccacacaccaagcctttacataagagataacactacgggtagaatgaccaggagtccctctccactctaaacgaggtaaacccgacaaggctaaggtcatagtctaggcatgacagtccaagatagcatggtaaggtgataaccagtccatccccaatatgacatcaaaatcaaccatgtccagcagaagcaaatctatacgagtctcaatacccccaatcacaactatacatgaatgatgtactcgatctaccgcaatagaatcacttaccggtgtagacacataaacaggagcactcaaagaatcattaggcatgaccagatacagtgcaaaataagatgacacataggagtatgtagatcctggataaataaaactgaagcatctctgctacaaactagaacagtacctgtgataattgcatcggaagccacaacctcgggcttggctggaagagcataacatcgggactgagccccaccaccctgaactacatctctgggatggcctgctactggctggcctccacctctagctacctgacctccacctctaatacctctacctccacctctaatacctctacctccacctctagcacctctaaccctacccctagctggtggagcaggcggttaaacacctggtgctagaaccatagtacgggaaccctgctgctgagaactgctcggtgctagagggcaatatctagcaatgtgcctcgtgtcgccacaagtaaaacaagcccctcgactgcttggtctgatgacactggaaactctgaagcggcgatgcagtgataggagttggtggtgcactataggactgttgatcagaatactgcatatgagaactacaactatctgaagcaccgtaagaaacttgaagtgctgactaaaaaggcctaggacgatggcctctaccatacgaatccttaccttcagacgaggtaccactgaatctgcctgaatgatgaggcctcttgtcagacccctgaccgcctccctacgatagaactatctcaactctcctggccacattggccacctcctaaaaagaaatgtcactccctatctcctaggccatctgaagtcgaataggctggataagtccctcaataaacctccttactctctctctctctctcggtgagaagtatgataagagaataacgtgccaagtcgatgaatatggtctcatactgagtaacaatcatagaaccctgctggagatgctcaaactgcctccgatagatctctctctgagtgatagggagaaaagtctccagaaatagctgagaaaactgctcccaagtcaaagctggcggtccggctggtctagccaagaaataatctctctaccaagtcttggcggatccagacgagcgaaaagtagcaaagtcgaccccaacagtctccattgtcaccatgttccgaagaacctcgtgacatctgcctaaatgatcctagggatcctcaaaagatgcaccgctgaaagtagtagtaaagagcttggtgaaacttatccaacctccacaaagcctctgaagacgtagctgatctatcacagatctgtgctgcttctcggctgaagaagaggtacgtgacctcgccattcgcgaaaggacaagagtaaagatttcgatttagcattgagagaacaaaaattgcatgacaggaaagaatagaagtgaagctttttcctaactttgtagcctctggggataaatacagacgtctccgtactgatcccttagactctactaagcttgtctgtgaactgttagacccatgtaacctagagctttgataccaacttgtcacgacccagatttcccaccatcgggagtcgtgatggcgcctactaacgtgagctaggcaatccgactatttgaaccaattacctttttaccccttttatattctttaacaattttaaatcaataacgtgtagacaacaaaatttacaataagcggaagaaaagaaatgaactatttgaatatgtatccaaaacaaatgcttgaacatagactacctagaactggtgtcacagtttcatagatggtctaaaaatactacataaaaagtctgaaagataaaagatacaatgtttttgaaataagtaaaagaaacaggataaagaaaagataggaggtgacgccaagccccgtggacgtctgtacaactacctcgggtcgcctgtgtggattgaagatagcaccctcaacgcggtccaatcactctggtatcagtatctgcatacagtgcagagtgtagtatcagcacaaccgaccccatctgctggtaagtgcctagcctaacctcggcgaagtagtgacgaggctaggaccagactaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagcgtgtgcagttaaatcatattcagcggaaatataaaagcagaaaattacagttaaagatgggagggggaaaaaatgcttcggggaataacagacaacaacagaacatcaagaggaatataaagtaaccaaaatccaattactaacaaggataaggaaaacaaatgtagaattcactttcatttcacatcttgttgcaggcgtgcaacacgatcccatttcatatatctcgttgcaggcgtgtaacccgatcccatttcatatatctcgttgcaggcgtgcaacccgatcccatttcatatatctcgttacaggcgtgtaacccactccattttatatatctcgttgcaggagtgcaacccgatcccatttaatatatctcgttgcaggcgtgcaacccgctcccatttcatatatctcgtttcaagcgtacaacccactcacatttcatatatctcgctgcaggcttgcaacctgctcccatttcatatatcttattgcaggcatgcaacccactcccatttcatatattttcgtggcgacgtgccacacgatcccatttacaaatcaagaacaatcacaaaagaatcccggcaagggaacaagagaaatataacaacatcccgacaagagaacaataatatcaaaacaaacatcccggtaaaggaacaataatatgacaataacatcccggcaagggaataataatgataataacatcccgccaagggaacaataatgataatcctcatatgaaacgcaatataccacaacgtgtcataacaattacaatacaagactcacgggcaagcttgacaccgacgtatagatagtcgtcaccatgcctatacgtcgtactccacaattatcacgtagcaaataaggcacgactcctaatccatcaagctaaggttaggcaaaacacttacctcgatgccacgaacacaattcaagtctcaattattgctttacctcttgattacaccaccaattcgctcgtatctagccacaagttacttaattacgtcaataaatgctaaatgaatcaattctaatgcatgaaaataagttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttacccaaaaagtcaaaaatcgccctcgggcccacatagtcaaaatccgaggttcgaaccaaaacccgactacccattctcctaagaacccaaatatataatttatattaaaatcggacctcaaatcgaggtccaaattcccaatttttaaaaaccctaggttctacccaaaacacccaattttcgccataaaaatcattgattttgagttgaaatcatatgaaaagatgttaatgattaaagaaaccgagttaaaattgacttacaatcgatttggaaaagagttgtctttgaaaaatcacccaagggtgttttggttttgagagagtgtgaaaaatgaaagattttcggctaagttatgcaattgcaggttgcagatgtcgaaattgcgaccagggttcgcaattgcgaacacagacttctgctaagctcgaattggccaagtgaccctcgcatttgcgaggtcggaattgcgaacatacaatcacatttgcgataacaggcccaaatggggagtatcgcatttgcgaaggaaaaatctcgcatttgcgaggaaaggctggcctgggatgttttgcatttgcgagtcaggcttcgcaatgcgaagcctgcaagcctgcaatgaaacagctgaagcctgcaatttctcaagtccaaaatccaccctatggcgtatccaaaactcacccgagcccttggggctccaaaccaaacatgcacaccaacctaaaacatcatacatacttgcttgtacattcaaatcactaaaagaacgtcaacaactatgaatttaacatcaaaatcatgaaatttcttaagaacatcaaatttcccaatttcctcaaattaggtccgattcatatcatttcaagtccgtttcttaccaaatttcacaggttcgactcaaattatatataagacctataccggggcccggaactaaaatacgatcctgatactatcaaactttaaacacatttcactgtcaaaaactcataaatattccagaaaataattttcttcaaaaattcatttcttgagcttaggaccttggaattcgattccgggccttcgcccaagtcccatattttcctacggaccctccgggaccgtcaaattacgggtccgggtccgtttacccaaaatggtgaccaaagtcaacttaaatccattttaaagtcaaaattcattatttttcacagattttcacataatgactttacgactacgggcccggactgcgcacgcaaatcgagccaagacagaaagagttttttaaggcctcgaaacatagaattcatttttaaaacaagtgatgataggtcatcacaataacaaacaaaagtcaataacattagctagactccacaaactttaattgaaaaacattagagctaattccagcaaagtttgacatccgcaacagggaaacaaaatgaaaatcttttactacctatggaattgagaattcgttatgatagtaatcttgagaataaactaaagaagttattgttcagttcctttcttgaagtttagaaatatcactattgatatgttgccatatcagattcaattttgttaggcagcagttccctgatgcaccttcttatcagctacgtcggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttgatatatttagctaaagaaaagaaataatgtcttaaatattaatatgttaggatttttttatcaacttcaagaaacaatattatttaccttgagattctccgatatgatctacgatgagtttatatctttgcatcctgagtggatgcaaggtgatagaagaactattatcccaatataatgtaggtgcttcctaccacgggaaatcataaagtaggacgcaaaaagaaggcaattaggaagcttttgggagagactatatctattcaaaattcagaggaaatagtcaaactcaactgaacaattgaaaagagaaactcggtagtggctaattatctaaagttctttctgaagtaatgcggataccaagcatacaaaatttataagtacaaaaattacctgtctttttcccctttagttctttttggttttcatttcttcttactctgttttctcctcctcttttccagccacctcttttactatcagccatgctcggattctcccactaacattgttccctccacccattttattttaattttattcaatttcttttagtttttttcacttgattcctcaagcatagtctattttttaaatttattttatccaaaaaatattcatgaaggttacatttgaaactcttcacactctttaacaggaggcaaaatattttttcataagtgctaaaaccaataaaaaaaaagttaatagtgctactgatatttagtattagttttgtattcacataatagaaacatccaaaatagaatagatgtcttggcgacatctactattgatcttaccaaatttaccgaagtgaaataaaaaggaacacattagtgtttaatcattcatatatcttctgatatggcatgtgaagagctcaagccatgctgtatctagaataatatcattataatcatgaggctacaataaaattgaaagcttactgggcaatcaatccaatggaaaatccacatcaaacgaaaacatttgaaaccataagcatgtgcaaaatgtgataaaagtcatatgtgcacttgcaggaatattttctccttttattcaaggagtcaatatatccatgctcgtgaattcctttatcttatcaaaaattgcagacaaataaaaataaacttctaggtatttttgtcttttatttaaatttttcctaattttattatcctgcacctcaagcaatatgaacgaattttcctactcaagcgctccattttggatgtagaggaaactaattctaagttttcataataatagtcagaaaaatcagaaggattttaagatagttgtactggataaagaatagctaaagctctgactacattagaggttattacgaacattgtatctgaagaattcacatgataatcaagcttcataagctcaagtttggctaaccaagaattctaaactaaaaatactaaacaggacttacatattatatattcttgttcgtggttctagtttcagcatcacccatatagtttcaggttttataattgcttcttccatttcttgttcaactatgattggaaacttcatttccttttatttctttcacccgcacttgttggaaacatatgttcctttttcaacataagataaaccaaaaagtctggcatgcatgttgtcataatttctccatattgattttttaaaattgaatttgaaacaattggtcctacagtttgtcacgaccccggttcgcgctccgtgaactatcgtgatgacacctagtctctacgacgaggtaagcctaaaatgcggaagataaaccaaatttgcggaagaaaataatttaaaacagaaatagagtaataaaatagtgtttaaaagtgtcgctcggcatacacaatattaactcttaaaaccaataaattttcccaaaacccggaaacccatgaatcacaagctaagagatacataagaagctctaactccaaaaatgtctaaccaaaaatggaatactgaagggctatactattacagaaagatagaaagggactcctcagtttggggacgcggaagatatacctcgaaatctctacagaagcgcctcgcctcaaggatgataagacagagtggaagtatctggatctgcacatgaaaacatatgcagaaggggcatgagtacaccacaacggtactcagtaaatgccaagcctaacctcggtcgggtagtgacgaggaaggtcagggccctactgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaacgataactagaacagagacaaaataatcacgaaaaggaaatacaactcaagacagagataacaaccggggtaccctccaggataccgtcctgtagtcccaattacatctaaccagtggatctcccgggatactgtctcgtagtccatcatatgtatttgaacgatctctcgggatcccgtctcgtagtctaactatcagtgcgtggggatctatcgaaattccgatccgtagtcccaaatataaatacccagtactggaagaatctaccatgtgcagtctcgtagttccatataactgtgcagggggatctaccggaatctcacatccgtagtcccaattaaacaaacaagggagatctactgacatcccacatccatagtcccaaataaacagacaaaggggataatccacatccgtagtcccaaataaacagacaagggggatctatcggaatcccatatccgtagtcccaatgtaaatacacagcagcaaaaggaaaatattcagaaatggcaaatttcatattaaggcaaacaagtaattctagcctagcatgctgcacagaattcaggtaaggcagtttgnnnnnnnnnnnnnnnnnnnnnnnnnnnnnnnnnnnnnnnnnnnnnnnnnnnnnnnnnnnnncaagtcacttagacatgctttcctaagctaacagcaggcttaatagtgcaagtaataaaaaacaggaaagaaatcatactagtaattacttaataaaaatcgaatttacaacaattagcacaagtatacactcgtcacttcacgtacaaggcatttcaattatcaaatacaccaaatcctaagggaaggtcccccacacaaggttagacaagccacttacctcgaaccggctcaataatcaatatgaaaccatgctcttggcatgagtactcgactctaaatgacccaaatctattcaattcaatatcataacgtaaataacacttcaagtaattgattctacaaagaaattctaagctaatacgcgaaattaagtaaaatgaccaaaacgtcactcgggcccacatcttggaatcgggtaaaatttatattttcagaaacctcgtaccctcacgagtctatacataacaagaatattgaaatcatagttcaattgacccctcaaatacccatgttaaggtctcttaatctcaagccctaattactcattttttccaaatttctcaccaccaattaggtctttaatcacatataaacgagttgtgaaatcaaaaatattacctccaagtgattcccgttgaatccctctttaatccccttcaaaaagcttcaaaatcgcccaaaaatggaggaacttaggctcaaaatcacggaataggcattttaaatcattctgccgaggcatttaaattcttcttcgcggacgcggtcaaagcctggcgttcgcgaagcacaaattgacgttgaccacttttccttcttcacaaatgcatccccttattcgcgaacgcgaaggctcagcttcccagctcatcgcgaacgcgtagttcaaagaccctagctcttcgtgaacgcgggacctccatcacgaacgtgaagtccataccttcagctccacatcctaacccttcgcgaatgcgagggtccattcgcgaatgcgaagaacaactggtctgcaacacacatagtagttttctgcaacttcaaacatcatgaaatggtccaattgaccacccgaaactcacccgaggccaccaagacctcaaccaaacttaccaacatatttcataacttcattcaaacttgttccaaccttcagaacacacaaaacaacatcaaaacacctatttttcatcggattcaaggctaagaattccaaaaactctaaaaatatgctttcgatcaaaaagtctatcaaacctcgtccgaatgacctgaaattttgcacatacgtcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacactacggagctattccaacttctggaattacattctgaccctcagatcaaaatttcactatcgaaccggaaacttcaaaattcgacctttctacatttcaagcctaaattagctacagacctctaaaacacaatccgaacacgcccctaagcccgaaatcacccaacgaagctaacgaaaccattagatttcccttctgatgtcatctttgcactgttctgactacggtaaactttccaacacttaagctcttatttagggactaagtgtcccaaaactcttcgaaactcaaaaccgaacatcccgacaaatataaatagcagaaataaattcggggaaagcagttaatagcggatcagggcgttaattcttaacacgaccggccggatcgtcacacagttgttcttggacatgcttaacacacataatcttcattgaagatgaaacaattcaagttctttagatataaagagtaggagaagaaagctataaagagcatacatcgaaaataagaatactttgattccccaaagtattaattatatcccccaattggaagataccaaaaaatctcaaagtagctaaagaaattcaaagccctgctctgcagaactagtttgactactaaattaagtcagaaatatgaaaaagaattgatcaaccaattaaagatgaatattttatccatcaaactaacatcatctacagatgaagtagccatgaataagcaacctccccaacatgcctcaatatctcaaaagggcaaataaacctcagactcaacttctctttcttcccaaatctcataacgccctttataagagaaacccgaagcagaacccgctctccaaccatataggaaacaacactaaccttccggtctgcgtaactcttctgtctggactgggatgtacgaagtctatcctgaatcaccttaatcttctccaaagcatcgtgaactaagtttgtgcccaataatctagcctcacccagctcaaaccagcccaccggggatctacaccgcctaccatataaagccccatacaatgccatctaaatgctggactgatagctgttgttgtaagcaaactccgccaatagcaagaattgatcccaagaccctctaaactcaatcacacatgtatagagcatatcctcaagaatctgaatagtgcggtcggagtgtccgtccgtctgagggtgaaatgttgtactcaaccccacccgagtacccaactcatgttgaatggacctccagaaccgtcatgtgaactatgtacctttatctgaaatgatggatattagaataccatgcagacgaacaatctctcggatataaatctttgccaaccgctccaaagaataagtagtacacacaggaatgaaatgagtggacttggtcagccgatccacaatcacccaaataacatcgaactttctcaaagtccgtgggagcccaactacaaagtccatggtgatctgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactttcactccgcaatctctatctgctgaagcaacccactcgatctctggtgctcatacttcacctactgacagttgagacaccgaactacgaatccaactatatctttcttcatacgcctccaccaatattgctgcctcaaatcctgatacatcttcgcggcacccggatgaatggaataccgcgaactctaggcctcctccagaatcaactcccgaagcccttcaacattgggtacacaaatacggccctacatcctcattaccccatcatcaccaatagtcacatctcttgcatcaccgtgctgaaccttgtccttgaggacaagcaaatgagggtcatcatactgacgttccctgatacaatcaaataaggaagaccgagaaaccacgcaatgtagaacccgactgggcttcaaaagatccaatctcacaaactggctggctaaggcttgaacatccatcgccataggcctctccgatgctggtaaataagcaaaactccctgcccaacgactcaaagcatcggccaccatattggccttgcctggtgatacaaaatagtgatatcatagtccttcagcaactctaaccacctcatcaggcacaaatttagatccttttgcttgaacatgtgctgcaagctccgatggtcagtctaaatctcacagggaaccccgtataaataatggcgccagatctttagggaatgaacaatggaagctaactcaaggtcgtggacagggtaattcctctcatgtaccttcaactgtctggacgcgtaggcaatcaccctaccatgctgcatcaacaccgctccaaggacaatcctcgaggcatcacaataaaccgtataagaccccaaacctataggcagtatcaaaattggggctgtggtcaaagctatcttgagcttctgaaagctcgcctcacactcctccatccactggaatggagcacccttttgggtaaacctggtcatgggggctgcaatcgatgaaaatacttccacaaaatgatggtagtaacccgccaagccaaggaaactgtggatctctatagctgaggatggtctggtccaactctgcacgacctctattttcctcggatccacctgaataccctcactcgataccacatggcctaggaatgccacggagtccaaccaaaactcacatttccagaacttagcatataacttctcctctcttagagtctgaagcatagtccttaggtgctgctcatgatcttcccgacaccgggaatacactagaatatcatcaataaagacaatgatgaacgattcaagatacaaccggaacacactgtgcatcaaatgcataaaggctacgggggcattggtcagcccaaatgacataacaaagaactcgtaatgactataccgagtcctgaaagcagtcttcgtgatatctggctcccgaatcttcaactgatggtaacctgagcgcaagtcaatcttagaaaacacccgtgcgccctgaagctggtcaaacagatcatcaatacaaggcaaaggataacggttcttcactgtaactttgttcaactagcgataatcaatacacatacgcatagaaccatcatttttcttaacaaacatgataggagcaccctaaggtgatacactaggccaaataaaacccttatcaagcaattcctgtaactgatccttcaactccttcaactcaggaggatccatgcaatacggaggaatataaatgggttgagtgcccggcaacatatcaatgccaaaatcaatatctctatcaagcggcatgcttggaagatcagctggaaacacatcgggaaaatcccgtactactgggactgaatcaactgaaggggtatcaatactgacatctctcacataagctaaatacgtgtcacacaccttctcaaccatatgctgagatttaagaaaagaaataaccctactgggagtgtgatctaaagtacccctccactcaacacgcggtacacctggcatagccagcgttatggttttggcgtgacaatcaagaatagcataatgaggcgacaaccagtccatgcccaagataacgtcaaaatctatcatactgagcaataataaatcggctctggtcccaaaaccactaagagcaaccaaacacgaccgataaatgcggtccacaataagagaatctcccataagagtagaaacgtaaaaaagaaaactcaaagaatcttgaggtacacccaaatgcggagcaaaataagaagacacataagagaaagtggagcctggatcgaatagaaccgatgcatctttgtgacaaaccagtataatacttgtgatgacagaatcagaggcaacaacctccgtacgtgtaggaagggcataatatctggcctggcctccccctctagggcgaactctaactccccgacctccacctctagctggctgggcaggtggggtagcaactggagctgtaaccatatcctgagaactctgcagggcacgctgtggctgagaagtctgtggaggtgcacccctcccaagtctggggcaatccctcaccatatggcgtgtgtcaccacactcannnnnnnnnnnnnnnnnnnnnnnnnnnnnnnnnnnnnnnnnnnnnnnnnnnnnnnnnnnnnnnnnnttgggaagacgtgggggctgtgactggctcaggctaggactgctggactgacctctgaaagcaccccgtagaggaggcgcgctagaaatcggaggtgcataataaggctcctgaggcctaggaggagctggaccactattggctgctgcaagagctgaatgaactcatataacccctaccatgatgacctgcagttggggcacgggcaccagaataatggcccgactctcgagacctcttggcctccctctcctctctttccctagcatgcataccctcaatcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgataaggaaaatccatctccaactcacgagccatgctagacctgatactaggaataagtagctcaataaactggtgaaccctctcgcgaacagtagaaaccaaggctggtgcatgtctagccaagctagtgtaacggacatcatactctgagatagtcatagcacccaggcgaaaatgctaaaactcagtgcgccacgcatctttgaggctttgaggaacaaactctattaagaatagatctaaaaactgggtccaagtcagcaaagaagcctcgtccggactgtctaactcataggtgtgccaccactcataggcggctcctcgaatttggaaagtagtgaaggaagccccgctcgattctgatatacccatggtacgaagaatgcggtatcactcctccagaaatcccaaggcatcatatgattctaacccactaaatacgggaggatcatacttcttgaacctctcaagtctccgctgctcatcctccgaagtcgatgccctatcctcgggttggcctggggctacaagaataatctctaggacctgatcaacgtgcactcgctgctcaggagtgcgggcagcaggagtctgtgctcctcccccggcctgagatatggctgcagcaagggaaagcaaccctgcctgagccaaagaggtgtacatgctcatgaactgcgctagagtctcctgaagtgctggagtagtagtagcaatatgcgtatcaggtgcctggactccagctggaactgctggtggtacctcggcggtagctcgcgcaggtgctctggctacaccacatgcgcgtcctcgacctcttccccggccccgaccctgacctctaacgactgcagtaggggcgcgagtgcctggtcatctcgggtagcacgtgtactcaccatgtgtgagagaatataagacaaaagtttagaattgtgatgtcaaaatatcgcacgacaaggaaatccaatgaagtggaaattttcctaacagtgacatagcctctcatagataagtacaggcatctccgtaccgatcagcgagactctaataaaccggcttgtgatccatgactcctatgaacctagagctctgataccaacttgtcacgacnnnnnnnnnnnnnnnnnnnnnnnnnnnnnnnnnnnnnnnnnnnnnnnnnnnnntcgttcgtaaaccattgtgacgacacctagtctctacgattaggtaagcctaaaatgtggaagataaaccaaatttgtggaagaaaataatttaaaacagaaatagagtaataaaacaacgtttaaaagtgtcgctcgacatacacaatattaactcttaaaaccaatacattttcccaaaacccgggaacccatgaatcacaatctaagagataaataagaatctctaactctagaaatgtctaaccaaaaggggaatactgaagggctatactattatatcaagatagaaagggactcctcggtctgcggacataacaaatatatctcgaagtctctacagaagcgcctcgcctcaaggatgataagacagagtaaaagtacttggatctgcacatgaaaaacatgcgcagaagaggcatgagtacaccacagcggtacttagtaagtgccaagcctaacctcggtctggtagtgacgagaaaggtcagggccctactgagtttaaataaaatataaggtataacagtgtataataagacagtataattaagtgcaacagtaagaaataacatagaatagaaagaataacaacaacaactagaacagagacaaaataatcacggaaaggaaatacaactcaagagagagataacaaccggggtaccttccaggataccgtcttgtagtcccaattacatctatccagtggatctcctgggataccgtcccgtagtccatcatatgtatccaaaagatctctcgggatcccgtcccgtagtccaactatcagtgcgcggggatctaccggaatcccgatccatagtcccaaatataaatacctagtactgggagaatctgccatgtgcagtcccgtagttccatataactatgtagagggatctaccagaatcacacatccgtagtcccaattaaacagacaagggagatctaccggaaacccacatctataatcccaaataaatagacaagggggatctaccggaatctcacatccgtagtcccaaataaacagacaagggggatctaccggaaccccacatccgtagtcccaatgtaaatacacagcagcaacaggaaaatattcagaaatgacaaatttcatattaaggcaaacaagtaattctagcctagcatgctgcacagaattcaggtaagacagtttgagcaagtaaagcaattaagtcacttagacatgctttcctaagctaacaacaggcttaataatgcaagtaataaaaatagaaaagaaaacatactagtaattacttaatgaaaaacaaatttacaacaattagcacaagtacgcactcgtcacctcacgtacaaggtatttcaataaccaaatataccaaatcctaagggaatgtcccccacacaaggttagacaagtcacttacctcaaagcggctcaataatcaatcctaaaccacgctcttgccacgagtactcgactccaaatgacccaaatctattcaattcaatttcataacgtaaataacacttcaagtaactgannnnnnnnnnnnnnnnnnnnnnnnnnnnnnnnnnnnnnnnnnnnnnnnnnnnnnnnnnnnnnnnnnnnnnnnnnnnnaatttacattttcagaaacctcgtaccctcacgagtctatacataacaagaacactgaaatcagagttcaattgaccccctaaatacccatgttaaggtctcttaatctcaagccctaattacccatttttcccaaattcttcaccaccaattaggtctttaatcacatataacgagttatgaagtcaaaaatattacctccaagtgattcctcttgaatccctctttaatccccttcaaaaagcttcaaaatcgcccaaaatggaggaacttaggctcaaaaccgcggaataggccttctaaattattctgccaggtatttaaatccttcttcgcgaacacggtcaaagactggcgttcgcgaagcacaaattgacgttgaccacttttccttcttcgcgaacgcgcccctttattcgcgaacgtgaaggctcagcttcccagcccatcgcgaacgcgactcccttctcgcgaacgcgtagttcaaagacctcatcccttcgcgaacgcgggacctccatcgcgaatgcgagggtccacttatgaacgcaaagagctactggtctgcaacacacacatcagttttctgcaacttcaaacatcatgaaatggctcgattgaccacccgaaactcactcgaggcccccaggacctcaaccaaacctaccaacatattccataacttcattcaaacttgttcgaaccttcggaacgctcaaaacaacttcaaaacacctatttttcattggattcaagcttaagaatttcaaaaactctaaaaatatgctttcgatcaaaaagtctatcaaatccaacggagcacacacgtcacattaaacactacggagctactccaacttctggaattccattccgaccctcagatcaaaatctcactatcgaaccggaaacttcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttacctttcggcacttcaagcctaaattagctacggacctccaaaatacaatccgaacacgcccgtaaaacaaaatcacccaacggagctaaggaatcatcggatttccattccgaggccgtctttgcattgttccgactacggtcaactttccaacacttaaactctcatttaggaactaagtgtcccaaaactctccgaaactcaaaaccgaacatctcggcaaatcaaattagtagaaataaactcggggaaagcagttaataggggatcggggcattaattgttaatacgaccggccagatcgtcacacagttgttcttggacatgcttaacgcatataatcttcattgaagatgaaacaattcaagttctttagatataaagagtaggagaagaaatctataaagagcatacataaaaaataagaatactttgattccccaaagtattaattatatcccccaattggaagctgccaaaaaatctcaaagtagctaaagaaatgcaaagccctgcagaacttgtttgactactaaattaagtcagaaatataaaaaagaattgatcaaccaataaaagatgaatattttagccatcaaactagaatcatctaccgatgaagtagccatgattaattctaaatttataggtactgaaattttagtagacaatatgtataattggttgaatatataccttgacgaaaattgttgggtagatttcttaagctgtcattgaaagcaacttttctccaagatcaccagaaattgtagcgattgttaactcactttcatcagtaagatcaatttggaataattactcacgggacaaagtaaaaataatcactcacatgaacaatataccactgaaactactttctaaagaacatcattttagcatcgactctagtccttcgagaaattgaaaaaaaaaacatacagttaactcgccgaatcaaattacaaaaggaattatacagagttaaagaaagtaagttgatggtttccaataattgaatggctggttcttcaacagtaagcaactgaattacaaaaacaaactcaatccatacaacataaataataacacatattaatagcataaaaatctcaattaatgttacacactcaaccatcattcgtttctcccaaattctagcaagtctaactaataggtcaataaagatgggaagaaatcaccagcaaaataaatctcctaaagattactgatctgtgaggattgaatcacatgcataaaatataagttagagacgcaaaatgtaatcagggaaaacaatcttcaatctctgttgcactaaggatcaaataccagacatgtatgagaatatcagaccaaattactgacatgcatgtagaaaatccaacaataaactaccaaaaagaacccaaaaagggagtgagacagaatgagagagagagagagaatataggaaactaacatacatccagcagatagcgattagcaacgaaaaaggtgcaacaaacaataaaacagatgcaaagaaaaactcaccaaaacaaagttcacactttgaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagagaatcagaaaatatttgagaaactctcaaaaaggagaaacggatcagttagatagagaagtaaaagaaaaggggataggattcgacaatgaccatggtagagtatcaaaacaagcaagacgcgtgtttatagcgtatcagtaaaagtctttagaactaatattataagtattaccaatttaaccttagaagagttcgcaatgctaagagtacaacgcttaaaactttttgtacaaccacctagagcagtgttcgtcctttcaaactctcatttctaaatagtagaaaaatactagtatctacttcatggaaaaaaaaaaaacataaatgatcactagagataatacatttgaactccaaagaaaatggacataatcagtaacagaataaaaatactccataaaatatctaaatttcctaagaaaaaacttaaaaaatatatttaaaaaaatatacattgaaaacatattaaaaataggaaaaatagttttaaaaaacagaaaacatacctctaagaaggaggaggaccggtcgaaatgaagacgaaaggggtttttgccttttattttccgacgatcgatgacttattatcgccaaatataattattttaagaaatttagtgaaagtcgagtgattttgtgtttagaaaaataagtttaggattttcgtgcaattataaactgagtgactgtgtaattaacccttttgtaagagttgaactctctgaagatataagtgtgtgtatttatttccctcttacatcctccaaaatgataatgtaagatgagcataaggacaactttcacctaattgtgactgaaatatgtaggagctgcctgtactgtagtaagtccatatgctagctattgataatgttaggatccgaaactcaggtagtgcggaatttagccaaataatattataatgtcaataataaagacaatgtaagttgataacaacgacaaaaaaaagataccaatttaatatggttcagtcagtgtgacctacgtccacaagcgaagaagagcaatttcaccataccaataagagtacaaaattagaataaatactctaattaatcccaaatacccgaagagaataacccactagatcactccaaagaaagggttcacataaatatttcctaacacttaactctcatacaaaatactcttaataactaaaggaggagaagaagaaacaagaaatgaagactcaagtcttgttggtgtgtctaaaatgaactaatggtctttggttttgtaggcaaaaaagccttggcctccaaggtgtaagagaaaagatacagcttgtgcaaatgatatctattacacaatgcaatatttttgggtcccaaagaatattatcaacaaggtctactttgcaaatatacttatgcttatgtgagatggagttcactaaccaaaatattggttatattacaaataataaaccacaaaaggaattccaacaattaaaaaatcttttatatatatgatgagagacaaaggaaaggaaaggaaatgatgagattccaatgttcgtactgcaataacatctgaaaaaaggaaatcaatacatgtcaaagttgaactctatataggagttttaggctaagaacgggaaaaaaaggagaattttagaaacagtaataagaaaaatgtaaaaagagaaagaaggatcaaattactatttacagctaattagaatattacatgtagtatcagcacaaagaattaagtaatataaagaaactagtctgtgaaatcgtttcagtgaactgcttcttggatcttggaaaatacagcttaattcctggtactagacggaattcaaacgcgttctttgacgtaatcgtagagatctgcaataagaaagaaaagccaataactcctattatattctttaattttccaacaaaattaattatattcttggtggaaaaactaaataaagtgttacttatataggatgccaaagtatgagaaagggaagggagcctataaaatatgaacatatatacagttgaggagaaaataaaggaaagtgaaaaacaacaattaattctgaaagtcgttaccttcatatatatatatgcgaagagcaagacaatcacttcccgccatggcagctacttcctcctgaatttctctggctgaatccacaattagaccgcatttatacaactcaattgactccaaggtgtatgtatctgcaaaggctataggaattcgcctaagaatcttgattttctccaatacgaggcgttgaagatttggaaagttaacattggtagcctcccagagttgtgtctctgtgtcatcaagtagaaggaactttagctgcttgaactcatcttcctcctttaatttccatacctcacctctgaatgcatgacatctaagtttgagtagttggagatttggtaacttggcaagatttgccatgtcttcccagggaagccaacttccagatagggtcaatctctttagcgatattgggaaacaacatttagccagagagagttcccttcatcaaaggaacactctaatactcggagtttattcaagtagagcaggctccaacatgtttcctctaatgctttgtatttttccccgatatcatagatacgtaatttctttagatgaggaaggccaagaaatacctcttttgtacagctagcaagacagagactggaaagctcctgcagatgttgcagacccaactcgtctaccacatatgggttgggcaaataagtgctaccatgtagacggagatgcctcagctgcttcatattccagatatggttaggtaaagttaaaattccacgccactccagattgtgatgaacaaaactaaaggtttgcaggttatgcatatattcaagtgattcagtaaaatgattgtctatgtgaatctcaagatagctgaatctaaggtcatgcgacgcctgaagatgaaatgatacctaggaatggcagccaacaccctcaaagctttgaattccaatggttttcctattgttttatgaggttccttgaaaagatacaagcaacgcaaaaattttgctgacttggtaaagttttcccctgaaatgcgtgtatgcaaactaaagcgaggagtctcataatgaaaattaggaatttgattagttctaaacacatccggaagcgctcacatccccaacaagtcatgcatacggcaaatttttgatccggccattgagtttcccccttttgaccattattaaatttctgctagccagatcttccaaacaatcctctgccactttttccaggcttctcagcttatccctcttcagaaaaccctctgcaacccacagacgaattaaccgccaagcatcaatctcagaatcctcagggaatgctcccatatggaggaaacaaggtttgaggtgaataggcaggtgatggtaactgatcgcaagcactgctatgcattcattcggataacttgtaacaacttcattcacattttcagatacagttacccagttttccctttttggggaaatcctagagagatgcccagcaaccaccaaaattgctagaggcagtccctggcatttttgtactattttcttcccgatatcttctaattcagaatgacaattaatgtggcttttccccaacaacttattctgaagtaacttccaactctcatctacccctaacggcagcacttcaagaggagggatatcagggttagcatactcagccacatcttttagcctcgtagtcagaatgattcgacttccattattgtcatcaggaagggttctcgcaatcaaatcccaaatctttgtactccaaatatcatcaactacgataagatacttccgacccttaagtgctttatatgactggtccattaactggtcatcactcattccctgaaactcgtatcctgtaaggctacgtgcaaggcttggcaacacttcgtttaagtgatattcttgagatatagtaacccacgtttggatgtcaaaatgtgatctaattgattgatcatcttgagcctttttagcaagtgtggtattgccacatccacccattcccaaaataggaatgacgttctgctcagaagctaatccaagtagtgcatcagtgagttttctcaaggaattcgccaaaccgactgtatcatcatcatcatcatcatcacctagaagggaagtaggagcaaggtttgaagaagaaccagctaccagagaatgtccctttttgaagaaatgatcctcatcatcaggggggccaaggcaacgagcataggtttcagtggagaaggagttaatccgcctcacctatttctttacagcatcaatcttgtctaccgcttgaggcaagactcgaagaagaacccctacttcatcctgaaaagtctcgtcaatattattctcttcttgttgcctccatcattctctcataatttccgcaacatttgattcaagcacatcttcagcttggtgcatcgctgatcttatctctgcctcaaaatatttgaatgtatcatattcctgtttctggtggctagcgttctcaagaatattttgaaaatattcagcactggcatggagagagtcaatcatctctgcagtttgaccatggatcaatgctggataagtcttttggaatagctccaaagtttgaattaaagagttcactgcaggataagccattactttcaattactcagtgggagagaaatgctttcaagatttactataagctctttcgaaacttatactagctagctagcacttaattttcagatcagcttggtcaaacagcaatttggaaagccaaatgggtgttcatggaggatggttctattttcaacattagtgcaaaagaagcctatttaaactaattagtgcaaaataagtctacttaaactaataagcgaaagagaagtggccttctatttaaaaattaaaataaattgatctatttaaactaaccagcgcatgcaagagaagtttacttaaactagaagtctatttaattacgacaaatggccaaatatacctttgtactgtaacaaaaaatttaaatataccctttgttataatttggatccaaataatactattgattctaatatactcctcttcttttaaaaatgttcaaggtggacattcaatcctacgtgacactgatatttgatgaggtggatgacacatgacataccacctcagcgcccataatccatatataaaagactaaaatttgaaatacaatattttttatggtagcgataatggtagcaatggtggtgggggggaggaaattttagtggtgaaaacaaaataggaggggtaaaatgggttaggggcgctgaggtggcaagccatatgacatccgcctcatcaaatatcagtgccacataggattggatgtccactttggacaaacttaacagaaaaacagtatatttgaaccaatagcataacgatatgggtatatttggactcaaagtataaagacagggtatatttggactcaaagtataacgagaggtacatttaagagcccgaaaccaaagtgtggtctttttggagtcaaacaaccaaaataggtgaaaaaaataacggattaccattttatatatagcggggttattcacggcgctataccttaacgacacgtttatccgaaaagcttttatgtgaaaatatgagatatagaaatttctagagttaaaatttgaatatggttgactttggtcaacattttgagcaaacggacccggatctgtgttctgacggtcctgggaggtccgcagtaaaatatgaaacttgggcgtatgcccggaaatgaattccgaggtcccaagccttagaaataagtttttgaaaaaaattattttgctgaattatttatgaaataaagaaaagaattaatgattgaaaccattggtatcgggcccgtattttggttccgtagccctgtacaaacttgttaaagtatttaaatgataattgtgaaatttggtgaaaaatggagttatttgacgtgatttggacctcaggttgaagagttatgaactttaagtgttcttgatgaaaatgatgagttttgaggattaatacatagttttacatgttattttcatgatttgattgcatgagtaagtccgtatgatgtttttggattagtgtgcatgtttggtttggagccccgagggctcgggtgagttttggataggccatagagtgaaatttggacttaggaagttgcaggttttagctggtatgttgtaggtctgcaggcttcgcaaatgcgataatcgacctgggctaccttagtcgcaaatgcgattgttctatcgcaaatgcgaaggtgatcgaaaattaaactgggtcgcaaatgcgaagggctcagttttctgaggggttcgcaattgcgaaccctgatcgcaattgcgacacctgtaacctgcaaaatcataacttagacgtatttcaacaatttttcaaaccctttcaaaaccaaaacactcttgggcgatttttcaaagacaaacactcttccaaatcaattgtaagtcatttctaacttgtttttattaatttttaacatcttttcttatgatttcaactcaaaattaaaggttttcatagaggaaattgggtgttttgggtagaacctaggtttttcaaattttggggatttggacctcaatttgaggtccgatttcaaaataaaatatatatttgggttcgtggaggaatgggtaatcgggttttggttcgaaccttgggttttgaccatgtgggcccgggacgattttttgactttttgggaaaaaactttagaaaacatattttcatgcattggaattgattcatttagcatttattgatatagttaagtaacttgtggctggagacgagcgaattggtggtggaatcaagaggtaaagcgatagttgaggcttgaattaactgcacaggtttatttggtagtttggttctagcctcgtcactacttcgctgaggttaggctaggcatttactagcacatggggtcagttgtgctgatactacactcttcaatgtgtgcagatacttataccggagcatttggaccgcactgagggtgttgtctttagtccattcaggcgacccgaggtagtctattcaggcgacccgaggtattcagagacagacttatgtatttcattcagaccttatttgtagtattcttagatagtccgtgacttgtgacaccaaattctgggtagtattgtactttaaattatgtagcagtgtttggttgaattattaagttttcgtattccgcatttctggttatttaatttatttcgctgtttaatcacttattattttaaattgtcgaacatttttaataaaaagtgtaatgattttataatattcggcttgcgtagcttccacgagtaggcgccatcacgactctcgagggtggaaaatccgggtcgtgacaagttggtatcagaactctaggttacataggtctcacaattcacagacaagcttagtagagtctgagggatcggtatggagacatttgtatttatccccagaggctacagagttaggaaaaacttcacatctattctttcctgtcgtgcggtctggtttctcaatgctaattaaatttctactttgttctttcctagatggcgagaacacacgcttcctcatcaattgataagcagcccgagcccccagcagcagctcccacgaggggcagagggcgaggccgaggtaggggcagagctcagcctagagcagcagcaccagcggcggagcctcaggttgagtttgatgatgaggttacgacccaggaagttccggtgggcctagctcatgtctcagaggggttcattgctaccccagtactccaagatgctctggtccgtctagtgggccttatggagagtgtcacccgggcatacttgcttcatcgtagcaccaaccatctctcaagctggaggaggagcccaaactcctactactcgcacttcggagcagatggctccccagtttcagactctaacaactcagccagttggagcagttcagccggatgtggtagctcagaccggtgatagagcagctatgtctgtcgatgccttgtggagattggacaggttcaccaagctcttcactaccacttttagcggtgcatctttggaggatccccaggattatttggacagatgtcatgaggttctcaggaacatggggatattggagaccaatgggatcgactttgctactttttgcttatctggattcgccaagacttggtggagggattattgtttggccagaccagttgggtcaccagctttggcttgggatcagttttctcacctttttttggagaagtttcttcccgtcactcagagagagatctatcgaagacagttgaatgtttccaacagggttctatgactattactcagtacgagaccaggtttattgatttggcccgtcatgatctacttatactccccattgagagagagagtgaggaggttcattgagggactcattcagcctattcgacttcagatggatgaggagacagggagtgagatttctttccaggaggtagccaatgtggctaggagagttgagatggttctatcgcagagaggtggtcaggagtctgataagaggcctcgtcattcaggcagattcagtggcgcctcatctggaggaaaggatttgtatggtagaggccaaccttctaggctttttcattcagcacttcaggtttctcacggtgcttcaggtggctgtggtcctcatatgcaatattctgatcagcagtcctacagtgcaccaccaactcctatcagtgcaccgtcgctttagagttttcagggtcgtcagtcccagcagccgagggcttgttttacttgtggcgacacgaggcatattgctagatattgccctcgagcaccgagcagttctcagcaccagagttcccatgccatggttcaggcatcgagtgttccaccgcccgcccaaccagctagaggtaggggttgaggtgctagaggtggaggtgctagaggtggaggtataggtattagaggtggagctcaggccgctagaggtggaggccagccagtagtagtccatcccagagatgtagttcagagttgtggggcccagcctcgatgttatgctcttccagccagacctgaggctgaggcttccgatttagttatcacaagtactattttggtttgtagtagagatgcttcagttctatttgatccaggatctacgtactcctatgtgtcatcttattttgcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgtggtcatgcctagtgattctttgagtgctcttgtatatgtgtctatcgctataggtgattctattatggtagatcgtgtccatcgttcatgtatagttgtgattggggggtcttgagactcgtgtatatttgttacttctggacatgattgattttgatatcattttggggatggactggttatcacctcaccacgcgatcttggactgtcatgccaagactgtgaccttagccttgccaggtttacctcgtttagattggagagggactcctggtcattctacccatagtgttattttatacatgaaggctcgaagtatgatcgagaaggggtatttggcttatttgtcatatgttcgtgattctagtaccgatgttccttctattgcttctgtgcctgttgttcgtgagcttcctgaggtatttccttcagacttgccgggtatgccacccgacagtgatattgacttctgcattgatttggctccgggtactcagcccatttcaattctattgtatcgtatggccccgcttgagttgaaagaattaaaggaggagttgtaatacttgcttgagaagggcttcattagacctagtgtctcgccttgggcgcgctggtattgtttgttaagaagaaggatggatcgatgcgaatgtgtatagatttccggcagttgaacaaggttacaatcaagaataagtatccattgccgaggattgatgatttatttgatcaacttcagggtgccaaggtattttcgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgattagggcatctgatgtccctaagacagatttctgcactcggtacgggcattatgagttcttggtgatgtcattcgagttgacaaatgccccggtagattttatggatttgatgaatcgagtattcaggccttacttggatttgtttgtgatagtcttcattaatgatattttgatctattcccacagctgggaggagcatgagcagcatctgagagtagtcctccaaactttgagagatagtcagttgtatgctaagttttcgaaatgtgagttctggttgagttcatttgcattcttgggtcatgttgtatcagcaaagggtattcaggtagatccgaagaagatagaggctgtgaagaactggcctagaccagcatcaactacagagatccggagtttcttgggattggcaggctattatcgtcggtttgtagaggggttttcatctattgcagtcccgatgaccaggttgacccagaagggttcctagttcaggtggtcggacgagtgtaaggcgagctttcagaagctcaagacagctttgactacgacgccagtgtttgttttgtccacaggttcaaggccatatacagtttattgtgacgcatctcgtattggacttggtgcggtgttgatgcaggatgacaaggttattgcatatgattcgcgtcagttgaagattcatgagaagaattatccagttcatgatttggagttagcagccattattcacgcgttgaagatttggaggcattatctatatggcgtgtcatgtgaggtgttcacggatcacaagagtttacaatacttgttcaagcagaaggagctaaacttgaggaagaagatgtgattggagctattgaaggactatgatatcaccatcttatgtcatccgggaaaggccaatgtggtggccgatgctttgagtaggaagtcagccagtatgggcagtcttgcttatattccggtcggtgagagaccgcttgctttggatgttcaatctttggccaatcagttcgtgaggttggatgtttctgagcccagccgtgtgttagcttgcatagtcgctcattcttctttactggagcgtatccgagattagcagtatgatgatcctcatttgtatgtccttagagacacggtgcagcacggaggtgccaaacaggttacattaggagatgatggagttttgagattgcagggtcgagtttgtgtgcctaatgtggatgggctccgggagttgattttagaggaggctcacagttcccgatattctattcattcgggcgccactaagatgtatcaggatttgcggcagcattattggtagaggaggatgaaaaaggacattgttgcatatgtggctcggtgtttgaattgtcagcaggttaagtacgagaatcagaggcctggtggtttgttccagaagattgagattcctgagtggaagtgggagcgtatcactatggacttcgttgttggactcctacagacttagaggaagttcgatgcagtgtgggttattgttgataggctgaccaagttagcacatttcattcatgtggcagtctcctattcttccgagaggttagctgagatctatattcgggagattgttcgtcttcatggtgtgcctgtgtctatcatttcggaccgaggtacatagtttaccttacatttttggagagcatttcagcgagagttgggcacatgggttgagttgagcacaacatttcatcctcagacagacgggcagtccgagcagactattcagattttggaggatatgctacgagcttgtgtcattgactttagaggctcgtgggattagtttttgcctttagcagagattgcctataacaacagctactagtcgagcatccagatggctccttatgaggctttatatggtaggcagtgccgtcgccagttggatggtttgagacggaagaggctcggttgttgggtatagatctagtacaggatgccttggacaaggttagtatcattcaggatatgcttcgtacagctcagtccaggcaaaagagttatgccgatcttaaggttcgagatttgtcattcatggtcggtgagcgggtgttgcttcgggtgtcacctatgaagggcgtgatgagatttaggaagaggggcaagcttagccatagattcattggcccatttaagattcttgatcgagtggaagtggtggcttacagacttgcgttgccgccgagattatcagtcgtgcatccaatgtttcatgtgtccatgcttcagaagtatcacggctttccatcccacgtgctatatttcagcattgtccaattggacaaggacttgtcctatgaggaggagccggtagctattctagaccagcaggtttatcagttgagatcgaagaatttatcttctattcgtgttccatggagaggtcagcctgttgaggcatcaacctgagagtctgagtccgatatgaggagcccctatccccatcttttccccgactcgggtacttccttcttatgtctgttcgaggacgaacggttattttagaggtggaggatgtgatgacccaaaaggtcatcacttgtgttagaaacaaattctgtgttccgaggccttaaacttcctttttacctcacctcaatttgcgtgcatggtctggacgtatatccggaaagcttttatgtgaaaatatgagagagagaaatttctagagttaaaatttgaatatggttgaccttggtcaacattttgagcaaacggacccggatctatgttccgtcgatccccggaggtccgtagcaaaatatgagactcgggcgtatgcccggaaatgatttccgagatcccaagccttagaaattaatttttgaaagaaattattttgctgaattatttataaaataatgaaaagaattaatgtttgaaactattggtatcaggcctgtattttggttctagagcccggtacaaacttgttaaattatttaaataataactgtgaaatttgttaaaatagagtttatttgaggtgatttggaccttcggttgaagagttatgaactttatgtgttcttgatgaaaatgatgcgttttaaggtttttttttttagttttgaggtttaattcatagttttacatgttattttcatgatttgattgcacgagcaagtccatatgatatttttgggttagtatgcatgtttggagccccgaggactcgggtgagttttggataggctacggagtgaaatttggacttaggaagttgcaggtctgcaggcttcgcaaatgcaaagcttggctcgcaaatgcgagagagcatcgcaaatgcgataatcgacctgggttgccttagtcgcaaatgcgactgttctatcgcaaatgcgatatcgcatttgcgaaaggtccctcgcaaatgagaaggtgaccggaaattaaactgggttgcaaatgtgacattatcttcgcaaatgcaaaggtgtcaattttctgaggggttcgcaattgcgaaccctgatcacaattgcggcacttgcaacctgcaaaatcataactaagacgcacttcaaccattcttcaaaccctttcaaaaccaaaacactcttgggcgatttttcaaagacaagtactcttccaaatcgattgtaagacatttctaacttgtttttattaatttttaacatattttctcatgatttcaactcaaaataaaaggtttttatgggggaaattgggtgttttgggtagaacctaggtttttcaaattttgggggtttggacctcgatttgaggtccaatttcaaaacaaattgtatatttgggtttgtgagagaatgtataatagggtttttgttcgaaccttgggttttgaccatgtggacccgggggtgatttttgaatttttaggaaaaaacattagaaaatttattttcatgcattggaattgattcatttagtatttattgatataattaagtaacttgtggctagatacgagcgaattggtggtggaatcaagaggtaaagtgatagttgaggcttgaattgtgttcgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagcttgggggattaggagtcgagtcttaatttctacgtgttaactgtggagtacgatgtataggcatggtgataagtatctatacgtcggtatcaagcatgcccgtgaatcttgtattgaaattttatgactccgttgtagtttattcgtgcttcatatgagaattatattattattcccttgccgggatgttgttgtgatattattgttcccttgctgggatgttgttataatattattgttcccttgcaggtatgttgttattatactattatttccttgccagaatgttattgttacattattgttcccttgccgggatgttgttgttatactattgttcccttgccgggattcttttatgattggtgttgataaatgaaataggagcgggttgcacgcctgcaactgtaatatatgaaatgagagtgggttgtacgcttgcaacggtaagatttgaaatgggagcggcttgtacgcctgcaacagtaatatatgaaatgggagcgggttgcacgcctgcaacggtaatatgtgaaataggagcgggttgcatgcctgcaacggtaatatgttaaatgggagcgggttgcatgcctgcaacggtactatatgaaatgggatcgggttgcacgcctgcaacggtattacatgtgtacttgttttccttatttccttatcttttgcnnnnnnnnnnnnnnnnnnnnnnnnnnnnnnnnnnnnnnnnnnnnnnnnnnnnnnnnnnnnnnnnnnnnnnnnnnnnnnnncatttttctactgttattctgttattatctgttactccccacaacatgtttcccctgcccaactttaacagtaattatctacttttatttccattgtatatgatttaactgcacatgtttatttggtagtttggtcctagcctcgtcactgcttcgccgaggttaggctaggcacttaccaacatatggggtcggttgtgctgatactatattctgtactgtatgcatatactgataccggagcgtttggaccgcagtgagggtgctgtcttcagtctatttaggtgactcgaggtagtcctgcatgcatccgcgggccttggcgtctcctcatatcttttctctttctgtttttacttattcagagacagacttatgtatttcattcagaccttatttgtagcattcttagatgctccgtgacttgtgacacaaaattctggatagtattgtacttcaaattatgtagcagtgtttggttgaattattaagttttcgtcttccgcattttcggttatttaagttatttcgatgtttaatcacttattattttaaattgttgaacatgtttaataaaaagggtaatgattttataatattcgacttgcctagcttctacgagtagatgccatcacgactcccgagggtgaaaaatccgggtcgtgacaggatctcgtctattgctcgtttcggctaccaaatactcaattttttcatatttcaaaaaaaattaaatctaggtgtcacgacccaattcccgaacccggtcgtgatgacgcctctcttgaagacaaggccagctaaaccaaaacagaatacctcttttaaacagttaaatatcattaatcgttctaaagcatgatataatatccataatttgcgaaattaacgataacaacagtaaaagccatcccgacatagcccaaattggggtgtcacaagtcatgtgcaactaagagaaaatcgtgatacagtctactaatcactaaactcgatacaatagttctaagaacatgaaaatgataagataagggaggcacgggggctgcggacgccaacagctacctcgtgatctccgaaacactgcctggacgggaagatcagcactcaggagcggactttgcgatgcctgaatctgcacacacagtgcaagcagtaatgtgggtactccgacctagtgagtaataatcataaataatggctgaaagcaagaaaacacataaaggcacaaagcaattctatatcaagtagtaaaatcacttaaagcaatagatcggtgaagaagtcaaatggaatccctttaaaccaagtaaaacaggtaatttagcaggtaattaacaagtagaaatccacccctcgggcacagtatcaatcactcaaaacggtatcagctcctcgggatcactcttatcacttagtgctcattctaagctcttgacccatatatctctcataataatagaaatcagaataaccgctgcggcatgcatcttgattcgtacatcgttgtggcatgcagcccgatccttatagatagtcgactgcgctcactgggggtgtacagactccggaggggctcctacagcccaagagctatattgctgcagcgtgcagcccaatccatataagtgttgcttcggcgtgcagcctgatccataacatatataatatcctcaccattgggttctcaacccctctctgtcatttacctcacagcctctcgggcacaataatagaagatacggatctcagcccacaaattcctctcatttaggaatagtatgataaaattcgactcgaatcgtttaaaacagatagaaacatgaccgaggatatgatttttaacaagtatagtgaggaaaaatcagtcaaaatccccgaagggttcagatagttcgcacgaagcccaaatatgacaattagcccaaataatgatgataacaaataagtttcagtcaaatatgcggtaaaatcatcagtcgggacggaccaagtctcaatccccagtagtaaaagaccccacgctcatcatccagcgcgtgtctcacctcaatatagcactacgatgtgcaatccggggtttcaaaccctcagagacatcatttacaatcattactcacctcgaaccggctaaaatctctatctcgcgacgcctttgcccctcgaatcggcctccacgcgcgtcgaatctatccaaaatcagaacgaatacatcacaataggctaagggaacaaagcccaagcgaaaacaatcgaattaccacaaaattctagaattggtcaaacccgacccccgggcccacatctcggaatttgacaaaattcacaaaactcgaatccttatactctcacgagtctaaccatatgaaaattatccaattccgataccatttggtccttcaaatcatcattttacatttttgaaagatttcacaattttcttcccaaattccatcccaaatcacgaattaaatgatgaattcaatgatagattcatgtactctagccaaatctgagttagaatcacttaccccgatgaatttcttgaaaaaccttcgaaaaatcgccaaaatccgagctctctaggtcaaaatatcaaataaaacccaaaacctcgtatttatagagtaccccacagatttccacctccgcggccgcacaaaatcgaccgcggtccgcacaaaaacgcaccgaccgcggccgcacagctttcctctacagtgacagctttagtattttggccataactttcgctacagatgtccaaattgcgatatctttacctttctggaaactagacacgaagggctacaactttttgtttttgaatcatctcaaaattccttgtagatcaaaagatatgagcttccgaagtaggaccagtggaatgttcttcaccgcggccgcacaccattttgtgcggtccgcacaacacctaccgcggccgcacttcattttgtgcggtccgcacagcacataccggccgcacttctttttgtgcggaccgcgcgggtgagttccgaggcctgcaacccttctggacctgctacagctatgattttcggcctaaaacatcccggaacctacccggaactcccggaacttcaaaccaattgtaccaacacatcccatgacatcgttcaaacttgttcaaaacttcggaacgctcacaacaacatcaatcaccaatttaacataggattcaagcctaagaactccaagaactcttaaattatgctttcgatcaaaaagtctatcaaatctcgtccgaatgacctaaaattttgcacacacatcccaaatgacacaacgaagctactgtcactctcggaattccattccgacccctatatcaaaatctcgcctatcaaccggaaccgccaaaatatcaacttcgccaatttaagcctaaatcttctctacaactccaaaaccattccgatcgcgctcctaagtcacaaatcacctcccgaagctaaccgaaccatcagaactcacttcgagccttctaacacataagtcaacatccggttgacttttccaacttaagccttcttaaaagagactaagtgtctcatttcttaccaaatcctctccgaactcgaactaatcaacccgatcacataaaacacggataacgaagcgtaaagaagctgaaatgggggaaaaacggagcggtaactcatgagacgactggccgggtcgtcacatcctccccaacttaaacaaacgttcgtcctcgaacgagtcaagaaacatacctgaagcctcaaacaggtgaggatatctgctccgcatctcccgctcggtctcccaggtagcctcctccatgggccgacctctccactgcactttcactgaagctatatcctttgacctcaactttcgaacctgacgacccaaaatagctactggctccacatcataggtcaaatcatcatccaactgaaccgtgctgaagtccaaaacatgagacggatccccaatatacttccggagcatagaaacatgaaataccggatgcacactcgacaagctgggtggcaaagcaagctcataagccacctccccaatcctccgaagcacctcaaaaggcccaatgaaccgaggactcaatttccctttcttcccaaatctcataacacccttcatgggcgaaaccttcagcaagaccttctcaccaaccatgtaggacacatctcgaaccttccggtccgcataactcttctgacgcgactgcactgtacgaagcctctcctgaatcaccttcaccttctctaaggcatcctgaaccaaatctgtccccaatagcctagcctcgccgggctcgaaccaaccaactggagatctacaccgcctcccatacaaagcctcatacggagccatctgaatactcgactggtagctgttgttgtaagcaaactctgcaagcggtagaaactcatcccatgaacctccaaatcaataacacaagcacgcaacatgtcctccaatatctgaatagtacgctcggactgtccgtccgtctgaggatgaaaagctgtgctcaactccacctgagtacccaactctcgctgaacagctccaaaactgaagtaaactgagtacctctatctgagatgatggaaaccggaacaccatgcaaccgaacaatctcccggatataaatccctgccaaccgctctgaagaataggtagtacacacaggaatgaagtgcgcggacttggtcagccgatccacaatcacccaaatagcatcaaacttcttcaaagtccaaaagtccaactcccacttccactcgggaataaccatctgctgaagcaagccacccggtctctgatgctcatatttcacctgctgacaattgagacaccgagctacaaatcccacaatatctttcttcattcttctccaccaatagtgctgcctcaaatcctgatacatcttcgcggcacccggatgaatggaataccgcgagctatgggcctcctccagaatcaactctctaagcccatccacattgggcacacaaatccggccctgcatcctcaacaccccatcatcaccgatggtcacatctctggcatcatcatgctgaactctgtccttaaggacaagcaaatgcggatcatcatactggcgctctctgatgcgatcatataaggaagaccgagaaaccacacaagccaacacccgactgggctccaaaatatccaacctcacgaaccgattggccaaggcctgaacatcaactgcaagaggtctctccccaactggaatatatgccaaactccccatactcactgcctttcggctcaaagcatcggccaccacattggcctttcccggatggtacaatatagtgatatcataatccttaagcaactccaaccatctccgctgcctcaaattaagatccttttgcttgaacaaatgctgaagactgcgatgatcagtgaatacctcacaagatacgccatacaagtaatgcctccaaatcttcaatgcatgaactatggcagccaactccaaatcatgaacatggtagttcttctcatggggcttcaactgacgagaagcataagcaataactctaccctcctgcatcaatacacaaccaatcccaactctcgaagcatcacaatacacaatatatgaacctgaagctgatggcaaaaccaacactggagctgtggtcaaagctgtcttgagcttctgaaagctctcctcacactcgtccgaccatacaaatgaagcacccttctgagtcaacttggtcaagggcgatgcgatagatgagaatccctgaacaaaccggcgataatagcctaaacccaagaaagctacgaatctctgtggctgaggacggtctaggccaactctgaaccgcctctatcttctttggatcaacctgaataccctcgctggacaccacgtgccccaagaaagccactgaactgagccaaaactcacacttggagaattttgcataaagcttctcctccctcaatctctgcaatacaactctcaaatgctccgcgtgctcctcctgactacgcgagtacaccagaatatcatcaatgaatactataacgaacgaatcaagataaggccgaaaacacgttgttcatcaaatgcatgaacgctgctggggcattggtcagcccgaaagacataacaaggaactcataatgaccatatctggtcctgaaagcagtcttaagaatatctgaatccctgatcttcaactggtgatagcccgaacggagatcaatcttggagaacaccctcgctccctgaagctggtcaaataaatcatcaatgcgaggcaaaggatacttgttcttaattgttaccttgttcaattgcctataatcaatgcacattctcattgtgccatccttcttcttcacaaacagaaccggcgcaccccaaggtgacacactaggccgaatgaaccccttatctaggagttcctgaagctgctccttcaattctttcaactctgctggtgccatacgatacgcggaatagaaatgggctgagtgcccggcaccaggtcaataccaaaatcaatatccctgtccggtggcatgcccgacaggtctgcaggaaacacatcgggaaaatccctcacaactggaacagaatcaatgctaggagtctcagctcccacatccctcacaaaacgctaaatatgaaaggcaacccttcccaaccatacgctgggccttcaagaaagatatcactctactaggaacataatcagtcacaccacgccactcgatccgcggtacacccggcatagccaaagtgactgtcttagcatgacagtctagaatagcacgacatggagatagccaatccatgcccaaaatgacatcaaaatccaccatgctcaatagcaatagatccactcgggtctccagacccccaatagtcaccacacatgaccggtacacacggtctacaacaacagtatcgcccaccggggtagatacatgaacaggtaaagcaagaaactcacggggcgtacccaaataacgagcaaagtatgatgacacataagaaaaggtggaaccgggatcaaataatacagaggcatctctgtggcagactgaaacaatacctgtaatgacagcatctgaagcaatagcatctggcctgcctggaagtgcatagaaacggcctgggccccctgatcgacctccccctctggggcgacccctggctgcctgacctccacccctagctggctgggcgggtggtgaagtaactggagcagaagtcgagggctgacccctctgctgagatgaactagcaacgacgaggacactgcctccacatatgtccaaactctccacactcaaaacaactcccaggtgctggagaaggggactgaagggaacccctcgcaccggagtgaccagctgatgcactcggcatagaagaaccctgagctgacggggcacgagatgaactctgggctggaagggcactaagtgatgactggccctgctgagatccatgataaccatgacccgaagatgccccacgataacctgggcgggctgactgagcaggcctgaaagaacgacctctaccatgctgaaactggcccctcgaaggagcaccactataactgccccctcgaggcctcttggcctccctctcctctcgatcctgacggcgaaccgtctcaatctcgcgagcgatatcaaccacctcctcgaacgtagcacccaacaccctctctcgggtcataagaatacggagatgatagttaaggccatcaacaaatctcctgatcctctcacgatctgtcggaaccatccaaatggcatgacgagccaactcagaaaacctcgactcatactgtgacacagtcatatccccctgtcgcaaccactcaaactgtctacgcagctcctctctgcgggactgcggtacatacttctccaagaagagagtggagaactgctgccaagtaaggggcgctgctccaaccggcctacgcctctcatacgcctcccaccaagtgaaggcagccccagtaaactgaaaggtggtaaatgccacaccactagactcaagaatccctgctgtacggagcatccgctgacacttatccaagaaaaccctgggcatcctcgccctcagcaccactgaatgacggaggctggagtctaccaaacctctcaagagacgctgctcatcatccggcataactggcacaacaaactcctgagctggtgcaaccggctgggctggaggtgcccccggcgtctgaagtccctgcactacctgctcaggtgtgcgagcagcgggggtctgattgcctccggcctgtgaagtagctgctgctgtagtggctgaaactgcctgagccaggccagtgcaaactgataagatctgtgccaaggcctcctgaagacccggaatcacgatgggcacagctggtgcctgaactggtgctgctggagcatccatagctggagcctgatccggagctagggcagctggtggatctacaggtgctgccctcgctgctctgcctctgccacgaccacgaccgcgtccacggcctctggtggtctcagctggtggcactggtggtcgtccacctcgtccggtagctcgcgtcctcaccatctgtgagagaatggaataacagaagtttagtactcggaccaacaagttcgcacgacaagaatttcaagaatatgaagtttttcctaaaggttctgcagcctctcgaggataaatacagacgtctccgtaccgatccgcgagactctactaaacctgctcatgactcgtgagacctatgtaacctaggctctgataccaacttgtcacgacccttcccgaacccggtcgtgatggcgcctctcgtgaagacaaggccagccagaccaaaacagaacacctcttttaaacagttaaataccataaatagttctaaaacatgatataataaccataatttgaaataacgataacaacagtagaaaccatcccgacacagcccaaaccggggtgtcacaagtcatgagcaactaataaatccggataccagtctactagatacgaaatccgatacagaagttcaagaacatgaaaatagtaagataagggaggcacgggggctgcggacgccaacagctacctcgtagtctccgaaaacactgcctggactgggaggatcagcactcaggagcggactctgcgatgcctgaatctgcacacacggtgcagggagtaatgtgagtactccgactcagtgagtaataatcataaataatggctgaaagcaagaaaacacgtaaaggcacaaagcaattctatatcaagcagtaaaaatcacttaaagcagtaaatcagtgaagagtcaagtgaaatctctttaaatcaggtaaaacggtaatttagcaggtaaataacaagtagaaatccacccctcggcacagtgtcaatcactcagaacagtatcagctcctcgggctcactctcatcacttggtgctcattctcagctctcgacccatatatctctcataataacagaaatcagaataaccgctgcggcgtgcagcccgatccgtacatcgctgcggcgtgcagcccgatccatatagatagtcgactgcgctcactgggggtgtgcagactccggaggggctcctacagcccaagcgctatattgctgcggcgtgcagcccgatccatataagtattgttgcggcgtgcagcccgatccataacatatataatatcctcaccattgggttctcaacccctctcagtcattaacctcacagcctctcgggcacaataatagaagatagggatctcagcccacaaattcctctcatttaggaatagtatgacaaaaccggctcgaatcgtttaaaacagagagaaacatgaccgaggatacgatttttaacaagtatagtgaggaaaatcagtcaaaatccccgaagggttcaaatagttggcacgaagcccaaatatggcaattagccccaaatcatgatgataacaaataagtttcagtcaaatacgcggtaaaatcatcagtcgggacggaccaagtctcaatccccagtagtaaaagaccccacgctcatcatcgagcgcgtgtctcacctcaatatagcactacggtgtgcaattcggggtttcaaacccacaggacatcatttacaatcattactcacctcgaaccggctaaatctctagctcgcgacgcctttgcatctcaaatcggcctccacgtgcgtcgaatctatccacaatcagaatgaatacatcacaatatgctaagggaacaaagcccaagcgaaaacaatcaataacaggcacaaatcccgaaattgccaaaacccgagccccggacccacttctcgaaactcagaatttttcacatcattagatgtcttatctccccacgagttcatatataccaaaagttctcaaatccgaccccaaatggtttttcaaatcccaaataaatgtccaatttctcaagccctagtacttcaatttttaggtttagtttccatgaatttctaggtggatttcacaatataatcgagttttaagaccaagattcttacctcaagtcgattcctcttgaatccctcnnnnnnnnnnnnnnnnnnnnnnnnnnnnnnnnnnnnnnnnnnnnnnnnnnnnnnnnnnnnnnnnnnnnnnnnnnnnnnnnnnnnaccaaaaacgagcagccataggtgaaaatagacccaaaatcgcggacaagacaacttaaaaccattctgcctaggcctgactttccttcttcgcgaacgcggtcaacatctcgcgaacgcaaagcacaaaattgcgttgaccagctttaccttacgcgaacgcgacatgccaattgcgaacgcaatgcttccatggccttgaccttcgtgaacgcattcgctccttcgcgaacgcgatgaataactgaccattagaccaaatcctccttcgcgatcgtgtatacacactcgcgaatgcgatgaagtcccctaacaagccttcgcgaacgtggcatggaccctggagaatgcgaagcttacgaaacccggcccttcgcgaacgcgaaggccaaaatacctgcaactgctggaacaagatctgcaattttccaaactctaaaatggtccaattgaccacccgaaactcacccgaggcccccagaacctcaaccaaaggaaccaacacatcctaaaacctcattcaaacttgttccaatcatcaaaacacctcaaacaacaacaaatcactcataacatatcggattcaagcctaagttttctaaaaacttccgaaatacgctttcgatcaaaaatccaaccaaaccacatctgaatgatctgagatttttcacacacatcctaaatgacataacgaagccactgcaactctcggaattccatttcacctcctggattaaaatctcacctaccaaccggaaatcgccaaaatctcaacttcgccaattcaagcctaattctactccaggcctccaaagccaattccgatcatgctcctaagtcataaatcacccaaggaagctaaccaaatcataaaaattccgatccgagctcatatacaaataagtcaactcttggtcaaacctttcaaattcgaagctttcatctgagactgttctttcaaattccttccgattttcctgaaaaccaaaaccaacgatctacatcattcataatacattacacggggaaagtcatgcccgagaactggcgatcaagtgaaaaagctcaaaacgactggtcgggtcgttacatcctcccccacttaaacacacgttcatcctcgaacgtacctagagttgttctagaagccaatcaataactgaataactttaccatgcatatacccgggggattatcccacgtcaccctatctcatataggtccgataacatattgaaactaaaattacgcaatccagtctggcccctaagccatagaaccacatttccacttctgaaaccatcaatacgatcaaagcctcacacctatactctgaatagactcgaaccagctgtaataacccatgcctgcaacctcgggagcaatcccatgatataccacataactcaaacactcgtagcgataacttctattcacagcagctgcacaacaaccgaatactggtagaaaatctcttaccagccaaagtctcattccaaaactatcaaatactgccaacgataaatgaaatacgcaataaaccataaccattttcttagatcacccattcatgaagcaacttctcctctgacaaataccatagcaaatttccgagccgaacctcgatattaaccttccaacatgctgaaatcgaatccgttcgtattcattaatgatcccaacgatctcctctaatccaacacaccactctggtgacatgacacatcaatagaaggcctaagccacaactcaagctcaccagtaccaccacaacacaaggctgagaacctgtctcacatcatataatagaacatatgaatctagcccgcaagttcatatcccatatagcttcattgcaatgtgcgatcctatcaaacactgctccacatgagacacctcaagtcactatgctcgaaattgacaaccacgcacaatttgatgtctggaaccaaagcagatcattacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgagcaacatctaattactcttcccgctcgacttccactatgaaccccaatggaaccgcaccatgtgtgctcataaccaacaaatcataacgtcttgcaacacataaaggcaacccatagatcttcccagatcactaataaactcaataatagttgaatcaacctatccctcaacaatacaattaggggccaaccaagccgactcaagatagaacacgtatccatattggcctgctaacgaactccttaccaaggaagcttaaagctgccccttacactactataactcccgctgaagccatacgatacggtgcccgacaccaaattaataccaaaatctgcaacctcgcccggtgacatgcccggccataagaaacacatccgaaaagttcctcaacactggaactgaatcaatggtagaaacctctgctttgacattcatcacgaaggcccaattaagaaaggcaatccttcctagacgtccgctgggtccttgaaatataaaccactatactagaacataatccgatgcacctcgccacttaacccgtggcatttccggcatagccaaaagcgcaatagttcggaataacccaacatggagacaaccagtctaaaccccaacatcacatccaaaatctaatataccaagcaaataaagatccactggggcctccaaatcccggtagttgctaaacaatgccgatacacacaatctacaaccacaacatagcctgaatatgagaactttcgtctccacatccaaacgacacatgaatcaccatatccgatcccaattttgccatccgaacacatgccacacctttaatacccaatcattccatgatagatactctaaaattcttttgtgcttccaagcaaactcgaatatcagcagccgatctgacaagaagtgctgcaatactaccggagtaccatcaacttaatcacattgcctctgtctgaatatatactctcgtccaatcacctcaattaacattaccctttctttaatcatctaaagatcatttctcaaatcatctgaaggtcatttcttcaatttatctaaactgcccatactacataagaatttatgacctttctttcaaatttgaaccgtgaccttacacatgccaatctcactcctatacaacataccgcataaaccgtaccattctaggataacaacaagaaccttgtatctcttccgagccacaagaaactatgtactcaaccaaccaagaacttcgattgttcccatctagaagaaaatcactatacataccatgctcctcatgcccatagaaaatatatatttccaaccgaggtcgaaaccatcaagaactctccgagttccccttgcacaaaccagacctgccaggactaaatccttctaactcaaccgagctatgcagatcactaaaacccaagagaattgccgagaaacacatgtagaaactcattatctcgcaagcatccgaagaactaatcatatccttaccataccaactcggcctactaccaagctatcccgtatattcgaatttccttctgatttaccttcaacttgatactcattcttgctataacatcacaattcctcaaaccagacttaccacacgggacccaagcataaagccataccgtctaaggctcataagccgctgaatactttctcagatattcccacgagcaccactatcaaagtactttgctctgaagagacttcctgcgaatctaaatctgttacctttaccttcccggtactgatacatagaatttcataatttataaagataataccacaagtctcgacatcttctaatgaaaactcaggttctaaccacatatacaactttaaaatacccaattgttatatgtaaaatcttgaacacattagaaccattctcgagagtcattcactctattcaaactgcaattagcctgatcaaatgaacagaagcacctgtgcttcaatagcactccgacaccgcagggtgtaatctcatcctagaacaaccaagccacttcctgctctatgcaccgagcatccattaccacaacagctcaagacactctaagattcccatacatctatgaagcatgacataacctctgtcaaaatttttcctttactcaagacatccacgatctcaatctccgtaatccatgactgattcaccagtgcacctcaaactggaaccaacatagcacataactgtgcaatcaacaaatcaatagcagactcccccacttggctcgaagccatagatcaaaacacatttaatatctcgtaacacatatactctattaatgccataataccatagtgagattaaactcaaagccattgtaagcttgcgaaaacacagatcatctagtactttaactcttccgcaaatctcgcattcactctcacaatagttaggtcccctctcttaagcgacccatttaaattacaagacatatctttcacttgcaaatgagatcttctaacagacagcataaagatcgcacaacttccgaactcttcgtaggagataacccacctgatttgcctcaaactaacattcccgcataccttccaccgtcgtaaactttacgcagtcacttagtcttcctgagtnnnnnnnnnnnnnnnnnnnnnnnnnnnnnnnnnnnnnnnnnnnnnnnnnnnnnnnnnnnctgaactcataccgcaacatgaaatttacttcacttccaactaggaaaaatgaaaagattcttcacacgccaacaactcgggctatacctcaaaccgagatggaattcaaacactaatagttcttctatcctccagcggacctttcttgtcgcttctaaatcatatagatacgtctcgcaatactaacacactcatcacatagccatccagtcgtcgctcccactaacagggacagtaccaaacatataagttcaaaaacacttgctcacataatcagcacctcggtgctcaagccatagggaaagatctggcctcaagtcctccagactggctcaacatcaactcacagagatcacatctcgccccccgatctaggactcataagccatcattgcaaatctgatactgagcgctcatgcgtgcatacgaatgcgtggaaggaattcaaagagttacagttcaagctgaatcaaggacgcacgataaggattcaagaacatgaagttttcctaaaggttctgcaacctctcgaggataaatacaaacgtctccataccgatccatgagactctactaaacctgctcatgactcgtgagacctatgtaacctagactctgataccaacttgtcacgacccaattcccgaactcgctcgtgatggtgcctctcttgaagacaaggccagccagaccaaaacagaacacctcttttaaacagttaaatatcattaatagttctaaagcatgatataatatccataatttgcgaaattaacgataacaacagtaaaagccatcccgacatagcccaaactggggtgtcacaaatcatgtgcaactaagagaaaatcctgatacagtctactaatcactaaacccgatacaatagttctaagaacatgaaaatgataagataagggaggcacgggggctgcggacgccaacagctacctcgtgatctccgaaacactgcctggacgggaagatcagcactcaggagcggactctgcgatgcctgaatctgcacacacggtgcaggaagtaatgtgagtactctgacccagtgagtaataatcataaatagtggctgaaagtaagaaaacacgtaaaggcacaaagcagttctatatcaagcagtaaaatcacttaaagcaatagatcggtgaagaagtcaaatggaatccctttaaaccaagtaaaacaggtaatttagcaggtaattaacaattagaaatccgcccctcgggcttagtatcaatcactcaaaatggtatccgctcctcgggctcactctcatcacttagtgctcattctcatctctcgacccatatatctctcgtaataaaagaaatcagaataaccgttgcggcgtgcagcccgatccgtacatcgctgcggcgtgcaacccgatctttatagatagtcgactgcgctcactaggggtgtgcaaactccgaagggtctcctacagctcaaacgctatattgttgcggtgtgcagcccgatccatataagtattgttgcggcgtgcagcccgatccatataagtattgctgcggcgtgcagcccgatccataacaaatataatatcctcaccattaggttctcaacacctctcagtcatttacctcacaatctctcgggcacaataatagaatatagggatctcagcccacaaattcctctcatttaggaatagtatgataaaaaatggcttgaatcgtttaaaacagatagaaacatgacagaggatatgtttttaacaagtatagtgaggaaaaattagtcaaaatccccgaagggttcaaatagttggcacgaagcccaaatatggcaattagcccaaatcatgatgataacaaataagtttcagtcaaatatgtgttaaaatcatcagtcgggacggaccaagtctcaatccccaatagtaaaagatctgacgctcatcatccagcgcgtgactcacctcaatatagcactacgatgtgcaatccgaggtttcaaaccctcaggacatcatttacaatcattactcacctcaaaccggcgaaatctctagctcgcgacgcctttgcccctcaaatcagcctccactcgcgtcgaatctatccacaatcagaacaaatacatcacaatatgctaagggaacaaagcccaagcgaaaacaatcaataacgggcacaaatcccgaaattgccaaaacccgagccccggaaccacttctcgaaactcagaatttttcacatcattagatgccttatctccccacgagttcatacataccaaaagttctcaaatccgacaccaaatggtctttcaaatcccaaatcaaaagtctaatttctcaagccctagttcttcaatttttaggttagtttccatgaatttctaggtggatttcacaatataatcgagctttaaaaccaaaattcttaccacaagtcgattcctcttgaatccctctttaatttccttcaaaatctcctaaaacgagtagccatgggtgaaaatagaaccaaagtcgcggacaagacgacttaaaaacattctgcccaggcctgactttccttcttcgcaaacgcggtcaacatctcatgaacgcgtagcacaaaattgcgttgaccaacttttaccttacacgaacgcaacatgcccgtcacgaatgcaatgcttccatggccttgaccttcgcgaacgtgatgaataactgaccattagaccaaatcatgcttcgcgatcgtgtatactcactcgcgaacgcaatgaagtcccctcacaagcctttgcgaacgcggcatggaccctcaagaacgcaaaacttatgagacccgtcccttcacgaacgcgagatccacttcgcgaacgtgaaggccaagatacctgcaactgctggaacaaaatctgcaattttccaaactccaaaatggtccgattgaccacctgaaactcacccgaggcctccgggacctcaaccaaaggtacaacacatcctaaaacctcattccaacttgttccaatcatcaaaacacctcaaacaataacaaatcactcaacacacatcggattcaagcctaagttttctaaaaactttcgaaatacgctttcgatcaaaaacccaaccaaaccacatccgaatgacctaagattttgcacacacatccaaatgacataacgaagccacttcaactctcggaatttcattccgactcccggatcaaaatttcacctaccaaccgaaaatcgccaaactctcaacttcgccaattcaagcctaattttactccgggcctccaaaacaaattccgatcacgctcctaagtcataaatcacccaacgaagctaaccaaatcataaaaattccgatcctagctcatatacaaataagttaactcttggtcaaacctttcaaattcgaagctttcatctgagactgttctttcaaattccttccaattttcctgaaaaccaaaaccaacgatatacatcagtcataatacattacacgaggcaagtcatgcccgagaactagcgatcaagtgcaaaaactcaaaacgatcagtcgggtcattacacgaggtattctgacttactttttgataaaactcatgtatataaaattcttatttgttgttttttaccgtggtctatattttttgtgatcattttgtgatttaattaatttgttatttttttatcccgattaaaatatttatgtgctaaaaaagtagtaaaaaggtatattattttatgaataaatattgttatatgtgattttatttttgtacgtatattaatatgtgactttattgttgtttagtgccttttagtgttatgttgtgttcttaattgttatgtagtgccctttagcatagtaaaactgatgataaattttagcttatggtaattgactttgtttatggccatttagagtagtgttattgtagtactctttaagattatttagtgtagaataaaaaattatgtgctctccttaacaaactcgggtagagtacttaattatatatttaatgtatcagtatataattatcaaatattagataggaatcataaaattatcatttgccgagaactggcaaaatatgaagttaacaaacaaatcgttgagaatggaataaattcaatattatttactattaagtttgtggtattttttatatgattaattattgagtatatcttgattacttatgaaattgtaatatattataattctattataattcaaaattaactttaaaaagatgatagttcaaacaaaaccatgtagaattttagtacaaaaatgttggaaactaacatatgaaatattaatacataaaatttatcaacctaagtatttgttaaatgaatagttattaaattatatttatagttattgaaattaatcatttaattatttgttaaccccaaaaatatacgaaaaaagattaaaaacaacatataaaatatagagaatttgtcaaactaagtattttctatatgaatacttattaattataacacgtatatttatgaaaattaattatctaattctattacatccaaaaatagctgagtaagaaaaaaaaatataaaataacaaattaacatataaagtaatgtaataaactaacatataaaatagtaatatataaaatgtatcaacctaagtaataatagagaaacaatatcgattaaatattaatataaaagatattgaaatatatttaaagatgttaaacaattaaacagaaaatactttaattaatattgttcaatttacggacatcgtcatggaggttccccctgtgcatcctggacttgcatctcgagagctactcttgctacagggcaaccataggtctttacacatctgagatggacagtgtctgccccggatattccgccccagacgtatagacgatatgtgggagttcactagggaccacccactgcatccccttatagttagacacctccagaatacgggtttctacaagatcatagagatcggccggttgcagttcgactgggctttaatgggttcatcataccattctttaaaagcacattgatttttgtcctaccaatggggatgataacacaacactattaattaacatgttatataaaaactattaacaaacattttttcaaaaaataataacttactagttgttgatacgtctagcgtctgcgccctagattgtaatttgaccaacatggcttcaaaattgcatgttttccacagtaacacattggtatgccattgcgtccagacatgatgtaatgctcgaaaaataaaaaattaatggaaagttgttctattcgttttgttacaatacaaataataactaaaatgtgcgaggtttttataggcagctaagagtgattttaggttacataacacatattggtgatgtgctatgttacccgtgctaatgtttctttagggtacaagtgggtgcagctttttagatcgacaactttttcagctccacaattttttcaggccgatatgacaatacacataatgcatattggtgacgctctatgttacccgtgataatgattctttagggtacaagactgctttttcaggtcgacagctttttcaggttaacatgacaatacacataacgcagattggtgacgcgctatgttacgcatgataatgattctttagggtacaactgggtgcagcttttcagatcgagagcttttccaggtcgataacttttttaggtcgacatgacaatacagataatgcatatcggtgacgcgctatgttacacgtgatatgattctgtagggtacaaatagatgcagctttttcaggtcgatagctttttcaggacgacatgaaaatacacataacgcatattggtgacgtgatacgtttaatatacaagttcatgcagtttagttcttcttaagttgaaccaagaaatcagtattcaaagactatttgaagaatcattgcaacattcatttaaaaaatgctactaacatttaataagtggttcaagaagaggtaaaaaggtaaaggtagttcatcaaatccacatggaacacgtcataatacaataaattcctacctgaaaaacatatgctaggttgttatactggtttggttgatgacaagtggtatggtattctacgtcccttggaaaataagcctatcaatatacacagtgatctcaaagttgcagggcacattattgagggcaaaacgcattctatagagcctgaaggtatgcgaatttagggagaaaaactacaataagttcccctttactcaaaacggtgtaattatggagtactatgtcactggcatggtctaggtgcaccacaagcactgtctgcaaccttccaaacaaacacacacaaagatgaactagaagtgattcggcctttgatgtagagattttagagatgaaaaaggcactagccgttcatcatgcactggatgaacttaactacctggaaggaatggaggatcaatgttggaatttattagaaaataaaaaattacgtagagacaataattatcctatttacccaatagctgtcgagtgggagggactacctaagtttctaccacagacgttggatgtaagagtcccatattattgtagaaatcaagcaagtggttttactaatgatatcgatgaaatacgagaaatgtgtgtcaaatagggcctatattatgatgccctcgatccgaagggtgcatacaagatgttgacgaagaagatgaagacaatgataatgaaatagtgccagatagtgacgataatggcgaataaaaattgttatttatttcttgtggtatatgttaaattgttgggttgaatctttaatgctaaatatcaattagatttaatcctattggaaacataattatattttagaaattttgcaaactgaacatttacagacatttagtacaacaaaaatactgcaataaaacactacatttatccttgataattgggaacattagatgaactgccacctggagctgaattaccaccattttccaaactagctgaaggacatttacggcggtcgtatcctgtttgggaacatataccacatttacgcatataaaagggtatcaccaacatccatttggttctgtatgcacgttcttttttgcacttaccgttgacgcacataatccttattacacaccattttaaatgattccggtggccaataatgctcagtacccactagctgcaactgtccactatatatgtttaagtatgcaacaacattatattctttatcaatgtacctcgttgctgcgaaacctgtatgttgaaagtacttcatggtatgtgagcatgaaaagtgatagattgaccattttccataggagcaaaatcttttggatttattgacaacatgtatattattctcgcggttgtcatgcagaccaatgcgaacttcaaaaatatttagcttgctgcaatactacaaaaattcatgccaccgtactcgcttcttatatttctcaaatcgtttcattgattgtggtataagttcaacacccctttccatcaatgacgatgcacctctagatctttcaacaaacctctctgccatctacttgaatgacatacgcaccatggcagtgacatgcaatccacgtgcaaacttcaataacctgttgaaagactctgatatagttgtagtcaaaatttcgtcaaaatttcccatcttctactaccattcatatgcaaagtccactagtcaagctcatgtcgcatcaaccaacgataggcttctaggtcttcctatctaatcaattccttttcctcctgaagttacactcttggtgatctgttacagccatttaaatcatgtaattccttgtttggataagccccctagaagttggccttcaagtaccttacatagtaacagtggtaggaatacggttcctgtcatacacgcaaattttgtacagaacttaaaataccgccatgccgatcagatattagacaaatacctgaacattgtttgacaacgtgctccttcaagtggttcaacaataatgtccatgtctcttggctttcattggaacaaatagcaaatgctaggggaaatatacttccattagcatctactgcaacgacgatcaacaacttaatatcctactttccatagacatgagtgccgtctatggatattaccagcccacaatgcacaaaaccatcaatgactggtttaaatgcccagaatacatatctgagtatgtattctagtattttcggactccgctcaagcttccattcaaccacagtcctgaggttaagtgttgcaatgcagccatgtacttgggtagagcagaaaaggacttatcccaattaccataaacaatttcaaacgcacgtttatgctcgagaaatgcttttttgaggtgatggtacatctatattcctggtggacagattgtcacgaccccaaaccggactcggtcgtgatggtgcctctcataaagacaaggctagctgacacaattcccaaatcaaccattttccatttaaaagtggtttttataccatctataaaccattaatgtcataatgaacattgaaaagaaaaatacggaataattacacaagctcgacatcgggtgtcactagtcatgagcatctaccaaggtctgaatacaacaaaaacagtcaagtgtactaagtacagaaatggaaatgagctgaagaagtagtgttgcgaacgtcgtgcggccaccttgctaactctgatgactccgcgtctgagcaatcaatacccgctaccgggttctgaaatacctgaatctgcacacgaggtgcagagagtaatatgagtactccaacccagtaagtaataagagtaaataaagactgagcagtaggaatcaatgaatccacattcatgataactcaataagcacgtaggttgctaattcagaatacgagtcgatcgtcttatttaaaatctagccttttggtaaaaattatttaaacaggtgaaaatactttttgacagtttcagtaggcgttcaataccatttataataaaagagatgaaaaccataatcggcccctcaggcaaaacatagttcataaactgcccctcgggcaaaaaaataaacaggaatcataaactcttcataacatgaaaatctcagtggaaataacaaagccaaatcagtgattaaattctgaacatctcacaaaccccagcttaaatgaaagttgttttaaaacatttgttcaacactttcgatagaggctcaatataaagatgagtgaaaacagtcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaataagttcataaagaggccccttatgcaaagcatcactcatatgcatgtatatatctatcgcccctcgggcaagcctctcagtcactcacgactcaactcttactaatcagcgctcacacttagcactcacactcaataggtaccatatagtaaccgctacggcgcgcagcccgatccatatgtcgctgcggcgtgcagcccgatccatatatatatatatatatatatatatatatatatatatatatatatatatatatatatatatatatannnnnnnnnnnnnnnnnnnnnnnnnnnnnnatccatagatatataatctctaggcccccggcctctcttagtcattagcctcaccattagactctcagtctatctcagtcatcaatctcacaatcagaccctcagtctatctcagtcattatctcatgatcactcggatcatcagtaaaacaggaaaatagtttccacatttttaagaatatagtgataaagccagatttgagcagtaaacaggtaaaacataattgaggatatgctttcaaataaataaagggaggaaagatagtaaaaatacccttaagggtctcaacaagtcggcacaaggccccaaacatggcatacaacctaaagtacaataacatcaaatggttaactatcaaatacgcattaaaatagtcgttcgggatggactaggtcacaatccccagtggtggtctaccccacgcttgtcatgtagcatgtaagtcacctcaaagtaacacaacgatgtgtaatccggggtttcaaaccctcaggacagtatttacaatcattacttacctcgaaccggctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccctcaaatcagcctccacgcatcgaatttatccaaaatcagaacgaatacgtcacaatatgcaaaggaaacaaagcccaagcgaaaacaattgaaaaataccaaaaattccgaaattagcaaaaactcgagccctgggcccacttctcgaaactcagaaattttcacatcattagattccttatcaccccacgaattcatacatatcaaaagtcctcaaatccgacctcaaatggcccctcaaatcccaattcaaaagttcaaaatctcaagccctagttcttccatttttaacttaagttccatgattttctaggtagatttcacaatagaatcacgttgtaggttcaaaaatcttacctccaatcgattatccttgaatctctctttaatctccctcaaaaagatctcaaaatgatcaactatggaggaaaaatgacccaaaattgctgatgaaataacttaaaaactttctgccccgcactgctcgttccttcatcgcgatcacggcacaagcatcgcgatcgcgaagagcaaatcttcaagacctcagcagtacactacacgaacgcaacaaataccatgtgaacgcgatgcttcagcttaccatacctatgcaagcacgagccctctagtgcgaatgcgaagagaaattcctcttggaccccatttcttatacgcgaacgcggacagcctcatgcaaacgcgaagcaccagctcccagccttccatgaacgcgaggccacctatgcgaacgcgaaggtctaaattctggccttccaaattccttctacgtgatcgcgatataccccatgcgatcgcgaaggcttaaatgtctacaacacctgaacaatttttctacaacattccaactccaaaaatagcccgattgaccagctgaaactcaccctaggcccccgggacctcaaccaaaagtacaaacacatcctaaaaccttgttcaaacttgttccaatcatcaaaatacctcgaacaacaacaaatccaccaattcacatcgaattcaagcctaaatttctaaaaacttccgaaatacgcttttgatcaaaaacccaaccaaaccacgtccaagtgacctgatattttgcacacacatcccaaatgacataacgaagctacagcaactcggaattccattctaacctctatatcaaaatctcacctatctaccggaaaacgccgaaatctcactttcgccaattcatgcctaaaccttccagggacttccaaaatgtattccgatcatgatcctaagtcccaaatcacctaatggagctaaccaaatcataaaaattctgatccgagatcatatataagcaagtcaaatattggtcaaacctttcgagtttcaagcttcaaactggaaactgttcttccaaattcattcagattttcctgaaaaccaaaaccaacgatttaaataagtcataatacatcacacggggctagtcatgcccaagaactggtgagcaaagtgcaaaagctcaaaacgactggtcgggtcattacacagatgttataaactctttgatcttgtaccttatggatgcttcaatgtatgtaatcaagacaagagaaatcaagccaacattaaagttaaaatgattcctactaaatgtgtccatttcacaagtgtgggtgccaatgtgtttccccacaatccacatatttgttttcaactttctcgcacgcagcatccaattacaaccttgaaaccatctatgacaaataaccttgtatacgtccgtagatgactcatgaaccacgatatcataacactcttttatgttgtactttcgcaccgctctgcttaggcacgctttatcagcaaaaaatatattctttgatagcaccgttactctagattcatcccccattgttgtccaaattttgtcaagatcccttgtgagggtatccatatccggcatacttggaaaataatcaaggtagaaaatctcccttgaatgaaacgacacatgggactcgtacactcttggtctaacgggaggtggagcatgctccctcgtcaaatttggttcatcattctcgtcctcatcatcatcaccctcatcagggaagggtgtgtcatctctaaactcatcaacattgttgtcataatcactatcatcttcccgactctgcgcatctgccagatcccaattaaatatgtcgtctccgggtaattaagtaaggacatgaccttcaagttgctcgttttcacttcacaaccaataaaataatgagtttctcaaattcatccaaacattacatataaactgtatcacttaacttacaaatcataatatgttgatatcccatgatgcacattatcctgttgctgatgactcctggatggaccaccatgatccaacataccaaaactaggcatattccaactgtccgttggttcataacttgtaaaattcatatctagtcggtaccccctgtggaatatatcagtgttaatacaaacataatacataaaaataaacatcgtaacacaaagaaaaattgaagtttactactcggtttgtggattatgtaaacttggggaaaaattatatcctcgctcctcattcacccgtgaaaataagtttagatctggctaaactctttcacttgaaacctgttcggataaaattgctccaattaagccacttgataattgcgagatatcattattttacggaccctcaatgttgcgaacgtcttcagccttggcatacatttccaatatttttatcacaagaagttttcggttcatccgaagtcctcataaaatctatcagagcttcatcctattcgatgtttaactcagcataccaagtaaccccttgcggagtaatagattacggatatcttcctgttactttaatattaaccgaacgtttgtgcacactcatttttttacataacaacgatactagtctatcgtacttcattgtaagtggcaacttaatatgacactgtagataacaactatagcatactgagttattctctaccacaatctcaacccccccccccccccccccccaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctaaatgaatttttaccaaattctgaaactccttaaataagaaaaaataccagtccgggggtacaataattgaggtatagcgcatgtataataggcgctatatatgtagcgtgtatattgcatgcgctataccctcaattattagtgggtcaacacggttcagataaaatattggtggggcaggaaagttcaaatatagcgcggctattcaccgcgctataccttaatggacaaacgtgtcgttaaggtatagtgtggtgaatcaccgccctatatataccacgctatatataaaatggtagtcagttatttttttcacctattattgttgtttgagtccaaaaaggtattgttgtttgagtccaaaaaggccacaatttggttccagactctaatatttaaatcttttctaatagtacaagggtatatttgacatttctttccgatttaattaaattactcagctagccagtgtgtaagagaagtttatttaaactaattaatgcatgatggttatgtccatcaattgaaatcaacaatggaaaagattgtagaaaacatgtgattttactgatcgatgttaggaataaaaacttgtaaaaccaatgttgggagttgtgatgacccaagagatcatcacttgttttaaaatgaaatttctgtgttctgaggatttaaaaacctcttttagcatcacctcgatttgcatgcacagtccgggtgcgtagtcggaaagcttatatgtgaaaatctgtgaaaaatgataaattttgactataaatgaattattttgacttcggtcaacgttttgggtaaacgaacccggaccggtgatttgacggtcccggaggatccgtaggaaagtatgggacttgggcgtatgcccataatcgaattccgaggttccaagcccgagaattgaatttttgaagaaaattattttctgaaattttttaaaggatttggaaatgaattttgattagaacgtgttggtatcgggtccgtattttggttccggttcctggtaaaggtcttatacgttatttaagataattctgtgaagtttggtaagaaacggatgtcatttgacgtgatttggaccttaaatgcaaatttgattttttaagaagtattgaaatattttattgattttgaagtttaattcgatgttgatgatgttattttggcgatttgatcgcacggataagttcatatggtgttttggagttagtaagtatgtttggtttggagcccctagggctcgggtgagtttcggatgtgtttcagaaggttttaaactcttaaaaagtcgcaggttttcagttgctcgtattctggtattttcttctttgcgttcgcggaggactctcgcgaaggcgatgagttaattgtgctgaaggaaaattccttctatgtgaacgcgagaccgaggtcgcgaacgcaaagctttggggggtctacccttcgcgaatgcgggcctggtatcgcgaacgcgaaggcttgtggcttggttaggggaaagggaaaattatacctatgcgaacgcgactacttggacgcaaacgtgaaggctcaaggagttacttctccgcaaacacgagccatcttctgcgaacgtgaaggtctgtcatacctaaccatcgcgaacgcgatgaccaaatccgcccagttattttaaaagtccagaaatagaatgcattacaagatttaacccatttttcacaaacttcttcttctccacacctcttgggagatttttggaagaacttcttcaccataacctcatgggtaagtaatctttgacttgttttcttccatttttatcaacatctactagatttctaggcctaaagcatgagattaagggtagaaaattagggatttgggtagagttagggttttttgattatttgggaatttgacctcgttttggggtcggattaaaaaacaaattatatattcggtttcgtgggtgaatgggtgatcgagttttggtccgaacctcatattttgaccaagcaggcccggggtaaatttttgactttttgggaagaatgattagaaagccataattaagcattggaattggattgtttaggatttattgatgttattaagtcaattatgtctagatacaattgttttggagccgaattcaaaaggaaaagcggtgtttgaggcttgagttgacttttgaagtttgaggtaagtgttcagtctaaccttagcttgagggattaggagttgtgtcttatttgctatttgtttcttattgagtacgacgtataggcatggtgacgagtatctatatgttggtgtcaagcatgaccgtgggtcttatattgtgattttcatgacttcgttgtgttattcatgccttggtgaaggtttctattgttgtgtaaagtttgtggaaagaattgtgacctatgaacattgaggagcgttggctcaagttgtataacgaattgtgaaagtataagtgataattgaacctctagagcattggctcgagttgtgaagtgaattgtgaagtaaaagtgagaaagagaagagatcattatgttgcccccttgccgggctattgttgagttgtggttcccttgcattgtgttcttaattgatattacggatgcttaggttgatgattctttgtgttgggtaaggattatggttattctcggggaacaagtttggttatagctgaggtagttagatgttgtaacaagtttgattatagctgaggtagttagatgttttggttatagcaacaagtttgattatagctgaggtagttagatgttgtaacaagtttggttatagttgtttctcccttgccgggacgtaattacttatgctgtcggatcccttgccgggatagtgtagaccttattgatcccttgtcgggactctcgttataattgtaaatattatatgtggatcgggttgcatattatatgtggatcgcacgccgcaacaatattatatgtggatcgggttgcacgccgcaacaatattatatgtggatcgggttgcacgccgcaacaatgatatatgtggatcgggttgcacgccgcaacaatgataaatgatatggatcgggttgcacgccgcaacaaagatatatgtggatcgggttgcacgccgcaacaatgataaatgatatggatcgggttgcacgcaacagtgttgttatatattgggatcgggttgcgcgccgcaacaattattgatacaagtgtgtttagcttggatattagtttcttttgttttgctgtgaattctaagctgcccttagactgttactcttgatttactgttaatactggtatacccccgtagcatgtatccccctcccatccttacttgttcatttctgttttattttccgatgtacattatatactgcacaggtttatttggtagtctggtcctagcctcgtcactacttcgccgaggttaggctaggcacttaccagcacatggggtcggttgtgctgatactacactctgcactcttttgtgcagaccccagtgttgtagacttcggaccgcggtgggattgctgattcttgttcatcaggcgacccgaggtagccctgcaggcgtccgcaggccttggcgtctccttccatctactattcctatttctttcatgcatttccagagacagtgttgtatttatttctttcagacctttatttgtagtgttcttagaccgactgtgaaactgtgacaccagttctgggtagtcgagattcaaacagttgtattggattcatgttctgatagcttattgctttttcttccgcttatgttaaattccgttgtttaaatgttattacttcgaaattgttaatgaatataaaatgggtaaaaaggtaaattgtgcaaataattggcttgcctagctcgtattagtaggcgccatcacgactcccgagggtgggaaatccgggtcgtgacaagttggtatcagagctctaggttacatgggtctcacagttcacagacaagcttagtagagtctgagggatcggtacggagacgtctgtatttatcccccagaggctacagagttaggaaaaacttcacattcattctttcctgtcgtgcgattttgttctctcagtgctaaattgaaacccctactcttgtcctttcgcgcatggcgaggtcacgtaccgcttcttcagccgaacaacagctcagaccggtgataggtcagctacgtcttcggaggctttgtggaggttggataggttcaccaagctcttcactactactttcagcggtgcatctactgaggatccccaggattatctagacagttgtcacgaggttctcaggaacatggggatagttgagaccaatggggtcgattttgccacttttcgcttgtctggatccgccaagacttggtggagggatttctgtttggctagaccagccggatcaccagctttgacttgggagcagtttactcagctatttctggagaagtttctccccatcactcagagagaggcctatcggaggcagtttgagcgtctccagcagggttctatgactgttacccagtatgagaccagattcatcgacttggctcgtcatgctcttcatacttcccaccgagagagagagggtgaggaggttcattgatggacttattcagccgattcgtcttcagatggctagggagactgggagtgagattactttccaggaggcggccaatgtggccaggagagtggagatggttctgtcgcagggaggtggtcatgggtcgacaagaggccccgtcattcaggcagattcagtggtacctcgtctggaggtagggattcatatggtagaggccatcctcctaggccttttcagtcagcacttcaggtttctcacggtgcttcaggtggccgtggttctcagatgcagtattctgatcagcagtcctacagtgcaccaccagctcctatcagtgcaccgccgctccagagttttcggggtggtcattcaggtcgcagggtcagtcagtttcctcagcagcactcaggtggatgttttgagtgtggtgatatggtcatatccctctcagcagcagggttcccgtgctatggttcaggcaccaggtgttccacagccgcccagccagctagaggtgggggtagagaggtgctagaggtggagcttagaggtggaggccagccagctgcaggccatcccagagatgtagttcagggtggtgggcccagccccgatgttatgctcttccagccaggcctgaggctgaggcttccgatgcagttatcacaggtactgttctggtttgtgatagagatgcttcagttttatttgatccagggtctacgtactcctatgtgtcatcttattttgcaccgtatctggtcatgcctagtgattctttgagtgcctgtatgtgtctacaccggtgggtgattctattgtggtagatcgagtccatcgttcttgtatagttgtgattgggggtcttgagactcgtgtagatttgcttcttttggacatggttgattttgatgtcatattagggatggactggttatcaccttaccacgctatcttggactgtcatgccaagactgtgaccttagccttaccgggtttacctcgtttagagtggagagggactcctggtcattctacccgtagtgttatctcttatgtgaaggctcggcgtatggtcgagaaggggtgtttggcctatttggcatatgttcgtgattctagtgctgaggttccttctattgattctgtgcccgttgttcgtgagtttcctgaggtattcccttcagacctgccgggtatgccacccgacagggatattgacttttgcattgatttggctccgggcactcagcccatttctatccccgtatcgtatggccccgcctgagttgaaagagttgaaggagcagttgcaagacttgcttgagaagggtttcattagaccgagtgtttcgccttggggtgcgccggtgttgtttgttaagaagaaggacggatcgatgagaatgtgtattgattaccggcagttgaacaaggttacaatcaagaataagtatccattgccgaggattgatgatttgtttgatcagcttcagggtgccaaggtattttcgaagattgacttgagatctggctaccatcagttgaggattagggcatccgatgtccctaagacagctttccgcactcggtacgggcattatgagttcttggtgatgtcattcgggttgacaaatgccccagcagcttttatggatttgatgaaccgagtgttcaggccttatttggattcgttcgtgatagtcttcattgatgatattttgatatattcccgcagccgggaggagcacgagcagcatcttagagtggttcttcagaccttgagggatagtcagttatatgctaagttctcgaagtgtgagttctggttgagttcagttgcattcctgggtcatgttgtatcagcagagggtattcaggttgatccgaagaagattgaggcagtcaagaactggcctagaccagcatcagctacagagattcggagtttcttgggattggcaggctactatcgtcggttcgtggaggggttttcatctatcgcagccccgatgaccaggttgacccagaagggtgcccagttcagatggtcggacgagtgtgaggcgagctttcagaagctcaagacagctctgactacggcaccggtgttggttttgcccacaggttcagggccttatacagtttattgtgatgcatctcgtattggacttggtgcagtgttgatgcaggatggcaaggtcattgcctatgcttcgcggcagttgaagattcatgagaagaactatccggttcatgatttggagttggcagccattgttcacgcattgaagatttggaggcattatctgtatggcgtggcatgtgaggtgttcacggatcacaagagtcttcagtatttgttcaagcaaaaggagttgaatttgaggcagaggaggtggttggagttgttgaaagactatgatatcaccatcttatatcatccgggaaaggccaatgtggtggccgatgctttgagtaggaagtcagccagtatgggcagtcttgcttatattccggtcggtgagagaccgcttgctttggatgttcaggctttggccaatcagttcgtgaggttggatgtttctgagcccagtcgtgtgttagcttgcacggtcgctcgttcttctttattggagcgtatccgtgatcggcagtatgatgatccccatttgtgtgtccttagagacacggtgcagcacggaggtgccaagcaggttaccttaggtgatgatggagttttgagattgcagggtcgagtttgtgtgcctaatgtggatgggcttcgagagttgattttagaggaggcccatagctcccggtactctattcatccgggcgccgcgaagatgtatcaggatttgcggcagcattattggtggcggagaatgaagaaggatatcgttgcatatgtggctcggtgtttgaattgtcagcaggttaagtacgagcatcagaggcctggtggttcatttcagaggattgagcttcccgagtggaagtgggagcggatcactatggatttcgttgttggactcccgcagactcggaggaagttcgatgcagtgtgggtcattgttgataggctgaccaagtcagcgcatttcattcctgtggcagtctcctattcttccgagaggttagctgagatctatatccgggagattgttcgtcttcatggtgtgcccgtgtctatcatttcggaccgaggtacgcagtttacctcatttctggagagcagttcagcgagagttgggcaccggttgagttgagcacaatttcatcctcagacggacgggcagtccgagcggactattcagattttggaggatatgctccgagcttgtgtcattgactttggaggctcgtgggatcagtttttgcctttagcagagtttgcctacaacaacagctaccagtcgagtatccagatggctccttatgaggctttatatggtaggcggtgtcggtctccggttggatggtttgagccgggagaggctcggttgttgggtacggatctggttcaggatgccttggacaaggtcaggattattcaggataggcttcgtacagctcagtccaggcaaaagagttatgccgaccgcaaggttcgtgatttggcattcatggtcggtgagcgggtattgcttcgagtgtcgcctatgaagggcgtgatgagatttgggaagaagggcaagcttagccctaggttcattggcccgtttgagattcttgatcgagtgggagaggtggcttatagacttgcattgccgccgagcttatcagccgtgcatccagtgtttcatgtgtccatgcttcggaaatatcacggcgatccatcccacgtgttagatttcagcactgtccagttggacaaggacttgtcttatgaggaggagccggtagctattctagaccggcaggttcgtcagttgagatcgaagagttttccttctgttcgtgttcagtggagaggtcagcctcctgaggcatcgacctgggagtccgagtccgatatgcggagccgttatccccatcttttcctcaggtacttcagtccgttcgaggacgaacggttgttttagaggtggagaatgtgatgacccaaaaggtcatcacttgttttaaaatgaaattctattcgaggccttaaaaacctcttttagcatcacctcgatttgcgtgcgcagtccgggcgcgtagccggaaagcctaaatgtgaaaatctgtgaaaaatgataaattttgactataaaatgaattaatttgacttcggtcaacgttttgggtaaacggacccggacccgtgatttgacttgggcgtatgcccggaatcgaattccgaggtcccaagcccgagaaatgaatttttaaagaaaattattttctgaaattgtttaaaggtttggaaatgaattttgattagaacatgttggtatcgggcccgtattttggttccggcgcccggtacaggtcttatatatgatttaagataattctgtgaagtttggtaagaaacggaatccgtttgacgtgattcggaccttaaatgcaaatttgatgtttaaagaagttttgagaaatttcattgatcttgaggtttaattcgatgttcatgatgttattttggtgatttgagtacacgaataagtccgtaggatgtttttgaggttgtgtgtatatttggtttggagccccgagggctcgggtgagttttggataggccacggggtgcattttgaacttagaaaaattgcaggatttttgctggtgtgatcaggcctgcaggcttcgcaaatgcgatggctcgcaaatgcgaaccagggcctgccttatctcgcaaatgcgagttgtgctccgcaattccgacctcgcaaatgcgatgcaaatgcgaaaaatccagatttcctaagggttcgcaaatgcgagcttcccttcgcaatttccaagccagcagaggtcggggcaattgcgaaaatttgttcgcaattcccacatctgagacctgcaacttttatacttagacgattttaaacccatttttcatatcctctcaaaacataaacacactaggcgatttttcaaaggcttcttcttctccaaatcaattgtaagtcatttttaactcattttcttcaatcattaacatcttttaacatgatttcaacttaaaatcaatgattttcatgggggaaattgggtgttttgggtagaacctaggtttttcaaaaattggggatttggacctcgatttgaggtccgatttcaaaacaaattatatatttgggttcgtgggggaatgggtaatcgggttttggttcgaacctcgggttttgaccatgtgggcccgggggcgatttttgactttttgggtaaaactttggaaaactcattttcatgcattcaaattgattcatttagcgtttattgatgtaattaagtaacttgtgactagatacgagcgaattggtggtggaatcaaggggtaaagctataattgaattgaattgtgttcgtggcatcgaggtaagtgtttggtctaaccttagcttgagggattaggagttgtgtcctatttgctatttgtttcttgttgagtacgacgtataggcatggtgacgagtatctatacgttggtgtcgagcatgaccgtgagtcttatattgtgattttcatgacttcgttgtgttattcatgccttggtgaaggtttctattattgtgtaaagtttgtggaaagaattgtgacctatgaacattgagtagcgttgtctcaagttgtataacgaattgtgaaagtataagtgataattgaacctccagagcactgactcgagttgtgaagtgaattgtgaagtaaaagtgagaaagagaagagatcattatgttgcccccttgccgggctattgttgagttgtggtttccttgcattgtgttcttaattgacattacgaatgcttaggttgatgattctttgcgttgggtaaggattatggttattctcggggaacaagtttggttatagctgaggtagttagatgttgtaacaagtttgattatagctgaggtagttagatgttttgaatgttgtaacaagtttgattatagctggggtagttagatgttgtaacgagtttggttatagttgtttctcccttgccgggacgtaattgcttatgctgtcggatcccttgccgggatagtgtagaccttgttgatcccttgtcggaactctcgttataattaaaatattttatgtggatcaggttgcacgccgcaacaatgataaatgatatggatcgggttgcatgccgcaacaaaattatatgtggatcgggttgcatgccgcaacaatgatatatgtgtatcgggttgcacgctgcaacaatgataaatgatatggatcgggttgcacgccgcaacaatattatatgtggatcgggttgcacgccacaacaataatatatgtggatcgagttgcacgccgcaacaatgataaatggtatggatcgggttgcacgccgcaacaaagatatatgtgtatcgggttgcacgccgcaacaatgataaatgatatggatcgggttgcatgccgcaacagtgttgttatatattgggatcgggttgcgcgctgcaataattattgatacaagtgtgtttagcgtggatattagtttcttttgttttgctgtgaattttaagctgcccttagactgttacttttgatttactgttaatactggtatacccccgtagcatgtatcccctcccatccttacttgtttatttctgttttattttccaatgtacattatataatacacaggtttatttggtagtctggtcctagcctcatcactacttcgccgaggttaggctaggcacttaccagcacatatggtcggttgtgctgatactacattctgcactcttttgtgcagaccccagtgttgtagacttcagaccgcggtggaattgctgattcttgttcatcaggcgacccaaggtagtcttataggcgtccgcaggccttggcgtctccttccatctactattcctgtttctttcatgcatttccagagacggtattgtatttatttctttcagacctttatttgtagtgttcttagaccgtctgtgaaactatgacacccgttctgggtagtcgagattcaaacagttgtattggattcatgttctgatagcttattgctttttcttccgcttatgttaaattccgctgtttaaatgttattacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttgcctagctcgtattagtaggcgccatcacgactcccgagggtgggaaatccggatcgtaacaggagttgacctcatgttctccctttcttaattctgagctacgattcattgatatcaactaacaacaaaagattctgaaaattaagttcacacttcaaattttgcggacatacgttatgaataaattaataaagtccacgttcagtgtaccctttttcgtcggagctaggttctattcctgaaatcaataagaaattgatgaaactcacatgcatgattttgccaatgtaatgactaaaacgaacttctgcatccactgtaggaactggatttccacgctctctctcttagatcaatgaaccggccaggcaagagtttcagatatcacatcagggcttcaactttggagttgacaagttgttatgagaaaaatttgcaaatgcattgtcggattctgtgctctctcttgcttctgggtcgcaattgttaaacgaggccacattatattggtccctttaaacacgcggtcattcaattcagacgaaccgaatctgaacaaagaaaaagtatattattactttaaatatatttgtttttattgttatttaaattattgtatcgtattgttaaatttgtcgttacgtaacaacgtaacgtacaattttatgtaacgaccgatttggtgtgacattgttaccttatttttttaatcatattgcccttccttattaatcatttatcatatctttttatatactaataatttattttctattaactttttctttgtaatattgcaagtttattctttatattattggtatatgacatcatgaaaacaacgacaaacgatacaatttatccaaacattgtatcatcaaaacaatatataaaacaatacaatataatacgatacatgcattatgaaacaatttgaacaaccatataatacgttacatgcacgaaataatttgtaacaaccatccaaactagctgtaagggaatggaatctgaaaaaccaaaggaggaagaaaaagaagaatagtagaaagtagaaacaatcacacctaccttcctttgctgcttacaaattgccatttagacaagctcaaacctttttaaatagtggtagattagattttagtatcttgtagttatttccatctaaattcacccaaagtccaagataaatttctttagtgtttttcagttttagaatttaacatataaaatatattttatacataaaatttattcgattcgattcgttatttttcagttttttacaaagctaaaaaaaactatcataattctccgtgaggatataaatttatactgaaaccttattttactttaaaaacctgataatcaactccgttaggttcagtttggtcaaatggtcggttttcaaagttgttttgacacgggtagttgcaattccagtggcctcactactgatgatctcaaatccctaatctcacaagtgagtattactgaattaattatgtaaggaataatttcaaagatgtttcttcgtgtttccctctatcacattatctccctcatggttcataatattatgtttaccttcattattttaattattttgtaataattttctacctatttttcattaatataatatagtttgagaaactctcctttttctaatattaaattttttcaattaattatttctatcaaaatgtcatattttaaaaattcttttaaaataaaatcagaaaacgttcaaaattacacttttactattattgcgatgagtttgcatgccacatggcatccacctcaacgatacgacatgccacgtgaggtaatggtgccatggtggagggtccgaacaccagagggctatatttgcaccaattctattacatcgggggctataatggatcaatagtataacgaagggtataaatgaacattttcaaatagtaaaaggataattttgaaccttttctgaaataaaattgtttaccctaaaaacggataacaattaaatttatatgtggttttaaggatatgcgaattaattcaatacaaatgataaattgcgttagattaaacagatagaaggacgtaataaattgtcaactcacttaagaggaatgattccgagttcggttacagccttaatggaatgcctgccttcgatcccggattcaaaataacgaagcactgatgagcaaaagtaagaactttgaataatggacaaaatgagagtatattgccttggtatgcgtgttacaatgtgtttttaatgaataatcagagcccctttatatagttggggagttttatcctaagcacaattccataaaaggtaaaaatcttccaattaactaatcaccggttctttgccgatacgtgccgagattcacgccgtgatatctagctggtcgtgaatattacgacattttgttgatcgtgttcggttacctggtaatgctctccgaggcctttggggttcgaaccggacatggggtcatggccccgatactcacgagggtaggtgttttacccgaaccccggatcgaacagctccttgcctcgattccagttccttgccttcatgtctctcactctgtttacttcatcggaaattgaggcgtcccgtggttcagtttcatccatacacagatagtccactcgtttctcggagggtaagtttacgaaaacgatgagaaacgacatgagctcttcgattcattctccaatacgtcgtgacagaaacgacaaagaatttgaaatgccccgtcagttgcgtcataatgacttcaaacgcgtgtctgccatcggcaggctatccctggacgcgaaacggcgcaaagcctctataaatactccctccttcgttcattttttacttttgaccaagcttctaccttccaatcttcaagatatcactggctttcttcatactccaacatttttaccttcatttttcaagatttctcggtaaattgaaaacttttatttatgttctgtccaaaccagcatacttgattccttcatctcccaatattccttctcactctcccaaacttttttccatataacaatggtgaagacttctaaaatggctccccaaaaagtcacttcttcttctcaaccgaccaccaaaattgatgaaaccactcctgatgtggtcgacctggagaggtacgctgctgatgtggttaccgatgaaccggctatcgaacctcccttaaaaatgttcattcccgagggttgtttggtcgccgacgactttaaggttgagaatccctcttcggtgtagggtcagcatgaggaggcatcgagatatatatgctcgatcaccgaagatgtcctccttgaagtccgaaatgactgcaactgggcagataaggacatagtggtccccgaccctgaggaggccattactacccatatcgagggatatctaagtatttacacttatcccttcacactaggcccggtggacccgaccattatagacttctgttagaggtacaaagtatgtctcagtcaaatccacccatcgctgaggaggattgcaatcttcattcgattcatcgtgaacaagatcgactcctatcagctcacggttgatcatctactccgcttgtacagttcccgaatcttctgagggggctaataaagctcgtgcaccgaactaacaaagcatcattctcaagcatcgatgaggactggtattgaggctggcatgggagctttgctgggtaaggacctcagacttgatccctaccaaatttaggccattccccgagaggtggaatgcatcacgtaagcacgactttcctttaaatgttgatttatgttcatctcttttttcctcattggtatttgtggtggtacaattgttgctcgagtccccaacactatccctcggctcaagaagtggattgaggatatcatctcacagatgccttactccgagcgctcgtggcgcaaactctcgaagggccgttggtaggctcgttcccatggtaagatttatttcccaaataagttacattaggcttctccttctagcatcacgttctcattttcttgattcctctactttagggcagctcggggctgcatcaggagagaagaagaagaagaagaaaagaaaggctttgggttccccgagctcagagaagaaaaaaccgaagagaagattggcctataagccaaaggatagctccagctctcgagcaccagactcagacttgctctactggctcagggaagagcatgaggaggatgatctttttacggcctacgaaccgacctcccccaaagagcgggcgatagccgaggaggagacaacaaaggcctgtctttctcaggttcgggagaccgatgtagaaacgagggctcagccttctcgagacgctggctctgctccacccagcatcaaagaaatttctgggtcaccttctttcaccgaatctatgttggacaaagctcgagcggagaaggagagatataacgaaggggcctatggtgtggacgacccccttcgttgcctttttgaaggtgtggactcaaccgccctaaaagacttctccggttgggttatttggagctgccgagactatctttggaggtcagcgggctgaactcgagcccaaaattaaacaatcgattccctgccccgagcatggatctcgacaaaaagcagtcaataatcatcactgtcctggtagatgccttggttcttttcgcccccgttggagtagctagataccttcggtgcctagtaaccaataaagagtaggaaaagtgaatgaggtggacacaccgtgcttgttcaacaaagcatagcaggcgctgaaccaggtaatgcatcattaccctctttcatcttcgtattttagtctttgatatctatgatgccttttttttatatttttgcaggctttggtacttcatcataaaaattttctctggtaccagcctgaggttaaccagctcgaggctgaggtcaaggagcttgctgagaagagggacacatataagtttctcagcgagaaacataaggaagcggtcaagagtctttgaacaaagtcggacgcgggtcagaaggagcatgctgacctccgagtcagatgaacgaggccaagtccatggctgaaaggtggaaagaaaaaatggatcgattggcttcggagaaagagactgcccgggagcaactgacatcggtgtaggtccaactccgagtggcaaaagagaaggaaaatgcatgtgctcgacaaatcgatgacctccatgctcaactaggctcagctgctgctaaacgggatacctttaggaaggagctcgaatcagtgaagtctgtgtcagaaataactaggggtgatgctgaagagatggtggcccagtacagggccgatgtcgaggtagcccaggacctccttaaagttactattgagtacgtaagtggttgtcctgaagggagactctcgaggaggtccatgtccagggtttctacctgttagccgagattgaagatgcaaaaaggctcgaggccgaggccaagaagctggctgaccccaaggatggggagggctatgagggctccggtgaccccgaggatggagaagaccctgacaaccctactaacgaggtgggttctggtgaagatcgggcttaggcgccttaaggatttttctttgtttttgtattttgtctattttgttgaggccattatcgtcggcctttgtaaagacttttattggaatgtatataaggcgtttttccctttggtgattttcgagttcgtttcttttggcttcctctttatgattgcaaagatttcaaatgccttagcacggaataaaatgtagtactaaggccttgttcggaggttcaaacaagaaaagacttgttctcaatgtaatttttgtttgaaactcgtgggggctcgatatgactggaagctttacccaaagtgcttatttagatgtttttaaattatagttttaccgagggtagcctttgaaacagtttggaatttttgaaggccttatgttttgattacgggttttggatgtctacgagccatttctagggtggctgtagccttttaagttcagattatgcctaataggatttgtactttcgggcttcgatacctgagccgtccgaacttgccttggacgacagtccccgagtgggtgtgatctctttgaactggatagaggcagcccttgtgctcggtatccttaaggaacaaaatgtaatagtctgaagggacaaaatatgtatctacaaggtggaaactttctttcattcttgtgcggaatatacaagattgtaagtgtgtacaagctttgtattagggcttaagtggtctatgcggacacggttcatttgaccatttggcccttacaataaatcttatcccacaagaccaaaatgttcaagcacatagtttccttccttgctaaaatcagtacccgagggtgatggcccccagtattctaggtcgatcgtcgagaggtcttggatattgttgatgtgaccctcgattctggttcataaccagtttcgattctaagttagcatgatccaatgttgcctcattaaaaacttgccgaaaaacccatttgggacaaaaccgattcaagggaaaaatagtgcaatgcgtgctttcaggcctaatagctgcatcattccttggatattgcctgcaagttttctaattcgtaatatacataaagagaagaatgaatggggtcataccttaacaatagtatcatttttagtgggttacattcaagttgtttggtagtcgctcaccattccctactttgggtttgtatgaacctttactggtaatctctacagttagatatggaccttcccaattcggtcctagattccctttgttcgggtttcggatgttcagtgtcacctttgtcaacaccaagttcccaatattaaaatgtcaaaggttggctatacgactgtaatacctttcgatccatcatttttgggcggccaaccggacaagggcggcctcgtgcctctcgtctaataattccaagttcatgctcatggactcaccatttgactcttcaatcgcatatcgaaactgaaaatagattctcctacctcgaccagtgttagcacttcaacacagtagaccaatgagaatagggtggccccggtactagattttgaggttgtatgatatgcccacagtacttcgggcaaaatttccttccattttccttaggcgtcggtcaatctcttcttaaggttttggagtatggtctttttagtagactctgccttccatttccactagggtgatagggtgttgataggatctttttgatcttatggtcctcaaagaaaattctcaccttactaccaatgaactgctcatcgttgtcgcatacgatcttggccggcactccgaaccggcaaattatgtggtcccaaatacaatcaataacttctttcttcatgactttctcaaatgtccgggcttcaacaaatttagaaaaatagtcagtcataaataatataaattgagtcttgtagggtgcctatggcaggggaccgacgatgtccattccccatttcatgaatggcgaaggtgacaaaactgaatacagcagcttcccaggctggtggatcattggtgcattcctttgacatccatcgtattttcatacgaactcctttgcatctttctccatgttgatccagtagtagccggctctgattatcttaagaacgagcgattcggcacccgaatggttcccgcaggtgccttcgtgaacttcctcaagacatatttggtatttcccggtcctagacatagggcgagtggtccaatgaacgttctccttaatagggtgttatcttcgaacatacaaaacctggccaccttcgtgtacataactcttgattctttagggtccgagggaaacttctcggtcttcaggtaatctatatacatgcttctccaatcccaagttaagcttgtcaagtttatctcgacgtggccctcttccactaccaatttcatgagttgtacaaccgttcccgagctgaattcatcgtcatcaaccaacgatccaaagttagctagagcatcggcctcgctattttgatcccggggtatatgttgtagggtccattccttgaattgatgcagtgttacctgtaatttatccaggtatctttgcattcgttcctctttcacttcgaatgtcctattgacctgattcactaccaggagggaatcacacttagcttcgatcacttcggcccccaagcttttatctagttcgagacctgcaatcattatcctcatactcagccttattattagtcaattttacagttctaatatattgcctaactacattaactattggtggctttgacatgatgccaagtctggacccttttgcgttcgaggaaccatccgtaaagagggtccatatccccgaggaagtccccgagttcaacaacaattcccttacaacctcaagtattaggataggcgtgaagtcggccacgaagtctaccaaaatttgggatttgatggcggtttggggtcgatattcaatatcgtacctgcagatttccatggcccatttggccaatcatcttgagagcttgggtttatgtattatgtttcttaacaggtaggtagttacgacacatatgggatggcattgaaaatacggctttaacttcttggaggcgcttagcaaggtgaacgccaatttttccaagtgaggatacctagtttctgtcacgacccaaaatccactaagggccgtgatggcgccggacaccattgtcaggcaagccaacactaaataactagtaatttctcgttttagatatttctgaattcagttcttttatacatttaaacaataaggaataaattcccgctgaataaataatgatatctttaacaatttcaaaatactgactacttccatagacatcctagaacctggtgtcacaagtgcatgagcatttactagagaatgaaataaaatatagaaactgtccgaaatacaagtagacagaaatgaaaatacagtacaatactctgaaggagactccgctggctacgctagtctcgataactgcaactcacataagtctccgtatcaaccatgccgctatgccactaagccactagccacacataaacatgtgcaacaaaaatgcacatcaagtgtagtatgagtacgaaaacaacgtgtacccaatgagtatcccgtctaatattgaagaagtagagacgagaggtcgacttcgacacttattagtggtccaatagtaatatattataaatgcaagtaatcatggagttattaagaccggtagtaatttcaaataagtcacgaacaggtaaaagttccttttatattaaaaatatccggattcataatctattaatttccaattatctcaagtcagggagagcaaatatcagtatcgataaatctcaaggcaagcaataaaagcatgcgcaaatcctgccgaggacgtatgacccgattcaacaatatttaaactatgcactgccagagcgtcgaatgatgcaaaccatagatgcatctatttaatcaccgaggcgttcgacccgttccgaaattaaacacatacagacagtcaatcaagaaatcaacaaggaacaattatccaaagaaaagcctttaacaattttataaaactgaagtttaatccttttagaaattcatttaccaattcaacaggatttaagcaattcagttgtcaataagattaaaaatattccaagtatagcatgctttttgggtcctagactacctagacttaaacataatagtagctacgcatggactatcatcacctcgtgcgtacatagcccccacaaataggagcacataaccaattatttcaactatggggacaattccctcttacaaggttagaaaggagactcacctcgctccaaagttccataatcggcattccacgcccttccgaagactcaattcgatgcaaaaatgctccacaactagccatttatcatctaagcccattaatatatgctcaagtactcattataatccaatttataacaatttctaaccccgatcgaaaagttgacaaaattgccctcaggcccacatgcccggattccgaaatttctcgaagataaattttacccatggactcacgaactcaaatatatgattttctcttaatttcatacgcaaaattgtggtcaaaatccaagaatattaattttctaggtttcccctaaatccccaagtttctaccaaattttcatgctcaaatccgcacataatcaatgtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtggttagcttaccttgtcattgatgatgaaaaaccccacttgaagctctccaaaagtgtccacaccatatgaaaatgggggaaaaaaagaccaacccccgattttaaaagaacttactgcctccagcacttctgcacctgcggtcacatgaccgtttctgcggttccacaggtgtggcccctttaccgctcctacggtttctctccaggctccctttttccgcttttgcgccttaacttcgcaggtgcggtcccgcttctgcgacgagatgactgcatctgcggtccttacacttccaacccaaaatcgcatctgcgactctcctgactgcttctgcggctccgcacctgcggccaaaaactcgcaggtgcggttacaccagatatcagctgcctcaatccatcctcaaattccaaaattgatctgttaaccatctggaatccactcgaggcccccgggacccaaaccaatcataccaaccagtcccaaaacacattacagacttgctcgaggcctcaaatcatatcaaacaatgcaaaaatcatgaatctatctccaatccaggcttaatgaactttagaatttcaaacttcaacattcgatgctgaaacctataaaatcacgtccgattgacctcaatctttttgcacacaacaaaaagtccactttcggtcaaacttttcaaaaaccttcaaatttctatctttagccaaatgactccaaaatgacctacggatctctaaattcacttctggtcacgcccccaataccagaatcaccatatagagttattcctggaatcggaatctcaaacgcacattgataaccctgaaatgcacttcaatccaaacttatgagattcttccaaaaatgctaacttccataataggcactaaaacgtacccagtccggacatacgcccaagtccgaaatcatcatacaaacttgctggaaccttcgaatcccgattctgaggttgtttactcaaaaatccaatcttagtccattatttcaccttaaagcttccgaattgagaatattctttccaaattaactctgaacttcccgaaattcaattccgaccatgcgtacaagtcataatacccgaagtgaactgctcatagcctcaaactactgaacgacacgctaaagctcaaaacaaccgatcgggtcgttacattctctcccacttaaacacacgttcgtccttgaacgtgctaagaactgcactgaagttgttctaaatcactgtctaacacctcgagcacctacccacgctaccacaactcagctgggcaccctagctcgatcaatctgaagataccctttttcacttaggcaattaagccttagagcccaattccaacattcgaaattctctgccaggcttgctccaacatatgctcacttaatcaataactacacgcagcaccaaaacatgactgcataccttagttgaattcacaccttgcaccactttactcacaggaccacaataacattctcttatcaatttaatcaaaattccatgactgtgatgctcccattgcacctcatgacatacataggtcttgccctaactcttacaatacccccacgacggaaaagagtgtagaaattcataactaactaccgaatcgacaattcattgggtctatattcctttcaggaaccatcaccctattctgaaccaaataatggtctttgctccttaatatacttcatataatcatattgcaatgatcctaaatccaatgatctcagctcaccccgtccgtactactcaggcaataagccatccaaaacatgatcaaaagtctcatatgctaccacaatgtaccaatatgctaccaattcgaacatgatacataaaggaaatgaactctaaaaaggaaatccaattaccccgcttgcgaatcataatgcgacgcggacacatagctaatacgagttttccttagaaactaggaaacaaaatacataaaaatagatataaggaactgtactcaacatcatactgttgcggcgcgcaacccaatccaaacaacatacccatggtggcgtgccacccgatccacacataaaattcacataagcagttacacattgagctagattgctcattacaacaaaatatcgaatatcggtcacaagcacgctaagtgcataataccatccctagggagatatatagcgctataagctacaaactcaagcacaactggggtgcgatatacgatctgaatctcaagagccattctgctcatataacatcatctctacgcggaacctcaacacataagaaattcactaagccatctcataactcacacagcgcaatatatcattacatgaaatagctgatgacgaggtaataccccgactactctcccataaggagcgcattgctgaaatgaacacatctggcctgatatagagcccatattcacatttaaatccatccacagacctcaagctgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatcgcacttaactaggctaataacctttcaaagatccataatcaccccccttttctcataacacacaagaacaaccatcataatcggagtagtcctccacaatccacaacccaataatcgagtgccctctagtcatcaattctcaatttaacgacatcactacaatcttcatacttggtttaactcttcaatcagtcaagtggttgcatgccacatgttacaacccatattcacgtatgttagctcatggcataaggtattcgacgtaaatccataaagagattatctttaagatgataagaagttaatcttattggtcttaaatgatacaagcgtgtataaggggggttaacaagtattataagttaaacgaatcaaggatattgttagccgtatttttgggtaaacctagaggttcttaatacactcaagaggtagtgttttaaggtgtttgaatcatataatatccgtatcataagtcttgaagtgaaacaagttatgaaacaaaagtcgacaaaagttgccgcaacttaggttcatagttttacttaaacattaggtcaaatgttactaagattttctcccaatttacttagaattatgggatgatatacccaccaaatttaagatctatgagtctagtttccaacgcattaaaccgtttgtcgatacaatctcgaagtacagagatatttgtatttttgtgagactgcgccaaacacctctctatagggcccacttaggcagtttaagacatttggatatatatatatatatatatatatatatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaattttttcactatattcagaccttagaaccctagaacatcatatcaaggttctctcaagattcaagacccaaataaaggcaaacaacacaaatcaagtgtcgggaatcctgtggcgctagtaagtttcttgttcttcttgttgttgctcatttttgtgttgttccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtgagggaggttgttttaaggggtttatgttctgtaaatggtgttaaccctctagcctgatttataactaaattgttgcagtgtatcgataatggtggcacagttcttagtgtttgctgtagcaaataggcttagatcatcagcaacgaataggtgggaaatattggagcctgtgtggttgatcttaatggggaactagctaccattctgcgcttgagcctcaatgctcctagataggcttttcatacacatgatgaagatgtaggaagacatagggtccccttgtcccatgcccctgctaggatgaaagaaataagtcatacccacattcactaagatatagataaagctagtagatatacatgagaggatcaacttagtcatattattagggaaatcaaaggacaccagggtatctcttataaaagaccattctaatctatcaaaagccttttctagatcaattttaaggatcatgttagcatttttccctttcattttattgaaatggctaatatattttctgcataatgatggaattgtcactagccctcccattggacaggaagttatcttgactagggccaatgttagaggggaggacaagtttgattctactaacaattattttagtgatcaacgtgtacattgtattgcagagtctaattggtctgaaattcttaagaattgtggcattgtcacacttatggataaagcataagtaggttgtgttcacaacatgcttcatttcaaggctgtggaaaacctacttacaaaaattggttactttatctttggtagaagagtgggtgaaggccatcaggcctatggtacttggttagtatgaaagagaacatagcagccttgatctcactgatccttaagggggcattcatattagtcttattacaccccatgttttcgtacatgaaattacgtcgtaagtcagttgatgtatgctcggaaattaggtcatcattaaaagtatataaagcaagttaatcatattactttggaggttaaaaatatttaagatcaataactacaagtaccaataggattagaaggtttagaagctaaacaaatcgaagaaaataagtttcgtcgaaatagcaagtcgggaatattataacccgtactttttgggtcatattagggttattaatatgataaggaggtgatattatgaggtgttttggtcatattatagtcgtgtgttatgttttgaaatcaaacgaattaagaaaaaaggtcgacaaaagttgtcacaagttacgttcataatttacgtaaaatttaggtctaatgttactgatcttttctctcaatgttattggatttatggggttattcatccaaaaaattgaatataaatgaatttattttccaattcattaaaccgttcatcaatacgatatcgaagtggagagatattttgcgagactacgtaagcagctccctttgggacccacaaggtcagttgaggattatcttgatatataaagttatagccttcatctctaaggctcatttcgacccatataagacctaaaaagtatctctatatatcttaaatacatccttagggttttggagcaattccataatccgcaactcaaaatcaagatgcgaacacatcaatgcgattctcacgacatatgtaagactttgccatccccttactccttataactcatgttttggaaagagcttcgtggctaaggaagattttctcctctatattttagttatacaagcataattaagggtatggatcaaagggaacaagttttggaagtgagaatacaagaggtatatagggttttcgtttcatttttgacatgatttgatttaactatgttctagacttttctcttaatcttttaagggttgttcaaggaaaattttagcatatatggtatccttgtataattcaattccatatgtgaattatggaagaaactagtttaggttgaaacttcaaagtacaataaaaacagaaagagtgaattgcccatttgacgtatgtcatccggacatatgtttattccgttcctttgatgtttttacgtatacctaacacccatataatcataatagcttcagttaagtatatataagcttaattattaggtgttgatgcatagattaatcctaaatcatatttatactttcatgtcacaagttagccactatgagtcgacattacgtcacagttctgttcatgttacgtcacaagttagccactatgagtcgacattacgtcagagttggacaaatatttagtttaaagggcatcccgttcctcaagttcttaatattaaccctaggtgatttcaaaccttctaaagtgattctagtgccggaaaatactaatagattgctagtttcacttccttgttgttgtgacagcattatagggatatttcatggacaattaaggtcaaattggagttgttctttctggctaaaggtaaggaacctcttactctacatgtatttaagattatccaagttgcggctaagtcattgaagctagaacttgtgaaatatatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactattttgggaggttcaatatgattaacattgatgttgttttggctatttggttattttttcacttgtaggaagtcatataaataggggaggtgctgttcgcttcctcgtaaaataggttgtgttcgatacatagtagttacgacgcctaaatgataacgatagtgtcatttcttattgtaggctaaggagccgtgaaattgcatatcttgaggttgggaagaatatacaaggtatgtgaggctatccctttccttcttttgcacgaccccgattgtacataatgtaatgaacaagattctaaagatactctactcttagaagctagcagtacttacattgtttccctttttatggagcgattgatgttgatgttgcatctcttattcttatgttatcaatgttgttggtatttccttattcttataagattaatgataaagcgttagtcctaataagtgtacagaggataccgaccttaatcactccggaaggttcaaaatattattccaatgagtccagcatgcattgtatatatgtatctattttactctaccgagccgcgctatagacggccgggtacaacacctattgtgcaaccactaatcaattgggttttaccaaactacatgtggtcgggtacgattctaccaagccttatgatggccaggtacgattttaccgagtcttttttgaggtcgggtatgatatgatgatgatgcccacagaggcgtgtgttttaaaagtttatgtatatatatttttgtatcatgcatttcatgtcagtagcctacagaggtacccagatattacaggttgtatattctctatccttattcacattactatatatacttatgtttttcttccttgcatactcagtactttattcgtactgacgtcttttttatttgtggacgctgcatcttgtgctgcaggtcctgatagacgggtagatgcagctcccccaccatagtaggctgcctagttcagcggttattgacgagatcccttctccggacttgtcgtggtcttggtatgcatttttgttatagacattatgggtatgtcagggccctgttccggctatgtttcaacacttatgttcctttagaggcttatagataggtgttggctcatgtatagtttggtatgccttgtcggctgaatttttgttgtatagcctttcatggtagcgtggtagctcgtaccttatatataatttcttgattatctggtcatcccatgttatgtatgttcatgccatcatattttattgttggttgtccatgatccatgtctaccatttatattgatctcgtcatccctaaaagataataaagaaggttagataaaatgtacgttggtgcttggcaagtatggctgggtgctagtcatggcactccagtttgggtcatgacaaacttggtatcagagcaagtgtgtcctaagggttgtctatgagacgtgtctagtagagtcttgattatggatgtgtagcgcgccacatttataatcaggagggtacatgacatctagggttgttaccttcttcctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagtgttcgtctctaatattcaccttattctctttcagtaatgcctttgactaggaagcaaatgattagtagacggcttgatatagaagcgagagagggtaccagtcaggtgccccaagctagatcaggacaaggtgaggctcagagtgagatgccctctcatacctcatctactctatctcctccagaggatattaggaggcaccgagcacctccagttcctccttctggaactacagaccaagatatgtggagtgctttgcagttgttgactagcttggtagctgctcaggcttagacacagaatacaggtgatgttgataaactagttagtacgagagttcgtgattttattaatttagaccctccagtgtttaccggatcagaccccaaggaggacccgtagacttttattaactaggttcatcgtacactgtggggttatgcatgctagtgatatagaggtagtagagttggcttattatcggttacgggatttaacggttttctggtatgatagttgggagagatccaggggtccgaacgctccttcggctgtgtggaaggaattttttgaggcctttcttcgtcactacttgatagttgagatacgatgagctagagctgataagttcttgaaccttaggcaaggtaatatgagtgtgcgatagtacagtatgcagtttaattctttatcaaagaatactccccatatggtggccaagatgagtgatcgggtgcatatgtttgtgaacgggttgggaccatatctgataaatgagtgcacaacagcctccttggtggagggcatggatatttcccatattcaggcttatgcccagaccctagaggatcgtaagcgccannnnnnnnnnnnnnnnnnnnnnnnnnnnnnnnnnnnnnnnnnnnnnnnnnnnnnnnnnacaaaaggtagatagggagaaggataggggccaacataagagggcgagatttgtagggtattctgatgacttcggaggcagtgtcagatcccaatcttcgaggagttcggtgccatctgtagctagtgctcctctacagtttcagaggcctcgatatgatcgatttacctattcaggtccaggtcaaagttcgcgggcattaggctcgcaatataacagagatactagtcagacgagacccccaacatcacgttgtgatcagtgtggtaaggcccactttggactgtgccatcgaggttctgatgcgtgctattcttgcagacagcctagccatataatgcgggattgtcctaatataggaggtggtggtatggctcagccgactagatctgtgtctggttcttcgtcatcaatttgatctccagcatgaggttttcagcagtcgacaggtcgtggtagaggtagaggtgcagtgccgcattcgagtagtgctcaaaatcaaacctatgctctagtaggtcgacaggatctcgagtcgtctctagatgttgttacaggtatattgtctgtattttcttatgatgtatatgcgctgattgatctgggatccacattatcatttgttacaccctttgtggctaataagtttggcattaaacctgaattgataagtaaaccacttgcggtatctactccgataggagattctgtgatcactaggagggtatataaaggttgcacagtgatgatttgtagtcgtcaaacctcagcaaatttatttgagttagaaatggttgatttcgatgtgataatggggatggactgtttggcctcatgctatgcaaatattgactgtcgtacgaagatggttagttttcaatttcctggtgaacccgtcattgaatggaaggggaacattgctacaccgaaaggtaggtttatttcctatcttaaggcaaggaaaatgatctcaaaaggttacatttatcatatcgtttgcgttagggatgcggaggcgaagccgcctactctacaatcaatccccgtggtcaatgaatttccaaatgttttcccagatgaactcccaggccgtcctcttgaaagggagattgagtttagcattgatgtgttgcctgacactcaaccgatctatatcctccatatagaatggcctcggtagagttgcaagagttgaaggcgcagttgaaggacttgctagataagggcttcattaggcctaacacttcaccttggggtgcgccagttttgtttgtgcggaagaaagatgagtcgttaaggatgtgtatcgattatcgacagttgaataagtttactataaagaacaagtatccacttccaaggattgacgacctttttgaccaactccagggtgccaagtatttctccaagattgacttacgttcagggtatcatcaggtgaggattaaggagaaggatgttccaaagacggccttccggacaagatattggcactttgagttcttggtgatgtcgttcgggctaacaaataccccagctgcttttatggatctcatgaatactgtattcaggccctatcttgatgtgtttttgattgtagtcatttatgacattctagtgtattctcgttcggaggcggaacatgcgggccacttgcggatagtattacagacacttcaagattgtaagttatatgctaagctctccaaatgtgaattctggctgaactcagaagcattacttggccgtatgatatctgacgagggtattagtgtcgacactcagaagatcgatgcagtaaagaattggccgagaccgacaacaccatcaaaagtccgcagcttcctggggctagcaggatattataggcggtttgtagaagggtttttctttatatcagcaccattgactaagttaacacagaaaactaccaagttccagtggtctgacacttatgaacgtagttttcaggagctaaagaatcgattaacatccacaccagtgctcactctccctgaaggaacagaaggttatgtggtatattgtgatacctcaggtataggtgtggggtgtgtattgatgcagcgtgggaaggtgattgcttatgcatcaagacaattgaagaagcaagaaaagaattatccaacccatgatttggaattggttgcagtaatatatgatttgaagatatggcggcactacttatacgtcgtccatgttgacatctacacagatcacaagagtttacaatacatcttcaagcagaaagagttgaatttgaggcagcgtaggtggcttgaattactgaaagactacgacgtcgagatattgtatcatcctggtaaagccaatgttatggcagacgctcttagctgtaagctaatgggaagcttagtacacattgaggcaggtagatgggggttgactaaagagcttcatcagctagccaatatgagaatcagattgttagactctgatgatggaggtgttactgtacataatacatcagaatcatctttgttagccgaggtaaaagtacgacaatatgaagatcctatcttagtacgattgaaagagagcattcagtagtgtaaaattacggcttttgagatcggaggagatggggcactaagataccagggccgattatgtgtgcctaatgtggcagggttgtgagataagtttatgaatgagattcatcaatcccgatattccatccatcctggctcgacaaaaatgtatcatgatgtcaaggagcagtattggtgggataacatgaagaagtctattgcagaatttgtagcccagtgtccataattgtcaacaagtaaagatcgaacatcagaaacccggtggattccttcagaatatagagattccgacctggaaatgggaggtgattaatatggactttattattggattaccttgctcttatcataagtttgactccattagggtgatagttgatcgacttacaaaatgtgcccattttttgccagttaagacaacttacttggctgaagattatacgaagttgtatatcaaggagattgttaggcttcatggtgtgccggtatctattatattaaaccgaggagctcaatttatggctaacttttggaggtctttttagaagggtttaggcacacaagtaaatctcagcactgcatttcatccacagactgacggacaggctgaacgtattattcatacacttgaaaatatgctacgagcatgtgttctagatttcaaggggaatcaggatgaccatcttccactcatagaattcgcctacaataatagctaccattccaatattaaaatggccccatacgaggcactatacgggaggagatgtagatcaccagttggatggctcgaagtcggtgaaacagaattatatgggccaaatttgattcaccaaggcattgagaaggtgaaagtgatacaggagcgattgaggacggcataaagcaggcaaaagtcttattccaatgactgacgtcgtgatctggagtttgagtttagtgattgggttttcctgagtatctcaccgatgaagggtgttatgtgtttcgggaagaaaggtaagctgattctgcggtatatcgggatgtataaaattcttcaacaaattggacaggttgcttatgagttagaattgccatccgaattggaatttgtccacccggtattccatgtatctatgttgaggaaatgtattggagacccttctcgagtcatcccaatcaaagatgtacaagttatagaggatctatcatatgaagaagtgccagtggcaatattagatcgacaagtccgcaagctgagaacaaaatatgtagcatctgtcaaagtattatggaggaacaagaatatggaagaaatgacatgggaagcagaagagaagatgaagtctaaatactcttacctattccacaatgaagataacaaggatgttggtggaacgcaggatacattggaaggtgaaactgctctatgaggtaagcaataacttgagaatactcttccttaatacaaaatggtgatatgtagataatgtaaatatccataatgctttgtgtagccttgtgaggacatatgttgggcttaactgcttgcaagttttgctagtgaccattttataagggaaaattgaccggaaatttccattggaatccacgatgatttggactccccataaacctttacattcgaggacgaatgtccctaaggggggagggtgttacaatctatattcacgtatgttagctcattccataatggactcgacgtaaatccatgaagagattatctttaagatgataagaagttaatcctattggtcttaaatgatacaaagatgtataagggtggttaacaaatactagaagttaaatgaatcaaggatgttgtcagccgtatttttgggtaaacctagaggtgattaataaacttaagaggtagtgttttaaggtatttgaatcatataatatccgtatcataagtcttgaagtgaaacgagttatgaaacaaaagtcgacaaacgttgtcgcaacttaggttcataggtttacttaaacattaggtcaaatgttactaagcttgtctcccaatttacttagaattatggggtgatatacccaccaaattgaatatctatgagtctagtttccaactcattaaaccgttcattaatacaatctcggagtagagagatatttgctttttcgcgagactgcgccaaatacctctctatggggctcacttaggcggtttaagacatttggatatatatatatatatatatatgatacctccaaccctttttaagtcaatttttttcactatattcagaccttataaccctagaaacaccatatcaaggttctctcaagattgaatacccaaacaaagggcaaacaacacaaatcaagtgtcgggaatcccgtgtcgctagtaagtttcttgttcttcttattgttgctcatttttgtgttgttctagatcatgtgggaggtttatttaaggggtttatgttttttaaatacttactcaagttcttaatattaaccctaggtgatttcaagccttctaaagtgactctagtgtcgaaaaacactaattgattcctagtttcgcttctttgttattgtggcagtattggagggatattaaggtcaaattggagtttttctttctgtataaaggtaaagaacctcttactctgcatgtatttaagattatccaagtttcggctaagtcattgaagctagaacttgtgaaatatatatcgaaaagattggtagtaatgttatcggttggtggactattttgggaggttcaatataattaacattgatgttttttgtctgtttggtgattgttttcacttgtgggaagtcatataaatagggtaggtgttgttcgtttcctcataaaataggttgtgttcgatacatagtagttacgatgcctaaacgataacgatagtgtcatttctcttattgtagactaagaagccgtaaaattgcatagcttgaggttgggaagaatatacaaggtatgcgaggctatccctttccttcttttgcacgaccccgattgtacataatgtaatgaatgagcttccaaagatactctactcttagaagctagcagtacttacattgtttcccttcttatggagcgattgatgttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctcttattcttatgttatcaatgttgttggtatttcctaattcttataagattcatgataaagagttagtcctaataagtatacagaggatatcgaccttaatcactttggaaggttcaaaatattattccaatgagtccagcatgcattgtatatatctatctattttactctaccgagcctcactatagatgtccaggtacgacacctattgcgtaaccaatgatcagttggggtttcccgagctccacgtggtcgggtacgattctaccgagccttatgatggtcgggtacgattttaccgagtcctttctgaggccgggtatgatatgatgatgatgtccacagaggcgtgtattttaaaagtttatgcatatatatgtttgtatcatgcattttatgtcagtagcccacagaggtacccagatgttacatgttgtatattctctatccttattcacattactattcatagttacgcttttctgccttgcatactcagtactttattcgtactgacgtcctttttatttgcggacactgcatatcgtgctgtaagttctgatagatgggtagacgcagctcccccaccacagtaggctgcccagttcagcggttattggtgatatcccttctccggacttgctgtggtcttggtatgcatttttgttatacacattatgggtatgtcggggccattttctggctatgttgcaacacttatgttcttttagaggctcataaacaggtgtggactcatgtatagtttggtatgccttgtcggctgaacttttgttgtatagtctttcatggtagagcagtagctcgtaccttatatatagtttctttattttctggtcatcccatgttatgtatgtccatgtcatcctattttattgttggttgtccatgatccatgtctaccatttatattgattgcgccagccctaaaaaataataaagaaggttagataaaatgtacgttgttgctcggcaagtatggtcgggtgctagtcatggccctccagtttgggtcatgacaccacacttatacaactttcccgtggggcacactcctacgacctttcgtttcagataacaggtctgtacatccaaaccaccagccgcactaacgctgaaaagcgatcaagaaccctcaaccaggatgcaaagcctttttcacaaaataccgacctcaagtgacactgaggacaataccaacttatttttaaacatccgaactcctttcctgctcatccgagctcgtgacatctttgtcaacaccgaatcgcaaccttgatcctcacttctaattccataccacttagtgcacccaacatgcccatatacgatagaacatgatttccatcataaccccggaaccactaatagatcaaaacttcatcatataaaaacttttcacttaactcacttcaggaggaccatatcaacacacaagtaaattctcataaccgtagaatatgcaattctctaagtagtagcctaagccaccatatccctttcgggatccgcctacacatacaggccataacaatagaatacttctgaataatatcaattacggcggccgacaagctcaccacgtaccgctaaaatccacttgcataacttgatcacgctaaaagaactgatcactaccaccaatctgccaattcaactatggctaaccaatctatcttcttccaatttatccttgattgccttagaaataataataaccccatctaacacataacacgctccattcgcactcatcccgagtgaccttgaatcacgagaccatgttgtctcaaatcccacaaactgtttcatacctcccaaatgctacactgcaagtcaaaacatcctagaagattctaggactcttcttataagctgctacaaagcttgatttttaaccgtacctataggctcgaaatcattacgcaccacactttacccctttgaatccactagtaccgttgttgagagccacccgctctgacttggccctgaatgttatcaattccatgaatcttctagtatatgaataccttctcgacgaagcacccggcaaaatcacttcccttggaacccgtatctatacaaggcgtaaatcctgaatcctctcatagaatcatcatccacagtcgcacgaccgatctctttgttgtataacccatagaattctttgcagaagcttcgccaaccatgtaaccgctggtctgctcactggagataacccacctgggaaatttacgtgccaacatattccaacgctgctgcacggggtacaatcattatgacatcaataactcatcctgagtccgaactcactctctagctgcacaggtccattcacccctcgtggaaatcaattaaaggtgtggcaacatccttccaatccaaagttatgttgtatccttcttcatttcaagcagctcctttccattgtacgaaatcttctaccgcataatagctcatacttcagcttaaatccatagaccccaatcacccatcactaaaattcccaaatcattccaaactttccttaaggtgcgtagtcatcctaccacaaaacccacatgcaactccgccactcttccgctttggcggaactcactcctttaatcaactacttgaccttcacttcttatacctggccttctagaaattttaaccaccacctgacactccccatatgtctttcctcatcctttgctgcttagttgttgccttaactaaaatccatctttgtagcacttgaacccacaaatcgctactaactttaaacctttccgaagatcatctttctcgagccgtcaacatttgaaacaccgattcaatcctgaaccaccacaccccgcgatctttgacagccgattttccagtacttttgtataataacatgccccaaaggtgaatcgtagaagatcataacaccgatgaacttaacacatccaatcgaggacgacaacactacatcgtagatgaaaattccaccacgctcgaaaataccatgtctcattgctccatcaccccaaatccggacattcataggccaattgcttttcctccaccagaaatgaaatatcagatctctgaattatgcactgagtggacttcctttcaaatcattcaccgccccaacacataggcaagtatcctatcatcaagtcaatactgtgtgataactaatcgtgagcatcatagcaacttgtgcatagcctccaagctcttagaggcacaactactgatccaaaacgatagaaaaaaaaatccttccacaaggcgatgacaatagcccaaccaactacacagggagaacatcccgcaccatatctgtagtaccattacaatccttcaattctcgatttataacaagtggttcgcgtcgtgtaagattgaataggaaggaaataaaagcataagtctcaaggaattaaaccacacaatgaggaatcaagaagggaagtgctcctaacagccctgcagcctctcgaagataagtacagacgtcttcgtaccgatccgtaaaactctactagactcgctcatgactcatgacacctaaggaaacctagtgctctgataccatgttgtcacgatccaaaatccactaagggtcgtgatggcaccggacaccattgttaggaaagccaacactaaataactagtactatcttgttttagatatttctaaattcacttattttatacatttaaacaataagaaataaattcccactgaataaataatgatatctttaaaaatttcaaaatactgactacttccatagacatcccaaaacccggtatcacaagtacatgagtatttactagggaatgaaataaaatacaaaaactattcgaaatacaagtggacagaaatgaaaatacagtacaatactctgaagaaaactctgctggctacggtcatctcgataactgtaactcacctaagtctctgtatcaaccatgccgctatgccactaagccactagccacacataaacctatgtaacaaaaatgcacatataagtacgaaaataatgtgtacccaatgagtattccgtctaatctcaaagaagtagagacgagaggtcgactttgacacttactagtggtccaatagtaatatattataaatgcgagtaatcaagaagttattaagtgtgatgacccaagaggtcatcacttgtttttaaaatgaattctgcattctgaggctttaaaaacctcttttagcatcacctcgatttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacaatccgggcgcgtagccggaaagcctatatgtgaaaatctgtgaaaaaatgataaattttgactataaaatgaattaatttgacttcggtcaatactttgggtaaacggacccggacccatgatttggcggtcccggtgggtccataggaaaatataggacttgggcgtatgcccggaatcgaattctgaggtcccaaacccgagaaatgaatttatgaaagaaattgttttcttaaaaatataaaggtttttgaaagtgaaatgttatgtgaaacctgtggtattgggcccataatatggttcttccggagtccagtataggttcaatctgatttatatgtgttttcggtaaagtttggtaagaaacggaatccatttgacgtgattcggaccttaaatgcaaaatttgatgtttaaagaagttttgagaaatttcattgatcttgaggtttaattcgatgttcatgatgttattttggtgatttaattacacaaataagtctgtaggatgttttttaggttgggtgtatatttggtttgaagccccgagggctcgggtgagctttggataggccacggggtgcattttgaacttagaaaattgcaggattttgttggtatgatcaggcctgcaggcttcgcatttaacaagtccaagcctgcccttcctcgcaaatgtgagatgttcctcgcaatgccgaccttgaaaatgcgagggtgccttcgcaaatgcgatgtatgccggaaatgcttgaagtcgcaaatgcgacatttctgatcgcaaatgcgaaaagcccaaatttcctgaagggttcacaaatgcgagccttgtttcgcaattcccaagccagcagaggtcggggttcgtaattgcgaacccctgttcgcaattcccacatctgagacctgcaacttttatacttagacgaattttaacccatttttcatatcctctcaaaacataaacacactagggcgatttttcaaaggcttcttcttctccaaatcaattgtaagtcgtttttaactagtttccttcaattattaacatcttttaacatgatttcaacttaaaattaataattttcatggggaaaattgggtgttttgggtagaacctaggtttttcaaaaattggggatttggacctcgatttgaggtccaatttcaaaannnnnnnnnnnnnnnnnnnnnnnnnnnnnnnnnnnnnnnnnnnnnnnnnnnnnnnnnnnnnnngaataattgggttttggtttgaacctcggattttgaccatgtgggcccggggctatttttgactttttgtgtaaaactttggaaaacacattttcatgcattggggttgattcatttagagtttattgatgcaattaagtaacttgtggctagattcgagcggattgatggtggaatcaaggggtaaagctataattgaaacgtgaattgtgttcgtggcatcgaggtaagtgtttggtctaaccttagcttgtggtattaggagttgtgtcttatttgctgcgagttaattgtggagtatgacgtatatgtgtggtgacgagtatctatacgtcggtgtcaagcatgcccgtgagtcttgtattgtaattgttatgactccgttgggaattatttcacttcacatgttattgaaatattattgtccccttgccgggatgttgttatattgccctggttcccttgccgggatgtcgttatattgctcttgttcccttgtcgggacgttgttatattgcccttgttcccttgtcgggatgttgttatattgctcttgtttccttgccgggattctttatgattgctattgatttgtaatttggagcgggtggtactcctgtcacgagataaataaaatgggagcgggtggcatgcctaccacaaggtaaatgaaatgtgagcgggtggcacgccttccacgagatacatgaaatgggagcgggtgtcgtgcctaccacgagatacatgaaatgggagctggtggcgtgcctgccacgagatacatgaaatgggagctggtggcgtgcctgccacgagatacatgaaatgggagcgggtggcatgcctgccacgagatacatgaaatgggagcgggttgcacgccagcaacgagatacgtgaaatgggtgtgggttgcacgcctgcaacaagatgtgaaatgaaagtgaattctgcctttgtttcccttatccttgttagtagttggattttggttcctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccatctttacttgcttatttctgttttactttccgttgtatattttataattgcacaggtttaattggtagtccggtcctagcctcatcactactttgccgaggttaggctgggcacttaccagcacatggggtcggttgtgctgatactacactttgcactatgtgcagatcccggagcagctcttggactgtagtttggaggctaccttcagtccacgcaaagatccaaggtagacttgcaggcgttcgcaggcactagcgtctcctctatcttttatttcctgtttcatctttctgcttcagaaacagtgtgtcttttatttttagaacttgtatttagcagtcttagaccgtctgtggtactgtgacaccaggttttgggtgattaaggcttgagcagttgtaatagatacaaatttcagatattttatcattttcttccgcttaaatttaaattttcgctgtttatacattatcgcttcatgtttgttaaaaagaaataaatggataatgaagtaattaatttaaaggattggctttcctagcttacattagtaggctccatcacgactcccgagggtggaaaattcgggttgtaacattaagaccagccgtaatttctaataagtcacaaacaggtaaaagttccttttatattaaaaatcttcggattcataatctattaatttccaattatctcaagctagggagagaaaatatcaatatcgataaatctcaaggcaagcaatacaagcatgtgcaaatcctgccgaggacgtacgacccgatctaacaatatttaaactgtgcactgctagagggtcgaatggcgtgaaccatagatgcatctatttaatctaccaaggagttcggcccgttccgaaattaaacacatacagacagtcaatcaagaagtcaacagggaacaattatccaaagaaaaatcaattctcttttaacaattctataaaaatgaagtttaatccttttagaaattcatttaccaattcaataggatttaagcaattcagctgtcaataagattacaaatattccaagtagagcatgctttttgggtcctagactacccggacttaaacataatagtagctacgcacggactctcgtcacctcgtgcatacatagaccccacaaataggagcacataaccaattattttacctatagggacaattccctcttacaaggttagaaaggagacttaccttgctccgaagttccataaccggcgttccacgcccttccgaagactcaattcgatgcaaaaattctccaaaactagccattaatcatgtaaacccattaatatatgttcaagtactcattataatccaatttataacaattcctaaccccgatcgaaaagttgannnnnnnnnnnnnnnnnnnnnnnnnnnnnnnnnnnnnnnnnnnnnnnnnnnnnnnnnnnnnnnnnnnnnnnnnnnnattgtcctcgagcccacgtgcccggattccgaaatttctcgaaaataaagtttactcatgaactcacgaactcaaatatatgattttctcttaatttcatacgcaaaatcgtggtcaaaatccaagaatattaattttctaggtttcccctaaatccccaagtttctaccaaattttcatgctcaaatccgcacataatcaatgtatttaactcaagataggtggggttagcttaccttgtcgttgatgatgaaaaaccccacttgaagctctccaaaagcgtccacgccatatgaaaatggagggaaaatgaccaatccccgattttaaaagaacttactgcctccagcacttccgcacctgcggtcacatgaccgcttcagcggttccgcaggtgcggcccctttaccgctcctacggtttctctccaggctcccctttccacttatgcgcctcaactctcgcaggtgcggtcccacttttgcggcaagatgactgcatatgtggtccttacacttccagcccaaaatcgcatatacggctctcctggccgcttctgcggctccgcacctatggccaaaacctcgcaggtgcggttacaccagatatcagctgcctcaatccttcctcaaattccaaaatttatttgttaacaatccgaaatccacctgaggcccctgggacctaaaccaatcataccaaccagtcccaaaacacattacaaatttgctcgaggcctcaaatcgtatcaaacaacgctaaaatcatgaatcaatctccaatccaagcttaatgaactttagaatttcaaacttcaacattcgatgccgaaacctatcaaatcacatctgattgacctcaaattttgcacacaagtcatatttgacattatggacctactccaacttttggaattggattccgaccccgatatcaaaaagtccacttccagtcaaacttctcaaaaaccttcaaatttctatttttagccaaatgactccaaaatgacctacggacctccgaattcacttccgatcgcgctcccaataccagaatcaccattcggagctattcccagactcggaatctcaaacggacattgataaccctaaaatgcacttcaatccaaacttatgagattcttccaaaaatgctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgaaacgttcctgggtcttccaaaacccagtctggacatatgcccaagtacgaaatcatcatatgaacctgctggaaccttcgaatcccgtttacgaggtcgtttacttaaaaatccaatcttagtccattctttcaccttaaagctttcgaattgagaatttttattcaaattaactccgaacttcctgaaattcaattccgaccatgcgtacaagtcataatacctaaagtgaagctggtcatgccctcaaactactgaacaatgcactagagctcaaaacgaccggtcaggtcgttacactttcggcctcgcctagagtcctcctaacatagtagataggaaattgtgtaccttcctattcccgggccgggactccacttacctctatctcggatactgctaagtataggtacaactgcttgtctgacttgggagtatgaagcaaaggcaggctcgaaaggtaccgcttgagttattccaaggcttgttggcactccggggtccatgaaaagttcttcttcttcttcaataacaaaaagaaccgatggctcttgtcggaggaccttgaaatgaatcgacccaagggggctatgttctcggttagcctttgaacgaatttgacattgtccaccatggtgatgtcctctatggctttgatcttttcgggattgatctcgattcaccagttggataccatgaatctgagaaacttcccggacccgactccaaatgcgcatttctccaagttcagattcatattgtatctcttcaatatactaaaggtttcctgcaaatattttaaatggtcctctgcttgcagggacttaactaacatgtcgtcaatgtaaacctccattgattttcctatttactcttcgaacatccgatttaccaagcgttggtaagtttcttggtcatacagtctaccatatttaattatacacggagtaggcatcgagaaagctgagtatctcatggtcgtccattgcatagatcatgcaatcgatgttaggcaaagggaaaaagtctttggggcatgccttgtttaagtctttatagtctacatacattctcaatttatttccctttttaggcactaccgctacatttgctaaacaatccgagtacttaacttcccgaatggagcatattttaagaagtttggatacttcgtctttgataaacgcatgcttgacttcagaccgaggcctcttcttctgtttaaccgggtgaaacttcgaatccaagctcagcttctgagtagttattttcggtgggatccatgtcatgtcaagatgggaccaagagaagcaatctatgttagctataagtaattcaatgagttttttcctaagcccgggagttagtcccgtgcccaggtatacctttcgatcgggcaggtgctcgatcaacttgacttgctccagctcctacaatgtttacttggtggcatcagaatagtcaggggctattgaagtcctagggactctgtagtcatcatccttgcatgtcacctgcttttatggttcggttggggctggcgtcagtgattgatatttggtttctcccttggtgactgaactcgagctcttcgatgtcgaaagtgtggatatcgggaccacctcatcgaccacgaacatttcttttgcagtcgattgttctccgtaaactattttgatccctcccagtgtaggaaatatcaatgcctaatgtagcattgagggtatctccctcatgttatgaatccatggcctcctgaataaagcattgtacctcatatctccttcgatcacgtagaactttgtttcttaaatggtcctggcggtgtttaccggtagggttatctcccctttagtggtctcgcatgcaatgttgaatccctttaagactcagactgcaggcactatttggttttgcatacctagttgttccacgatccttgatcttatgatattggccgagctacctgaatcaattaacacacgcttaactagagatttattttttagtacagatattaccagtgcatcattgtggggttgcatgatgcctttaacgtcctcgttgttgaaagatacggttccctctggtacatagtctcgagcccgtttttcccttgcaatggatactttagtgcattttaacatcgacccttggggatgtcaacttcaccaatgatcatgttaatgatgtgttgaggttcctcttctcaatctatttgttggtgtccctattcctgaagtgatttttggctcgatcacttagaaattctcggaggtgcctgttgttgaataaccgggctacttcttccctcagttgtcggcagtctttggttctgtagccgtgggtgccatgatatttacacattagattggggtccctttgggcaggatcagactgcaatggccgaggccactagtatctttaatacgtctgatggctgatacgataccgacaacatcgacgttaaagttgtattccgataaccttggtgcttctttggacccgataggtctgtcaaaaccgttctttctcatgagtccccaattattatgacctcgataactccttctttactccttgcaggggtgcgtccagacccactgctccttcaatctccactctacgattgatactaatctctgttcgatcttggctcatgatcgacgtctcttttggatctgtcactggtcctaacggggtaaatggacccagaaagggtctcgagctaatcatctttgaccctgatttttgtttggtgtctgttatggacgtcgacccaagttacagccgggtattctttcaaaatttgcttcaactgttgtgaagccaacgagctttggggattgagtccttgggtgaatacctgaacggctcaatcgtctacgactggaggcagatccttccgttccatttgaaaccttgacatgaactccctgagtatctcgttacatctttgctttaccttgaaaaggtctgacttcctggtctcgaccttgatggctccggcgtgcacttttacaaaggcatctgcaagcatagtaaacgagtcaatagaattaggggggtaagttggaataccatatcatagctccttttggcaaggtctctccaaccattttcagtagaacagattcgatttcatcatcctccaagtcgttccctttgatggcgcatatgtacgaggttacatgttcatttggatcagtcgttccattatacttcgggatttcgggcttatgaaacttttttgggatcgacttcagatatgcgctcgaggggaaagccttttggacaaacttcttggaatccaggcctttcagtatcggtggtgctcctggattttggtcgaccctggagttataggtctccacctttttgtcgttagcttcgattttcttttctcctatttctacccgttccgtcaattcctcgagcatatttattatctcggggttggccccggattcatcttcactcgcctttttgtggctggttaatttctgcgagtgtttttccggaattgttcgggctcaactctactgggagcaaggctttggttctgcaactgggctatcgctgcttgttaagcctgtagcatttcgaagatcacccgctagttgatctcatcgcctttatcgttgtgcgtatccctggctatcgacctggctcccacgcgaacactattttacggatcggtgggaaagttagcatcaatggccacatgggagttggcatcgattggacctgcgaccggcaccccgtaggggtcagcatggtgaacctcgttgctgggcactatattgttgttctcgccgtggtggccagattcagcatcaacgtttaggtgagcaaattgagagtttgacatctttaagatttcgtaaaattaagatctcaaagaacaagagaaaagtagagtgtgttatggaaatttgtatcaaatagccactattatccttagccccatggtgagcgccaaactgtttaccctaaagaacggataacaattaaatttatatgtgattttaaggatatgcggattaattctatacaaatgataaatagcgttagattaaatagataaaggccgtaataaattatcataccacttaagaggaatgactccgggatcggttatagccttaatggagtgcctgtcttcgatcccagattttcaaaaacgaagcactgatgaacaaaagtaagagctttgaataatagagaaaatgagagtatattgccttggtgtgcgtgttaaaatgtgtttaatgaataatcagaccccccccccccttttatatagtcggggagttttagcctaagtacaattgcataaaagataaaaatcttccgtttaaataatcaccggttctctttcgatacgtgctgagattcacgtcgtgatatccggctggtcgcggatattaaagtcttttgttgatcgtgttcggttacctggtaatgctctccgaggcctttggggttcgaaccggacatggggccatgaccccgatactctcgagggcaagtgttttacccggacgctggatcgaggagctccttgcctcgattccggttccttgccttcacgtctctcgctccgtttgtttcatcgaaaatcgaagcgtctcgtgggatcggtttcactcgtatacaaaaataaaaagatacaatcttcctcgtgaattcagttgatgactagccttccgttttttctttccagcttttggaatgagtattggatatacgatttccacattattattgtttctcttcattgaaatctccactgccatgaaaaccgagatcgaaattttaatttggatagtgttttttggttatttagtttggttttagaatgagaaattaaaatttttaatttttttggttttgtttgggatttaagaaaataaaaaacgaaaacccaaattttttttatatatattatacagaaaagggctatatatgtccctctactatcgaatattagttatttatatcctctgttatactatttgacgtttcttacccttgtcgttagcctttttaacaaatctgcccctcccattgacggccccagtctgtgcggacacgtggcacatttttagaacccaaaccctttttctttccccacccaagatccatgcccgaaatctatactaaacccatatcaataataagaagcaagcttagtttattaagtgccttaatgcattgtctttcatcattgcaagaaaccatcaaatcaaaaccccgaaagtgaaaaataaaaccctgctactacctaattgattgattaaaaacaaaaactcgtgaaggggcgaaatatatcacgattaaaaagaaataaaaggtttacatcttcttcgttctatgctccttccttaagcaaaatgagggcttcagattcagtaggtagagctgggattggtcatttcttggttgttgtgatggctctacatgcacaggcaaaccttagtacttccttcaaccttgcttcatcttgcatttttagttttccacaaattaatttacccccgttatgatgatgtccatctcattgaagaagtattaggcatgtgcctaataagagttttctttggtttggtagccaaccttgttgacttggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgatatcgtagtgaggtgggaatatcaaaagagggttatttcttttgagtgttgtagtggtctttggagtatttatctccgacctacaaagtgtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaaggtacaactgtaaaaccttgtgactactgtttagttggtaagcagcatagagtctcatttcagacatcgtctgaaagaaaattgaatatacttgatttagtatattctgatgtttgtggtccaatggaaattgaatcaatgggcggtaacaaatattttgttacttttattgatgatgcttcacgaaaattatgggtttatattttgaaaaccaaagatcaggtgtttcaagttttccagaagtttcatgctctagtgaaagggagacgggcgaaaagctaaagcgtcttcgaagtgacaatagaggtgagtacacttcaagggaattcgaagagtattgttcaagtcatgggatcagacatgaaaagacagttcctggaaccccacagcacaatggcgtagccgagaagatgaaccgcaccattgtggagaagatgagaagcatgctcagaatggctaaactgcctaagtcattctggggtgaagcagttcagacagcctgttacctgatcaataggagtccatcagttccgttggcgtttgacatcccagagagagtttggaccaacaaggaggtgtcctactcgcatctgaaggtgttcggttgcagagcttttgcacatgtaccaaaggagcagagaacaaagctggatgataaatctgttccctgcatattcatcggatatggagatgaagagttcggatacagattgtgggatcctgtaaagaagaaggtcatcagaagcagagatgtagtcttccgagaaagtgaagttggaactgctgatgatatgtcagagaaaggccaagaatggtataattcctaaccttgttactattccttctacttctaacaatcccacaagtgcagaaagtacgaccgacgaggttgccgagcagggggagcaacctggtgaggttattgagcagggggagcaacttgatgatggtgtcgaggaagtggagcaccccactcaggagaagaacaacctcaacctctgaggagatcagagaggccaagggtagagtcatgcaggtacccttccacagagtatgtcctcatcagtgatgagggggagccagaaagtcttaaggaggtgttgtcccatccagaaaagaaccagtggatgaaagccatgcaagaagagatggaatctctacagaaaaatggcacgtacaagctggttgaacttccaaagggtaaaagaccactcaaatgcaaatgggtctttaaactcaagaaagatggaaatggcaagctggtcagatacaaagctcgattggtggttaaaggcttcgaacagaagaaaggtattgattttgacgaaattttctcacctgttgtcaaaatgacttctattcgaacaattttgagcttagcagctagcctagatcttgaagtggagcagttggatgtgaaaactgcatttcttcatggagatttggaagaggagatttatatggagcagccagaaggatttgaagtagctggaaagaaacacatggtgtgcaaattgaataagagtctttatggattgaagcaggcaccaaggcagtggtacatgaagtttgactcattcatgaaaagtcaaacatacctaaagacctattctgatccatgtgtatacttcaaaagattttctgagaataactttattatattgttgttgtatgtggatgacatgttaattgtaggaaaagacaaggggtgatcgcaaagttgaagggagatttgtccaagtcatttgatatgaaggacttgggcccagcacaacaaattctagggatgaagatagttcgagagagaacaagtagaaagttgtggctatctcaggagaagtacattgaacgtgtactagaacgcttcaacatgaagaatgctaagccagtcagcacacctcttgctagtcatctaaagttgagcaagaagatgtgtcctacaacagtggaggagaaagggaacatggctagagttccttattcttcagcagtcggaagcttgatgtatgcaatggtatgcactagacctgatattgctcacgcagttggtgttgtcagcaggtttcttaaaaatcctggaaaggaacattgggaagcagtcaagtggatactcaggtacctcagaggtaccacgggagattgtttgtgctttggatgatctgatccaatcttgaagggctatacaaatgttgatatggcgggtgacattgacaacagaaaatccactactggatatttgtttacattttcagggggagctatatcatggcagtctaagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacattatttatttataaacaagcttaatttgggataagaaattataaaggtattaccgttaatgggaggggcatatttgttaaaaaggctaacgacaaaggtaagaaatataacggagtttataaataattaatatccgatagtactagatatataaggtctcattattcatctttaaatacaaccccttattctcgttactaagtagtattttgattgggaaactttcatcgagcttctttaacttttaatatttacgagcaaaaatcagtctcatttgcacttgaattataatttattgtatttttatacctggacatgttactattaatattgtcttttaaaagttttaaccgtgactaatattaacaactctattttaagagatataatatgattacttctcattctctatgatattttttgccatagaatataaatatttaattatgttttttttttaatttttattcttctattatgcccaaagatctatttcttttcgattatgttaattatcttatactagtattagtacccgtgcgatgcgtggacaaatcatatcaaattgtgatgtagattgtttgaatcatgtgcaattaacctcaaaatataaacctctcagataaaaattatataatcattagatattaattaagaagcaggatatgaaattattgtttaaatctcgtaatggacaacctatttttgtctatattagtagtcaaactagtactagtatcatcagacactagttgtatgaggcattttttttatctcacatttttgtggactcatgtttttatggatccagaagtataagattagggtccacgagataaaaaaaagtcttatacaattcatgtaagttgtgtgagacacataataaaacttaataaaactttacttgctggatctgtacgtttgctattatccatgttttgaatatgaaacttgagcatccagcgaagagttgattttgtgctatctttcttacgtgttgacttgtcattcattgagttggcttttcatttaccttaaagacagacgtactatattattaatcaaaactagtagtcgtacccgtgcgatatgcggtaaatattaaaaaaatattaattaaattaaattatgatcgggtttgtttgatcctattagatcttattgctttattaaatttaaattgtcatcttattgtctatacgatatacccaataataaaatctctattaacttaaagatacttatatagtcagnnnnnnnnnnnnnnnnnnnnnnnnnnnnnnnnnnnnnnnnnnnnnnnnnnnnnnntgtaacttttttgttctatatttttctttattacgttatccattgtttagtattattacattgtcaatagaaatttttattagtatattactttgtttactccaaaccctacaatgtgagatattactgggtacgttgttattgtatattactttgtttactatttttgtctgctcactttctttttctaatataagagaagatatataattaattgttgttgaaatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttattttatcatccaatatttagtattattacattgttaataaaaaaatttattatcatattatttatttaatatttttctctgctactttatttttgtaatataatagaagatatatattttattaatcttgcaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggactttaatgaacaaattttcgattaaattaaagggacttatgtagtcatcgaataacttttttttatgtatttatctttattatatcactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttattttaaaataatttaaacactccaacttaaaactactcccgccaatttgaacgggtagttatttttattatatatttatatttttcgttttttattataactaattataagatctngttaaaaaaattttattatcatattatttatttaatatttttctctgctactttatttttgtaatataatagaagatatatattttattaatcttgcaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtagttttttttattttttattattttcgttttttataaatatttaaattcaaaaataataactaaataattaattaaatatttaaattttattatattttctcaataatatttaattttagtgaataattacactttttattttgaaaaagaaaaacgaaaatgatttaacaaaatcaaataaagaaattaactaacccaaaccaaccatcacccatgtttgagtagttaattcaggtaattaatttctttgttaatttttaataaataattgttattaactaattgtgccatatgttttttattgctttattttaattttttaatttaaaataaacttaaaattccaacttgaaactactcctcaatttgaatgggtaaattttttttttacttttattttatttaaaaatattttaaaactccaacttgaaactactctccgatttgaatgggtagtttttctttttcttttttcatttaattattaaagcaaattattttattttaaaataattttaaaactacaacataaaactactcccgccaatttgaacgtgtagttatttttattatatatttatatttttcgttttttattataacaaattataagatctttttttttaattcaaataaagtaaccaatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtaactaattatatcatgtggctttttttaggctgccacttggcttaaggagagggctttatcctctccttttaataatatataaatattttattttaaaataatttaaaaactccaacttaaaactactcccgccaatttgaacgggtagttatttttattatatatttatatttttcgttttttattataactaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatattgtagttttttcattttttattattttcgttttttataaatattttaattcaaaaataataactaataattaattaaataactaattatatcatgtggttttttttaggctgccacttggcttaaggagatggctttatcctctccttttaataatatatagatagatattttattttaaaataattttaaaactccaacttaaaactactcccgccaatttgaacgggtagttatttttattatatatttatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtagttttttcattttttaatattttcgttttttataaatatttaaattcaaaaataataactaataattaactaaataactaattagtaactaattatatcacgtggcttttttttaggctgccacttggcttaaggagagggctttatcctctccttttaataatatatagatttttattttaaaattaatttaaaactccaacttaaaacttctcccgtcaatttgaacgggtagttatttttattatatatttatatttttcattttttattataactaattataagatcttttttttaattcaaataaagtaaccaatatatatatatatatatatatatntaaaaataaacttaaaattccaacttaaaactactccccaatttgaattggtaatttttttttacttttattttttgttttaaaattattttaaaactccaacttgaaactactcttcgatttgaaagggtagtttttcttcttttgtttccatttaattattaaagctaattattttattttaaaataatttaaaactccaacttaaaactacttccgccaatttgaacgggtagttatttttattatatatttatatttttcgttttttattataactaattataagatctttttttttaattcaaataaagtaaccaatatatatatatatatatatatatatatatatatatatatatatatatatatatatataatgtagtttttttattttttattattttcgttttttataaatatttaaattcaaaaataataactaataattaactaaataactacttagtaactaattatatcatgtggcttttttttaggctgccacttggcttaaggagagggctttatcctctccttttaataatatatagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgtagttttttcattttttattattttcgttttttataaatatttaaattcaaaaataataactaataattaactgaataactaattagtaactaattatatcatgtggcttttttttaggctgccacttggcttaaggagagggctttatcctctccttttaataatatatagataaccattacgcttccggtattggggatgatatcctttcttttggggtaccattaattcattaatttgtacaaagtgatagagcttgacgtttactcatatgcccctttcttatgtggtatgcatatagatgctgaaattttaacagatcaagataaatcctaaatttatgattattcttaaaataataggagtctatcaggattacttggtggctactccactgtcacgacccggactttctaccctcgggaatcatgatggcgcctactaatgtgagctaggcaagccaatccttaacaacttacttcattaacaaatcacttattttaacgattatcagtgatagcatgaaaacatcagaatttagtaaatgtacggaagacttaaattaaagaaactgaacaataatacggaaatcaacatatgcctctacccaagaactggtgtcacatagttggtatcagagctctaggttacataggtctcacaactcacggacaagctcagtagagtctgagggatcggtacggagacgtctgtatttatcccccagaggctacagagttaggaaaatctcacatttgttctttcttgtcgtgcggatttgttcctcaaatgctaattggatttctactctgttctttcgcagatggcgagaacacgcgcttcctcatctaccgctcagcagcccgagcccccagcagcagctcccactaggggcagagggcgaggccgtgctagaggccgaggtaggggcagagttcagccccgagcagcagcaccagtggcggagcctcaggttgattttgaggaggaggttccggccccagcagttccggtgggcccagctcaggtcccagaggggtttattgctaccccagttcttcaggacgctctggtccgattggtgggcctcatggagagtgtcacccgagcaggtttgcttcctgtagcaccagccacttctcaggctggaggaggggctcagactcctgctacacgcactccggagcaggtagctcctcagattcagactccagcggttcagccagttggagcagttcagccgggtgtagtagctcagaccggtgatggagcggctatgtctgccgatgctttgtggaggctggataggttcaccaagctcttcactactactttcagcggtgcttcttctgaggatccccaggattttctatatagctgcacgaggttctcaggaacatgggtattgttgagaccaatggggtcgattttgctacatttcgcttgtctggatccgccaagacttggtggagggattattgcttagctaggccagccgggtcgccatctttgacttgggagcagtttacagtattgtttctggagaagtttctccccgttactcagagagaggcctatcggaggcagtttgagcgcctccagcagggttccatgacggtcacccagtatgagaccaggttcatcgacttagctcgccatgctcttgtcatacttcctaccgagagagagagggtgaggaggtttatcgacggtcttattcagccgattcgtcttcagatggccaaggaggccgggagtgagatcacttttcaggaggcggccaatgtggcccgcagagttgagatggttctgtcgtagggaggtggtcaggggtcggataagaggccccgtcattcaggcagattcagtggtacctcgtctggaggtagagattcatatggtagaggccatcctcctaggccctttcagtcagctcttcaggttttcacggtgcttcaggtggtcgtggtcctccgattcagtattctgatcagcagtccttcagtgcaccaccagcacctatcagtgcaccgccgcttcagagttttcagggtcgtcagccccagcagccgagggcttgttttacttgtggcgacacgaggcacattgctaggtattgccctcgagcttcgagcagttctccgcatcagggttcccgtgctatggttcaggcaccagatgttccacagcccgcccagccagctagagctagaggtggaggtagaggtcctagaggtggagctcaggccgccagaggtggaggccagccagcagcaggccgtcccagagaggtagttcagggtggtggggcccagccccgatgttatgctctcccagccaggcccgaggctgaggcttcagatgcagttattacaggtacggttctggtttgtgatagagatgcttcagtgttatttgatccagggtctacatactcgtatgtgtcatcttattttgcaccgtatctggtcatgcctagtgattcgttgagtattcctgtttatgtgtctacaccggtgggtgattctattgtggtagatcgagtccatcgctcttgtgtagttgtgattgggggtcttgagactcgtgtggatttgttgcttctagacatggtcgatttcgatgtcatattggggatggactggttatcaccttaccacgctatcttggactgtcatgccaagactgtgaccttagctttaccgggtatgcctcgtttagagtggagagggactcctggtcattctacccgtagcgttatttcttatgtgaaggctcggcgtatggtcgagaaggggtgcttggcctatttagcttatgttcgtgattctagtgcggaggtttcctctattgattctgtgcccgtggttcgtgagtttcctgaggtattcccttcagacctgccgggtatgccgcccgacagggatattgacttttgcattgatttggctccgggcactcagcccatttctattccgccgtatcgcatggccccgcctgagttgaaagagttgaaggagcagttgcaggacttgcttgagaagggtttcattagacccagtgtttcgccttggggtgcgccggtgttgtttgttaagaaaaaggatggttcgatgagaatgtgcattgattaccggcagttgaacaaggtcaccatcaagaataagtatccactgccgaggattgatgatttgttcgatcagcttcagggtgccaaggtattttcaaagattgacttgagatctggctaccatcagttgaggattagggcatccgatgtccctaagacagctttccgcactcggtacgggcattatgagttcttggttatgtcatttgggttgacaaatgccccagcagcttttatggatttgatgaaccgagtgttcaggccttatttggactcgttcgtgatagtcttcattgatgatattttgatatattcccgcagccaggaggagcacgagcagcatctcagagtggttcttcagactctgaaggatagtcagttatatgctaagttctcgaagtgtgagttctggttgagttcagttgcattcctgggtcatgttgtatcagcagagggtattcaggttgatccgaagaagattgaggcagtcaagaactggcctagaccagcatcagctacagagattcggagtttcttgggattggcaggctactatcgtcggttcgtggaggggttctcatctattgcagccccgatgaccaggttgacccagaagggtgcccagttcagatggtcggacgagtgtgaggcgagctttcagaagctcaagacagctctgactacggcaccggtgttggttttgcccacaggttcagggccttacacagtttattgtgatgcttccgtattgggcttggtgcagtgttgatgcaggatggcaaggtcattgcctatgcttcgaggcagttgaagattcatgagaagaactatccggtcatgatttagagttggcagccattgttcacgcattgaagatttggaggcattatctgtatggcgtggcatgtgaggtgttcactgatcacaagagtcttcagtatttgttcaagcaaaaggagttgaatttgaggcagaggaggtggttggagttgttgaaggattatgatatcactatcttatatcacccgggaaaggccaatgtggtggccgatgcttgagtagaaagtcagccagtatgggcagtcttgcttatattccggtcggtgagaggccgcttgcttggatgttcaggctttggccaatcgatttgtgaggttggatatttctgagcctagtcgagtattagcttgcacggtcgctcgttcttcattattggagcgtatccgtgatcggcagtttgatgatccccatttgtgtgtccttagagacacggtgcagcgtggaggtgccaagcaggttaccttaggtgatgatggagttttgagattgcagggtcgagtttgtgtgcctaatgtggatgggcttcgagagttgattttagaggaggcccatagttcccggtactctattcatccccgcgaagatgtatcaggatttgcggcagcattattggtggcgtagaatgaagaaggatattgttgcatatgtggctcggtgtttgaattgtcagcaggttaagtatgagcatcagaggcctggtggattgtttcagaggattgagcttcccgagtggaagtgggagcggatcactatggacttcgttactggacttccgctgactcggaagaagttcgacgcagtttgggtcattgttgataggctgaccaagtcagcgcatttcattcctgtggcagtctcctattcatccgagaggttagctgagatctatatccgggagattgttcgtcttcatggtgtgcctgtatctatcatttcggaccgaggtacgcagtttacctcgtttctggagagcagttcagcgagagttgggcaccaggttgagttgagtacaacatttcatcctcagacggacgggcagtccgagcggactattcagatttggaggatatgctccgagcttgtgtcattgactttggaggttcgtgggatcagtttttgcctttagcagagtttgcctacaacaacagctaccagtcgagtatccagatggctccttatgaggctttgtatggtaggcgatgtcgatctccggttggatggtttgagccgggagaggctcggttgttgggtacggatctggttcaggaggccttggacaaggtcaggatcattcaggataggcttcgtacggctcagtccaggcaaaagagttatgcagaccgcaaggttcgagatgtggcttttatggttggtgagcgggtattgctccgagtgtcgcctatgaagggcgtgatgagattcgggaagaagggcaagcttagccctaggttcattggtccatttgagattcttgatcgagtgggagaggtggcttatagacttgcattgccgcctagcttatcagccgtgcatccagtatttcatgtgtccatgcttcggaagtatcacggcgatccatcccacgtgttagatttcagtactgtccagttggacaaggacttgtcttatgaggaggagccggtggctattctagaccggcaggtccgtcagttgagatcgaagagttttccttcggttcgtgttcagtggagaggtcagcctcctgaggcatcgacctgggagtccgagtccgatatgcggagccgttatcctcatttttccccgactcaggtacttccttcttctgtccgttcgaggacgaacggttgttttagaggtggagaatgtgacgacccaaagggtcatcacctgttttcttacccattatgtgcttccgaggccttgaaaacctcatttagagtcgcttcgatttgcgtgcgcagtccgggcgcgtagccggaaagcttaaatatgaaattctgtgaaaaatgttaagtcttgactttaaaatgaataaatttgacttcggtcaacattttgggtaaacggacccggacccgtgatttgacggtcccggagggtccgtaggaaaatatgggacttgggcgtatgcccggaatcgaattccgaggtcccagcccgagaaatgaatttttaagtgaaattgttttcagaaattgtttaaggaaatttgaaatgaaaactgattagaaagcaatggtatcgggcccgtattttggttccggcgcccggtacaggtcttatatatgacttgagtcattcctgtgaaatttggttaaaaacggacgtcgtttgacgtgatccggaccttaattgagaaatttgatgtttaaaagagttttgagaaattttattgatctcgaggtttaattcgatgctcgtgatgttattttggtaatttgattacacgaatatgtccgtaggatgtttttgaggttgtgtgtatacttgggttggagtttcgagggctcgggtgagtttcgagtggttccggaatgccttaggcttagaaagtcagatgttgcaggttcaggaagttgcagtctctgaaccctctagtgcggtccgcgagaaatcgcgtgcgaccgcggaggggccagcgcggccgcggtcgcctttgtgcggtccgcggtggaggctgtgcggccgcagtcgcctttgtgcggtccgcacagggtgctgaactgcaggtcttcagggaggggccagcgcggccgcggtcgcctttgtgcggtcaggctgttccatttgatgcggtccgcactgggggtctgagaggggtataaataaacgggaatttcagttatttttcacttttcaaaaccccaaaacataagaggcgatttttcaaacaacctttcttctccaaaacgttggtaagtgatttctaactcattttcttcactccttaacatcttttaacatgatttcaacttcaaatcaaagattttcatgggggaaattgggtgttttgggtagaacctaaaaattggggatttggacctcaatttgagattcgtgggggaatgggtaatcgggttttggtccgaacctcgggtttcgaccacgtgggcccggggggtgatttctgacttttgggtaaaactttagaaaactcattttcatgcattggggttgattcatttagcacttattgatgtaattaagtaacttgtgactagattcgagcggattggtggtggaatcaaggggtaaagctatagttgagacttgagtggtgatcaaggcatcgaggtaagtgtttggtctaaccctagcttgagggattaggagttgagtcatacttgctacttgcttcttgttgagtacgacgtataggcatggtgacgagtatctatacgttggtgtcaagcatgaccgtgagtcttaaattgaaagttgttgtgttcttaaatgacacttgggtgctttacttaatgatcttctatgattgagcattttcaataattgaactgagtacaagttgagttgagattggttatagctgattctcccttgccgggatgactaattcaatattgttgttcccttgccgggaaaattataacattgttgtgttcccttgccgggaagttattatattatttatgttcccttgccgggatttcttgtgattgtgtgatgaaatgtaaaagggagcgggtggtacgcctaccacaagatataatgaaatgggagcgggtggtacgcctaccacgagatataatgaaatgggagcgggtggtacgcctaccacaagatataatgaaatgggaacgcctatggggagcgggtggtacgcctaccacaagatatactgaaatgggagcgggtggtacgcctaccacaagatatgagaaatgggatcgggttgcacgcctgcaacaagatgaaactgaaagtgaaagttgccttatttctctttatccgtgttagaagttaaattgtagtttccttactattctttgatattctgttttatctgctacccccggagcatgtttcccctttcccagctttgattgcttattacctgtttacttttccgccatatagtatataactgcacaggtttatctggagtctggtcctagcctcgtcactacctcgccggggttcaacttctaagagtactaaatacaaccgtttgaaagaaaaatataaactgtttgtctcgaatacatgagataacagactgaaataaagagagaggagacgccgggcctgcggacgcttgcaaggctaccttggtgtctcactggactgaaagcaggctcccgcgttactgctgctgtccaagacctggatctgtgcaaaagagcacagagtgtagtatcagcacaaccgaccccatgtgctggtaagtgtctggcctaaccccggcgaggtagtgacgaggctaggaccagactccagataaacctgtgcagttatatactatatgacggaaaagtaaacaggtaataagcaatcaaagctggaaaaaggggaaacatgctccgggggtagcagataaaacagaataccaaagaatagtaaggaaactacaatttaacttctaacacggataaagagaaataaggaaactttcactttcagtttcatcttgttgcaggcgtgcaacccgatcccatttctcatatcttgtggtaggcgtatcacccgctccgattttattatatctcatggtaggcgtaccacccactcccatttcattatatcttatggtaggcgtaccacccgctcccatttcattatatctcgtagtaggtgtaccacccgctcccatttcattatatcttgtggtaggcgtaccacccgctcccatttcattatatctcgtggtaggcgtaccacccactcccattccattatatctcgtggtaggcgtaccacccgctcccatttcattatatcttgtggtaggcgtaccacccgctcccatttcattatatctcgtggtaggcgtaccacccactcccattccattatatctcgtggtaggcgtaccacccgctcccatttcattatatcttgtagtaggcgtaccgcccgctcccttttacatttcatcacacaatcacaagaaatcccgacaaggaaacataaataatataataacttcccatcaagggaacacaacaatgttataattttcccggcaagggaacaacaatattgaattagtcatcccggcaagggagaatcagctataccaacctcaactcaacttgtactcagttcaattattgaaaatgctcaatcatagaagatcattaagtaaagcacccaagtgtcatttaagaacacaacaactttcaatttaagactcacggtcatgcttgacaccaacttatagatactcgtcaccatgcctatacgttgtactcaacaagaagcaagtagcaagtatgactcaactcctaatccctcaagctagggttagaccaaacacttacctcgatgccttgatcaccactcaagtctcaactatagctttaccccttgattctaccaccaatccactcgaatctagtcacaagttacttaattacatcaataagtgctaaatgaatcaaccccaatgcatgaaaatgagttttctaaaattttacacaaaagtcagaaatcacccccgggccgacgtggtcgaaacttgaggttcggagcaaaacccgattacccattctctcacgaatccaaatatataatttgttttgaaatcggacctcaaattgaggtctaaatcaacaattttagaaaacctaggttctacccaaaacacccaatttcctccatgaaaatctttgatttgaagttgaaatcatgttaaaagatgttaaggagtgaacaaaatgagttagaaatcacttatcaacgttttggagaagaaaggttatttgaaaaatcgccttttatgttttggggttttgaaaaagtgaaaaaatagctcgtttatttatacccctctcagacccacagtgtggaccgcatcaaatggaccgcggtcgcacagcctctaccgcggaccacacaaaggcgactgcggccgcgctggcccctccctgaagacctgcagttcaacaccctgggcggaccgcacaaaggcgatcacggccgtgctggcccctccgctgtcgcacacaatttctcgcggaccgcactagagggttcagagaatgcaacatttgactttctaagcctaaggcatttcggagcccattcgaaactcacccgagccctcgaaactccaacccaagtatacacacaacctcaaaaatatcctacggatatattcgtgtactcaaatgaccaaaataacatcacaagcattgaattaaacctcgagatcaataaaatttctcaaaactcttttaaacataaaatttctcaattaaggtccggatcacatcaaacgacgtccgttttaaccaaatttcacaagaatgactcaagtcatatataagacctgtaccaagtaccagaaccaaaatacgagcccgataccattgctttctaatcagtttctcacttcaaatttccttaaacaatttctaaaaataatttcacttaaaaattcatttctcgagtaagggaactcggataccgattccgggcatatgtctaagtcccatattttcctacggaccctccgggaccgtcaaatcatgggtccgggtctatttacccaaaatgttgaccgaagtcaaatttattcattttaaagtcaagacttaacatttttcacagaatttaatatttaagctttccggctatgtggctggaatgcacatgcaaatcgaagcaacttcaaatgaggttttcaaggcctcggaagtacataatgggtaagaaaacaggtgatgaccctttgggtcgtcacattctccacctctaaaacaaccgttcgtcctcgaacggacagaagaaggaagtaactgagtcagggaataaatgaggataatggctccacatatcgaactcggactcccaggtcgatgccgtaggaggctgacctctgcactgaacacgaaccgaaggaaaactctacgccctcaactgacggacctgccggtctagaatagccaccggctcctcctcataagacaagtccttgtccaactagacagtactgaaatctaacacgtgggatggatcgctgtgatacttccgaagcatggacacatgaaatactggatgcacggctgatcagttaggcggcaatgcaagtctacaagacacctctcccactcgatcaataatctcaaatggaccaatgaacctagggctaagcttgcctttcttcccgaatctcatcacgcccttcatagacgacactcggagcaatacccgctcaccaaccataaaagtcacatctcgaactttgcggtctgcataactcttttgcctggactgagtcgtacgaagcctctcctgaatgatcatgaccttgtccatggcctcctgaaccagatccgtacctaacaaccgagcctcccctggctcaaaccatccaacaggagatcgacatcgcctaccatacaaagcatcataaggagccatttggatactcgactggtagctgttgttgtaggcaaactctgctaaaggaaaaaactgatcccacgaacctccaaaatcaatgacacaagctcggagcatatcctctagaatctgaatagtccgctcggactggccgtctatctggggatgaaagcctgtactcaactccacctaagttcccaactctcgctgaactgctctccagaaatgcgaggtaaactgcgtacctcggtccgaaatgatagatacaagcacaccatgaaggcgaacaatctcccgaatatagatctcagctaacctcttggatgaataggagaccaccacatgaatgaaatgcgctgacttggtcagcctatcaacaatgacccaaactgcgtcgaacttcttccgagtcagcgaaagtctagtaacgaagtccatagtgatccgctcccacttccactcgggaagctcaatcctctgaaacaatccaccaggtctcttatgctcatacttaacctgcttaaaattcaaacattgagccacatatgcaacaatatccttcttcattctacgccaccaataatgtcgccgcaaatcctgatatatcttcgcggcgcctggatgaatagagtactaggaactataggcctcctttaaaatcaactctcgaagcccatccacattaggcacacaaactcgcccctgcaatctcaaaacttcatcatcacctaaagtaacctgcttggaacctccatgctgcaccgtgtctctaaggacacacaaatggggatcatcaaactgtcgatcacggatacgctccaataatgaagatcgagtgaccgtgcaagctaatattcggctaggctcaaagatatccaatctcacaaatcgattggccaaagcctgaacatccaacgcaagcggcctctcaccgaccgaaatataggcaagactgcccatgctggctgactttctactcagagcatcggccaccacgttggcctttcccaggtgatataagatagtgatatcataatccttcaacaactccaatcatctcctctgcctcaaattcaactccttttgcttgaacaaatactgaaaactcttgtgatcagtgaacacctcacatgtcacgccatacagataatgcctccaaatcttcaatgcgtgaataatggctgccaactctaaatcatggaccagatatttcttctcatgaatctttaactgccttgaatcataggcaatgaccttgccatcctgtatcaacactgcaccaagcccaatacgggaagcatcgcaataaactatgtaaggccctgaacttgtgggcaaaaccaacactggtgcggtagtcagagttgtcttgagcttctgaaagctcgcctcacactcgtccgaccatctgaatttggcacccttctggttcaacctgatcatcggggctgcaatagatgagaacccctccacaaaccgatgatagtagcctgccaatcccaagaaactctgaatctctatagctgatgttagtctaggatagttcttgactgcctcaatctttttcggatcaacctgaataccctctgattatacaacatgacctagaaatgcaactgaactcagccagaactcacacttcaagaacttagcatataactgactatccttcagagtctgaagaaccactctgagatgctgctcgtgctcctcctggctgcgggaatatatcaaaatatcatcaatgaagactatcacgaacgagtccaaataaggcctgaacactcggttcatcaaatccataaaagtcgctggggaatttgtcaacccaaatgacatgaccaagaactcataatgcctgtaccgagtgcggaaagctatcttaaggacattggatgccctaatcctcaactgatggtatccagatctcaagtcgatctttgaaaataccttggcaccctgaagctgatcgaacaaatcatcgatcctcggcagtggatacttattcttgatggtgaccttgttcaactgccgataatcaatgcacattctcatcgaaccatccttttcttaacaaacaacaccggcgcaccccaaggcgaaacactgggtctaatgaaacccttctcaagcgagtcctgcaactactccttcaactctttcaactcaggcaggtccatgcgatacgacagaatagaaatgagctgagtgcccgaagccaaatcaatgcaaaagtcaatatccttgtcgggcggcatacccggcaggtctgaagggaaaacctcaggaaactcacgaaccacgggacaaaatcaatagaggaaacctccgcactataatcttgaacataagctaaataggccaagcaccccttctcgaccatatgccgagccttcacataagaaatgacgctacatgtagaatgactaggagtccctcttcactctaaacgaggcatacccggtaaagctaaggtcacaatcttggtgtcacagtccaagatagtgtagtaaggtgatagccagtccatccctaatatgacatcgaaatcgaccatgtctagaagcaataaatccacgtgagtcttaagacccctaatctcaactcacaagagcgatagactcgatctaccacaatagaatcacccactggcatagacacataaataggaatactcaacgaatcactaggcatgactagatacggtgcaaaataagatgacacatacgagtatgtagaccctgtatcaaataacactgaagcatctctatcacaaaccagaaccgtacctgtaataactgcatctgaagcctcagcctcgggcttggctgggagagcataacatcggggctgggccccccaccttgaactacctctctaggatggcctgctactggctggcctctacctctggcggccagagctccacttctaggacctctaactccacctctaacacctctacccccacctctagctatctgggcgggctgtggaacatctagtgcctaaaccatagcacgagaaccctgatgcggagaactgctcgaagcccaagggaaataccttacaatgtgcctcgtgtcgccacaagtaaaataagccctcggctgctggggctgacgaccctaagaactctgaagcggtggtgcactgataggtgctggtggtgcactgaaggactactgatcagaatactgaatcggaggaccacgaccacctgaagcaccgtgaaaagcctgaagagccaactagaagggactaggaggatggcctctaccatatgaatccctaccaccagacgaggtaccactgaatctgcctgaatgatggggcctcttatctgacccctgaccaccttctgcgacagaaccatctcagctctgcgggccacattggccacctcctgaaaagtgatctcactcccggcctccttggccatctgaagatgaatcggctgaataagaccgtcgataaacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagagcatggcgagctaagttgatgaacctggtcttatactgggtgaccgtcatggaactcgaactgcctccgataggcctctctctgagtaacggggagaaaattctccagaaacaatactgtaaactgctcctaagtcaaagatggcgacccagctggcctagctaagcaataatccctccaccaagtcttggcggatccagacaagcagaatgtagcaaaatcgacctcaacaatacccatgttcctaagaacctcgtgacagctatatagaaaatcctggggatcctcagaagaagcaccactgaaagtagtagtgaagagcttggtgannnnnnnnnnnnnnnnnnnnnnnnnnnnnnnnnnnnnnnnnnnnnnnnnnnnnnnnnnnnnnnnnnnnnnnnnnnnntacatacatagccgctccatcaccggtctgagatactacacccggttggactactccaactggccgaaccgctggagtctgaatctgaggagctacctgctctggagtgcgtatagtaggtgtctgagcccctcctccagcctgagaagtggctggggctacaggaagcaaacttgctcgggtgacactctccgttaggcccaccaatcggaccagagcatcctgaagaactagggtagcaataaacccctctgggacctgagctgggcccaccggaactgctggggccagaacctcattctcaaaattctcgggactaaactctgcccctacctcggcctctagcatggcctcggcctctagcacggcctcggcctctgcccctagtgcgagcttctgctgggggctcgggttgctgagcggtagataaggaagcgcgtgttcttgccatctgcgagagaacagagtagaaatccaattagcatttgaggaacaaatccgcacgacaagaaagaacaaatttgagattttcctaactctgtagcctctgggggataaatacaaacgtctccgtaccgatccctcagactctactgagcttgtctgtgagttgtgagacctatgtaacctagagctctgctaccaatttgtcacgacccggacttcccacccccgggagtcgtgatggcgcctactaatgctagctaggtaagccaatccttaacaacttacttcattaacaaatcacttcttttaacgacaatcagtgatagcatgaaaacaccagaatttagtaaatgtacggaagacttaaattaaagaaactgaacaataatacggaaatcaacatatgcctctacccaagaactggtgtcacatnnnnnnnnnnnnnnnnnnnnnnnnnnnnnnnnnnnnnnnnnnnnnnnnnnnnnnnnnnnnnnnnnnncgaacttctaagagtactaaatacaaccgtttgaaagaaaaatataaattgtttgtctcgaatacatgtgataacagactgaaataaaaagagaggcgatgttgggcctgcgaacgcgtgcaagactacctcggtgtctcactggactgaatgctggctcccgtactactgcttctgtccaagacctggatctgtgcaaaagagcacaaagtgtagtatcagcaaaaccgaccccatgtgctggtaagtgtctagcctaaccccggtgaggtagtgacgaggctaggaccagactacaaataaacctatgtagttatatactatatggcagaaaagtaaacatgtaataagcaatcgaagctaggaaaggggaaacatgctccgggggtagcaaataaaacagaataccaaagaatagtaaggaaactacaatttaaacttctaacacggataaagagaaataaagcaactttcactttcagtttcatcttgttgcaggcgtgcaacccgatcccatttctcatatcttgtggtaggcgtaccacccgctcccattcttcagtagtgagacaccgaggtagccttgcaagcgtccgcaggcccggcgtctcctctatctttatttcagtctgttatctcatgtattcgagacaaacagtttatatttttctttcaaacggttgtatttagtactcttagaagttcgtgagtaatgtgacaccagttcttgggtagaggcatatgttgatttccgtattattgttcagtttctttaatttaagtcttccgttatttattaaattccgttgttttcatgctatcactgataatcgttaaaagaagtgatttgttaatgaagtaagctgttaaggattggcttgcctagctcacattagtaggcgccatcacgactcccgagggtgggaaatccgggtcgtgacaagttggtatcagagctctaggttacataggtctcacaactcacggacaagctcagtagagtctgagggatcggtacggagacgtctgtatttatccccagaggctacagagttaggaaaatctcacatttgttctttcttgtcgtgcggatttgttcctcaaatgctaattggatttctactctgttctttcgcagatggcgagaacacgcgcttcctcatctaccgctcagcagcccgagcccccagcagcagctcccactaggggcagaggccgaggccgtgctagaggccgaggtaggggcagagttcagccccgagcagcagcaccagtggcggagcctcaggttgattttgaggaggaggttccggccccagcagttccggtgggcccagctcaggtcccagaggggtttattgctaccccagttcttcaggacgctctggtccgattggtgggcctcatggagagtgtcacccgagcaggtttgcttcctgtagcaccagccacttctcaggctggaggaggggctcagactcctgctacacgcactccggagcaggtagctcctcagattcagactccagcggttcagccagttggagcagttcagccgggtgtagtagctcagaccggtgatggagcggctatgtctgccgatgctttgtggaggctggataggttcaccaagctcttcactactactttcagcggtgcttcttctgaggatccccaggattttctatatagctgtcacgaggttctcaggaacatgggtattgttgagaccaatggggtcgattttgctacattccgcttgtctggatccgccaagacttggtggagggattattgcttagctaggccagcgggtcgccatctttgacttgggagcagtttacagtattgtttctggagaagtttctccccgttactcagagagaggcctatcggaggcagtttgagcgcctccagcagggttccatgacggtcacccagtatgagaccaggttcatcgacttagctcgccatgctcttgtcatacttcctaccgagagagagagggtgaggaggtttatcgacggtcttattcagccgattcgtcttcagatggccaaggaggccgggagtgagatcacttttcaggaggcggccaatgtggcccgcagagttgagatggttctgtcgcagggaggtggtcaggggtcggataagaggccccgtcattcaggcagattcagtggtacctcgtctggaggtagagattcatatggtagaggccatcctcctaggccctttcagtcagctcttcaggcttttcacggtgcttcaggtggccgtggtcctccgattcagtattctgatcagcagtccttcagtgcaccaccagcacctatcagtgcaccgccgcttcagagttttcagggtcgtcagccccagcagccgagggcttgttttacttgtggcgacacgaggcacattgctaggtattgccctcgagcttcgagcagttctccgcatcagggttcccgtgctatggttcaggcaccagatgttccacagcccgcccagccagctagaggtgggggtagaggtgctagaggtggaggtagaggtcctagaggtggagctcaggccgccagaggtggaggccagccagcagcaggccgtcccagagaggtagttcagggtggtggggcccagccccgatgttatgctctcccagccaggcccgaggctgaggcttcagatgcagttattacaggtacggttctggtttgtgatagagatgcttcagtgttatttgatccagggtctacatactcgtatgtgtcatcttattttgcaccgtatctggtcatgcctagtgattcgttgagtattcctgtttatgtgtctacaccggtgggtgattctattgtggtagatcgagtccatcgctcttgtgtagttgtgattgggggtcttgagactcgtgtggatttgttgcttctagacatggtcgatttcgatgtcatattggggatggactggttatcaccttaccacgctatcttggactgtcatgccaagactgtgaccttagctttaccgggtatgcctcgtttagagtggagagggactcctggtcattctacccgtagcgtgtgtaggtgcttggcctatttagcttatgttcgtgattctagtgcggaggtttcctctattgattctgtgcccgtggttcgtgagtttcctgaggtattcccttcagacctgccgggtatgccgcccgacagggatattgacttttgcattgatttggctccgggcactcagcccatttctattccgccgtatcgcatggccccgcctgagttgaaagagttgaaggagcagttgcaggacttgcttgagaagggtttcattagacccagtgtttcgccttggggtgcgccggtgttgtttgttaagaaaaaggatggttcgatgagaatgtgcattgattaccggcagttgaacaaggtcaccatcaagaataagtatccactgccgaggattgatgatttgttcgatcagcttcagggtgccaaggtattttcaaagattgacttgagatctggctaccatcagttgaggattagggcatccgatgtccctaagacagctttccgcactcggtacgggcattatgagttcttggttatgtcattttgggttgacaaatgccccaacagcttttatggatttgatgaaccgagtgttcaggccttatttggactcgttcgtgatagtcttcattgatgatattttgatatattcccgcagccaggaggagcacgagcagcatctcagagtggttcttcagactctgaaggatagtcagttatatgctaagttctcgaagtgtgagttctggttgagttcagttgcatttctgggtcatgttgtatcagcagagggtattcaggttgatccgaagaagattgaggcagtcaagaactggcctagaccagcatcagctacagagattcggagtttcttgggattggcaggctactatcgtcggttcgtggaggggttctcatctattgcagccccgatgaccaggttgacccagaagggtgcccagttcagatggtcggacgagtgtgaggcgagctttcagaagctcaagacagctctgactacggcaccggtgttggttttgcccacaggttcagggccttacacagtttattgtgatgcttctcgtattgggcttggtgcagtgttgatgcaggatggcaaggtcattgcctatgcttcgaggcagttgaagattcatgagaagaactatccggtcatgatttagagttggcagccattgttcacgcattgaagatttggaggcattatctgtatggcgtggcatgtgaggtgttcactgatcacaagagtcttcagtatttgttcaagcaaaaggagttgaatttgaggcagaggaggtggttggagttgttgaaggattatgatatcactatcttatatcaccgggaaaggccaatgtggtggccgatgcttgagtagaaagtcagccagtatgggcagtcttgcttatattccggtcggtgagaggccgcttgctttggatgttcaggctttggccaatcgatttgtgaggttggatatttctgagcctagtcgagtattagcttgcacggtcgctcgttcttcattattggagcgtatccgtgatcggcagtttgatgatccccatttgtgtgtccttagagacacggtgcagcgtggaggtgccaagcaggttaccttaggtgatgatggagttttgagattgcagggtcgagtttgtgtgcctaatgtggatgggcttcgagagttgattttagaggaggcccatagttcccggtactctattcatccgggcgccgcgaagatgtatcaggatttgcggcagcattattggtggcgtagaatgaagaaggatattgttgcatatgtggctcgatgtttgaattgtcagcaggttaagtatgagcatcagaggcctggtggattgtttcagaggattgagcttcccgagtggaagtgggagcggatcactatggacttcgttactggacttccgctgactcggaagaagttcgacgcagtttgggtcattgttgataggctgaccaagtcagcgcatttcattcctgtggcagtctcctattcatccgagaggttagctgagatctatatccgggagattgttcgccttcatggtgtgcctgtatctatcatttcggaccgaggtacgcagtttacctcgcgtttctggagagcagttcagcgagagttgggcaccaggttgagttgagtacaacatttcatcctcagacggacgggcagtccgagcggactattcagatttggaggatatgctccgagcttgtgtcattgactttggaggttcgtgggatcagtttttgcctttagcagagtttgcctacaacaacagctaccagtcgagtatccagatggctccttatgaggctttgtatggtaggcgatgtcgatctccggttggatggtttgagccgggagaggctcggttgttgggtacggatctggaggccttggacaaggtcaggatcattcaggagaggcttcgtacggctcagtccaggcaaaagagttatgcagaccgcaaagttcgagatgtggcttttatggttggtgagcgggtattgctccgagtgtcgcctatgaagggcgtgatgagattcgggaagaagggcaagcttagccctaggttcattggtccatttgagattcttgatcgagtgggagaggtggcttatagacttgcattgccgcctagcttatcagccgtgcatccagtatttcatgtgtccatgcttcggaagtatcacggcgatccatcccacgtgttagatttcagtactgtccagttggacaaggacttgtcttatgaggaggagccgtggctattctagaccggcaggtcgtcagttgagatcgaagagttttccttcggttcgtgttcagtggagaggtcagcctcctgaggcatcgacctgggagtccgagttcgatatgcggagccgttatcctcatttattccccgactcaggtacttccttcttctgtccgttcgaggacgaacggttgttttagaggtggagaatgtgacgacccaaagggtcatcacctgttttcttacccattatgtgcttccgaggccttgaaaacctcatttagagtcgcttcgatttgcgtgcgcagtccgggcgcgtagccggaaagcttaaatatgaaattctgtgaaaaatgttaagtcttgactttaaaatgaataaatttgacttcggtcaatattttgggtaaacggacccggacccgtgacgggtccgtaggaaaatatgggacttgggcgtatgcccggaatcggaatccgaggtccctagcccgagaaatgaatttttaagtgaaattgttttcagaaattgtttaaggaaatttgaatgaaaactgattagaaagcaatggtatcgggcccgtattttggttccggcgcccggtacaggtcttatatatgacttgagtcattcctgtgaaatttggttaaaaacggacgtcgtttgacgtgatccggaccttaattgagaaatttgatgtttaaaagagttttgagaaattttattgatctcgaggtttaattcgatgctcgtgatgttattttggtaatttgattacacgaatatgtccgtaggatgtttttgaggttgtgtgtatacttgggttggagtttcgagggctcgggtgagtttcgagtaggttccggatgccttaggcttagaaagtcagatgttgcaggttcaggaagttgcagtctctgaaccctctagtgcggtccgcgagaaatcgcgtgcgaccgcggaggggccagcgcggccgcggtcgcctttgtgcggtccgcggtggaggctgtgcggccgcagtcgcctttgtgcggtccgcacagggtgctgaactgcaggtcttcagggaggggccagcgcggccgcggtcgcctttgtgcggtccgcggtggaggctgtgcggccgcggtccatttgatgcggtccgcactgggggtctgagaggggtataaataaacgggaatttcagttatttttcacttttcaaaaccccaaaacataagaggcgatttttcaaacaacctttcttctccaaaacgttggtaagtgatttctaactcattttcttcactccttaacatcttttaacatgatttcaacttcaaatcaaagattttcatgggggaaattgggtgttttgggtagaacctaggttttctaaaattggggatttggacctcaatttgaggtccgatttcaaaacaaattatatatttggattcgtgggggaatgggtaatcgggttttggtccgaacctcgggtttcgaccacgtgggcccgggggtgatttctgacttttgggtaaaactttagaaaactcattttcatgcattggggttgattcatttagcacttattgatgtaattaagtaacttgtgactagattcgagcggattggtggtggaatcaaggggtaaagctatagttgagacttgagtggtgatcaaggcatcgaggtaagtgtttggtctaaccctagcttgagggattaggagttgagtcatacttgctacttgcttcttgttgagtacgacgtataggcatggtgacgagtatctatacgttggtgtcaagcatgaccgtgagtcttaaattgaaagttgttgtgttcttaaatgacacttgggtgccgtggttggcgtaccacccgctccaatttgattatatctcgtggcaggcgtaccacccgctcccatttcattatatctcgtggtaggcgtagcacccgctcccattttattatatctcgtggtaggcgtaccacccgctcccatttcattatatctcgtggtaggtgtaccacccgctcccgtttatatttaatcacacaatcacaagaaatcccggcaagggaacataaataatataataacttcccggcaagggatcacaacgatgttataattttctcggcaagggaacaacaatattgaattagtcatcgaggcaagggagaatcagctataaccaacctcaactcaacttgtactcagttcaattattgaaaatgctcaatcatagaagatcattaagtaaagcacccaagtgtcatttaagaacacaacaactttcaatttaagactcacggtcatgcttgacaccaacgtatagatactcgtcaccatgcctatacgtcgtactcaacaagaagcaagtagcaagtatgactcaactcctaatccctcaagctagggttagaccaaacacttacctcgatgccttgatcaccactcaagtctcaactatagctttaccctttgattccaccactaatccgctcgaatctagtcacaagttacttaattacattaataagtactaaatgaatcaaccccaatgcatgaaaatgagttctctaaagttttacccaaaagccagaaatcacccccggggctcacgtggtcgaaactcgagtttcagaccaaaacccgattacccattcccctacgaatccaaatatataatttgttttaaaatcggacctcaaattgaggtccaaatccccaattttagaaaacctaggttctacccaaaacacccaatttcacccatgaaaatctttgatttgaagttgaaatcatgttaaaagatgttaatgagtgaagaatataagttagaaatcacttaccaatgttttggataagaaaggttgtttgaaaactcgcctcttatgttttggggttttgaagaagtgaaaaaataactgaaattctcgttatttatacccctctcataccccagtgaggaccacaacaaatggaccgcggccgcatagcctccaccgcggaacgcacaaaggcaaccgcggccgcgctggcccctccgcggtcgtacgcgatttcttgcggaccgcactagagggttcagagactgcaacttcctgaacctgcaacatctgactttctaagcctaaggcatttcgaagctcgctcgaaactcacccgagccctcgaaactccaacccaagtatatacacagtctcaaaaatatcctacagacatattcgtgtactcaaatggccaaaataacatcacaagcatcgaattaaacctcgagatcaaaaaaaattctcaaaactcttttaaacgtcaaatttctcaattaaggttcggatcatatcaaacgacgttcgtttttaaccaaatttcacaggaatgactcaagtcatatataagacttgtaccgggcgccggaaccaaaataagggcccgatactattgctttctaatcagtttctcactttaaatttccttaaacaatttcacttagaaattcatttctcgggctaaggacctcaaattctgatttcgggcatacgcccaagttccatattttcctacggactctccgggaccgtcaaatcacgggtttgggttcgtttaccctaaatgttaaccgaaatcaaatttattcattttaaagtcaaaacttaatatttttcatagaatttcatatttaagatttccagctacgtgcccggactatgcacacaaatcgaagcaactctaaatgtggttttcaaggcctcagaagcacataatgggtaagaaaacaggtgatgaccatttgggtcgtcacatccacccaaaccctaattcatgcctataaataaggctacatatgttcttcaaagatagtccaacagttccataaactctcaaaatatgcataaagagatcaaatatacgatctccaaaatccccaaaaattcttggaatattcaataagagatcaaagacatgccaaatatgtcttgctcaaatttctatcaacattcaagatccaaacagattgctgctacatgcttcttgatcatcaaatacatcaaggagatgcataccattacgttcgagaaatacacttctaaggccctagaatcacgtagaataaatcggaggaaagaatcaagggataaacagagttgtaacctaaaatgtttatcaataaaatccttttttctttatagttgtttgtgattgcagttttatttttctctgcataaatttgttgcaaacaaattggcacgcatagtgggaccagctctgtcctccatctcttccttctgcaaatcgaatgtcgcgccccctttttccccttcatgggaaaaatccgggttctaacgttcatgggggtaataacttatttccttttgggaatttgggtattaaagagtcgccacctaacggattatagtgcgttagggcacctagagcgattaactcttggattggtttgcattactagagatttagggtaagggctcgagataacctagaagagaaggtgttaggcacccctcttagtccacaacggtgggtcccgcccgaacatatatttacgaacaagtccattaacagataaatagttttaaacacataattacaaataagagcaggttttagacattacatgactcaaataatgacacaaaggaaaggcttaaacaaattgtatacatatggaaagtaaaggtaatttgggaaggaggggtcctagtttggttagactacaggatcaccccatgtaatgtctggtaaacactcctcaatgaggggctacatatgacattagcgcgtagtcatcatatccctttctacccaagtccctccccttggtcatagcctaaacctctctagcaactttgacaatatcctatgcgtgcactacccgttccttcttcgtggccctggaggtattttaggacctctattctttagacagttctcgacttttctaagtttttaaaggataaaaatctaggcgtcaattaagaatagtttggactgcatttaaagaaataagttataggctcatagttacctcctcaaacataacaagtaagtgcacgtcttcaaagaacattcaaatacttaagagaaaaccctagcacatgatatctaggtgagcaggggttatatagcgttgaattaggacaatatgtgaaagatcctatttatcttgcctattgatttgaacttgttaaatttgaacagctttaagtagcaaaaaaatagttccagagttgcagaatttaaaacgccctataggcttgcctaaatgtagaatagtgatgtcttaagagcaagataactacgttgatgtagtaaatcagtgaacagttttaaacggacacttgagatcctataggcatgctttctagcagtagtgagttaaggcagtgttttaaaaactcaattaaagaagtggatagttgattaagccaatttcaaagtgaactaacatgaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatataggcatgttatctaattgttaagagctgatgttggaacttataggtatgattttagtgagacaaatgtaaacacatgtagtagaaggaattgaactcaatcactttacactctataagcatggtatctaattatgaagttgattttaaacctatagatatggtttctattattgaatccatttaaaccctatagacatgagttctaatatgggaaccttttaaaccatataggcatggtttctagtgtggtaaagcaaatatagcaagtctattaatataatcctataaatatggtatctacccgaattacccctgaaatatgtaactacccacgccttttcactaatcaccccaatgttatttgcaaataattattacagaccagctgaacaaataacataaacaaataaagaaggaaaagaagaagttaactatagggagcctgaagtaggcccaaatgacttcccaagcctccaatagcctcaagtgccaaagtaacatatacaatatcatatctaggtgtgtcaaagttccctaaggaactcaaggatcctgagcagtgctcacacctagacctttctcaacaataactgatttaagtgcagtgtggaaaggccagctctaacatgcaagagttcagagaaatctcatggatctcaaggcagtacacatgccagaggggcaggacctaaatattctagtagtggagagtgcttgacatagaaagagtttggaagatagagaaagaaggtcttaatagcagaaagaacttttatgaaagtcagaacaaagttttaagagtaggaatagtttaagaagacatttaaaataataagaaatcaggttaaagaatatacagcttcagaataaatctcacacaagggatagaggtatgggaacacctagcatacaccttagtggtgtcaatcaagtacagatatggtagttacaaagttaagttgggaacacataggtttaagacacaagcagaattacattagaacaaactgtaccggacaaacatttcatgaaaaacattcaatgtattagaacaagcagggtttggtcatgctaaacagtataaaatcataagcttgaaacatgctttgtaatatagtattctaggcatactgattgcatctaagtagaatagctcataaaactgaaaatcaagattgataaactatagtaacaaagtaaacacatagcttggaatgtgaatttaatcagaacataccagtttaggagagtatgcagaatacagagtaaagataatgccagtagtcagccttagtgtacaaccgactgaactagtaggaattgtaaggaacagaagagagtagatgctttttgagagtataatagtgtagacaaactagagtgccttgttatcgttgttataaactttaaagaagagaaggtttatataggagtcgaaaacttaacaaaatgagataagagattaattgagtagtaaatcagggaagttacccataaatcagcaagatcttcccttaatcaagggactattcaatcaacggtaaacatgccaggtatttaaggacaagaataaagtaaagtcttaggtataaaataggtaattaagggctaggtacataaagttctaattagggaaataattagtaagaatcaagtaataatgcagacaaggtaaggaaaaattaattaaggcaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatcaaattgagtaaagaagcaagaatcaaacgtttaaagcaaagtagtcaaataaaactagaaactaagggatttagagtaattaacggttcagaaaatcgtgaaagaagcagcatgcttagcatataaaatgaggtaaggcatgaacagtcaggatttcacacagccttgacaaaacacatggttaaacgacactgattcaaagggaagcatacaaattttgcatgaatggctagtacacacacaagttcataatattagtgaaagtttgaacaatgaagattcaataaaagcatactaggacaagtaaatcatgagaagtcacaagaaactaaggcaagaacacactcagaagtacccatatcagaaacaaaatgaaaaccccaacattagggttttcagtataaacgggctagggttgcagcaattttataaaattagtcaaaaatgtgtgagaatcagaagtttaaacacaaagaatcatcaaacaaagttttaaaagaaatttcaaaaaccctaattttagaaaaggtgaagaaatcacttgaaatcaaacgattttggtagagaatctcaaagatattgtaagacacacaagaaatagactcaaatcgtcctagatctgtacagatctaggagatttagagaggaagttagggtttcgcagaaaaccatatagaggtgaagaaacatactgaaaaaaccatagatcgtggctaacatagaaagatttcactcgaaatcacaccggaatggccaagaacaggcaagagatgaacccaggatgcaagtcggcatggccctggtcccttgagggccttagggattgaaagaatgacatgagagaagccattagaggcctgagagatgatgagaggtcgccagagatagccatagataaggggtcggcgtttggagattagggtttaggttgagagtgttttgagagcaaagaggattttagggcggcggggtgggttgtaaaatgaattaggttggggagggaggggtattggtcggtttaattaggaaagggagaatctgggccgttgatcctttgggccattgatcaaaacaatcaatggccaggatttggccggtattgggtcgggtattttaatcaaaagttgggctaggtaatttagtgtccgatttgggatgaatagggattggggaggggttggaattgggctaaaattgaaatgcaatttggctagattttaaataaaattttaacactatatactttataataaataataaatgatttctgaaaaaaataatttcatgtattaaaatgattaaatagttgtttaatattttaaaaatataaaataccattttatgtattaaaaacgtagttatgctttaatagggctagtattgcaaatatatgcaaattgactttaaaaatgcaaatgcaattataaaaatgtactaaaaatattttaacaatattttggcataaatatagaatttagatggctaaatcaccacaaaaataatttgaaggatgattattggagatttttgactttgtttttatggtatttatgttatgttatggatttaatggtattttatgttgttttattatgagtctattgatagtactaatatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtagaggtaaggtctgtgtacatattaccctccccagaccccacttgtgggattacaccgggttgttgttgttgttgttgttgattattggagattttatcagtaaaaaggaaggaaataaatcaatttgaagattttaaaaattatagaaaaattataaaaatgcttatgcatgcttatatatgcatatatactattttgaaagtatatttatgtattaaaaaaatatatagggaaaaattcggtatcaacagctgcccctctttaccgaaaaggatgaaagagctttcgggtaaagaaataatagccaattttgaccggacgggatgttttgaaaaacagaggccggactccggtctttgatttgcctacatatccctaattttcaggaatcaggccatgtgtagttctagattcatcggcggaatatgccgatgaaattattgcaagaacggacacgagatgtggaagcagctatggtgagtggttagggttcgggacaattgaaggaactggagcgagatcgctcctactaggatagttgtttcttgctggttacctgcagataaaaatactacaaacctatatttgtgaaaatttaaacatgatgaagatttccttttagaccatgaaggttgtctttggacggttaaagatgatgtccttggaccatgatgtcctgggccatgaattgtttagcgagggattcacagtccatgaaatgatgttctcgggccatggcaatggtgcctccgaaccatgacgcctttgaataatgatatgcaaatttgagggatacttaggccatggcatgaggatgatgccttttagactatgacgcctttggatagattgacgatatttagcccatgatatgcaatagtcatgatgttaacaagacaaggcttagtcttgggaaatggagggcagagcttagcccgattgaaaagcaaataaatagtactagaaatagagcaatattcgtgcaaagagggacaatgcttagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacagatggggaagcaaggattagcctcatgcagatggaggcagggaatatcctcatgtagagagggaggcaaggattagcctcatgcaaatatggaggcaaggattagccccatgcaggtgtggaggcagggattagcctcatgcagatatgaaggcagggattagcctcatgcaaatagggaggaaaggattagcctcatgaaaatatggaggtagggatcagcctcatgcaaatatggagtcaaggattagcctcatgcagatatggaggtagagattagcctcatgcagatatggaggtagggatttgactcatgcaaatgtggaggcaaggattagcctcatgcaaatagggaagcaaggattagcctcatgcaagtggggagacaaagattagcctcatgcaagatagggaggcagggattagcctcatacacgtatggaggcaaggattagcctcatgcagatatggaggcaggaattagcctcatgcaaatatggaggcaaagattatcctcatgcaagtgtggaggaaaggattagcctcatactaatagggaggcagggattagcctcatgcaagtatggaggcaaggattagcctcatgtagagagcaagtagcaaataagagtagtgtatgtcttagctggagatacattcggtgtctgatgtcttgattgataatgaatttgttacgtgtatgtatttgaggatgttattgccatgctagatatgcctgcattcaaagaaaaattgtaagttttgtgggggaaggttggtttgtgcttctgtcggctggctttgctttgctctatcctgaaagccctttctgagttcccctaggtaacacctgactgttatggaaatagagtttttcgaaaaatattcaatcgttcataaaaatagagttatttcagaaatatattgatatatttagatgaactagtgactgtaacacatctcaaatgcattacaactctcttctattggaattttgagggtccttctcaaaattctgccccagtttagtagatgatccttcggctgtttgcggacaataggccttgctgaaccttcttcggaattttgagaatccttctcaaaaattttgccccagtttcttaactaattattgaccgtctgacacatgtttgcattggctggacttgctccggaattttgaggaccctcttcaaaattctaccacagtttctgatcttggggggaaatgaaaattttattatgatatgatcgaacccataaggctgcctacgtatcccctcttaaatggaaatcaggtcaaacgtagttcaattacattagatgagaaaaatgtaaataatccaagcatcgtatctcttgattgcgtctgaattaattggttttggccaaattgctccatcaatttttgcaagtatgggtgctcctcctgtcagcaccctgtgaaccatatacgaaccttgccagttgagggagaatttcccttttgattcatcttaatgtgggaagatcttctgcagcaccaactgacctggtgtaaattgccttagtttgaccctttagttgaaagctctggacattatgttctgataaatttggccttggcacactgcattcatcctctttccatcgatgaaggccaattgttcatagcgacttcttatctattctgcatcgctgagttcagcttcctatatgactctcaaagaagcaatctctacttcggctgggatgacaacttcggtaccgtaaactagcatgtaggaagttgccctggttaatgtgcgaaccatagtgcgatatcccaataaagcaaatggtagcttttcgtgccactatttgtgattctctaccatcttccttagtatcttcttgatgtttttgttggccgcttctacggctctattcatctgaggtttgtaggttgtggaattcttgtgcttgattttgaaagtttcacccatggcttttatcagatcactattgaggttggcggcattattagtaagaatggactcgggaactcctaatcgacaaacaattcgatccttgacaaaatctacgatgactcttttggttacagctttgtaagatgcaacctctacccattttgtgaagtaatcaatggctactagaataaacctgtgttcgtgtgaagcagtgggctaaatcggaccaataacatccattccccaagcggcgaatggctaatgagagcttgttacattgagctcgtttggcggcacttttatcatatcggcatgcacctggtattgaaagcatttgcggacatactggatgcaatccgtttccatggtcatccaaaagtaaccgaccctaagtatcttcttagccaagacgaaaccattcatgtgcaggccacaagtcccggcatgtacatcctcaagtagcttagaagcttcctttgcatcgacacatcttaggaaacccaaatcaggagttctcctgtacaaatttcctccgccgtggaagaagtgattgtaaaatctctggagtgtgcatttctgagtgtggtttgcgtgctcaagatattctccctttgacaaatacttcttgatgtcatggaaccaaggctttccatctatttcttcttcaacatgagcgcaatatgccgactgattatggatcttcactgggatgggatcaatataatttttatatggatgttgtatcatagatgacaaggtggctactgcatcgacaaactcattctgaattctgggcacatgtcgaaattctatcttcatgaacctctttcttaattcctgcacatggtgcagatatggcaatatcttggaattcttggtggcccactctccttgtacctggtgcataagcaaatctgaatcatcgatcactagcaactcttgaatgttcaagtcgatttccatgtttagccctagtatgcaagtttcatactctgccatgttgttcgtgcagggaaatttgagtttagcagatactggataatgttcacccatttctgataccaaaactgctccaatgcttactcctctaaaatttgcatctccatcaaagaacatcctccaaccgtcgtatgcttcagtaatgtcttctcccacaaatgatacttcttcatcaggaaaatacatcttcaaaggttcgtatgctcctcccaccggatttttagcaaggtgatctgccaatgcttgccctttgaccgccttttgagttacgtagacgatatcgaactcacttaacagtatctgtcatttggccaactttccaatcggcatgggtttctagaatatgtacttcagagggtctatcttagatatgaggtatgtagtgtaggcacagaagtaatgcctcaatttctgagctgtccaggtcaaagcacagaaagtgctttcaagtaaagagtaccgtgcttcataaggtgtgaacttcttactcaggtaatatatggcttgctcctttcttattgtctcgtcatgttgtcctagaacacatccgaaggctccatccaatacagatagatagagtagcaaaggtcgtcctggttctggcgggaccataattggtggtgtggacaggtactccttaatcttgtcaaatgctttctcacaatcctttgtctagcttgtttcggcatcttttctcagcatcttaaagatgggttcacatatgattgtggattgtgatatgaatcgattgatgtagttgagacgtcctacgaagctcattacgtcctttttgctcttaggcggtggtaactcctgaatagccttgaccttagatggatccagctcgatccctcgaggactaacgatgaatcccaataattttcctacgagaaccccgaatgcacactttgcgggattcagtttcaaattgtacctctttagactgccaaagaactttctcaggtccgctatgtgatctgcgaccctatcggatttgataatgacatcatccacatacacctctatttccttgtgtattatatcatggaagatggttgtcatggctctcatgtaagtagccccaacatttttcagaccgaatggcatcatcttgtaacagtatacacccaaaggcataataaaagttgtcttctctgcatcttctttgtgcatccagatctggtgatagcccgcgaaacaatatacaaaggattggagttcatgcttggcacaattatcgatcaggatgtgtatgtttggtagtgggaagtcatccttgagacttgctctgtttaaatcccgatagtcaacacatactctgaccttcccatccttcttcggaataggcacaatgttagctaaccaagttgggtacttaaccaccctgagaactttggctttgatatacttggtaacttccttattgattttcaggctcgtgtctagtttgaactttctgagtttctgctttactggcggacatatgagattagtaggcatcccgtgagtcactatggacgtgctcaaaccagtcatgtcatcatatgaccatgcaaaaatatcctcatactcttttaggaagcaagtgtactcttccttctctgttgttgacagtgaatgctgatgcgagtctccttgacggtcttggcgtctcccaaatttactgctttggtttcatccagattggacttaggcttattctcaaaattttcaacctccctgataatttcctcgggtatctcatcctcttcgtctgaatcactatcctcatgttgcatttcctcattacatgtcacagtcacgggttcatcagaaaaagtaataataatgctgtagaaatgaaagtataaaatagtaatgaataataaagagcaaaagagtttgattaaaactgataaatcatcttgacaagtacggctcgatgaatcaggcatttatttcgaaacaagtaaatcttaaaacaaaattacaggaaatcttagatgcctagaatggctatagaagtaaaaatttgccaagctacccagggactcagcgggctcgagatggtgtggcagtccagttcctgagagcggctcccttctttacagtttgaatggtgaggccttcttcctcctcctcctcctcaattatgcactgcagtctatgtcctcatcctccaagaacaaattcttcaacccagcgagcgcttcctcttctgtagtcccccatatcgtattagcttgatgaaaagcttgttccaaatgtgacactagttgctcgagagggtagtacggtccatgccattaaggcgaccaatttctatgctcctgccatgtgtactagtatccaagcccaaaggtggtaccatgatttttcagctatattggtttggtgataccttagaggttctttcccaatcctttgccgggttcatatccagactaggccaatatgctttctattttactgctccaccatttatccttgtcgatggcattgacccgttcaatgtgatgatatgtttccccttctagccttcttttatgtccaatagccgggatggtttgactagtgtaaatgggctactcccgtcgccgtgaatgatcacctcctgacgattccattttaatttcatagcttgatgcagttaggaaggcacggcatcagaggcatggatccatggtcggcccgacagaagattatatgaggctggtatgtcaagcacctgaaactcgacgtcgaaccgagttggccccatctgcaagcaaagtttgatttccccgatcgtggccctttggaacccatcgaaagctttcacgttcatgcttcctacccgtatttcatggaaacctttgtccaaccttttcagagtgtccaatggacaaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcttgaacctccgtcaaccaagaccctgtcaatgaatttgtcttcaattacactgtaatgtgcaatgccgattgtgatttagcccctcaggtggtagctcatcttcgtggaagataatcttataactttccaatacttgccccaccatgttggccatttctccgccagtgatgttattgggtacataagcctcactcagcactttcattaaagtgttcttacgtgcctctgaattttatgatagtgacaggatagatatctgagctggggttttgttcagatggtcgacgatggaatacttctttgcttgtactttcctccacaggtcattcggcccgatctcaatgataggctacctagtattggtatccttacttgaacctcccaaatgttcaggcatatagccccttccagtcctagtcttcccttgtgcatcatcagattcttctacgttggcgttccctttttgctgagcctcgacaacataatcccagggtattgcttttgattttaatggaggtgtggttgatactgtcatagtaaaaggtgggaccacttctacctcaaagggagcaggggtggccacatgtaaagccacctctacctcaaatggaactgatgcatttatctcaaccttgattggtgactgagtctgtaccacaataggagtaagtgtgactgcaactttaaagtcatagccttctcgaataaacccaatcgatccctcagggtcccattcttcattcgtctttatcacatgtacttcaccgcatctatgatcagggagggggttgtcgcggacattaggtgtgtcttcctttgcgtgtatgaccttgttgccaatcagtgtctggatcttatccttcaatgttcggcacccagcagtggtgtgtcccttcataccagaatggtacgaacaagttttgttcagattgacccattgggatgggttttctaatgccacagtgggaacagaagtggcataacccacagcttgcaacctttcatacaacaggtcgataggctcaacaatggcggtgtaatgtatgggtggcttgcgatcgaaattaggtcttggtctcgaaaagttttggcgagttggaggtgattataaatgggatggttgggagttataagtatggtggaaagtggccgattaggaatatttgggagataagggttgacatgtgggtggcggtgcttggtacgtgggtagaggtgtttaatatgtaagtggagatttcgggccttgggccaccattactgccccaacatttctcttctttgatatgctgcctgattgtaatgccttctttgagggcctgtagcacctcaaaattcattaccatcccactcttgattccttcttcgattctttctccgagtttgatgatatcagagaatttatgatttttgataaccatcaatctttcataatattgcggatcctatgctctaatgaagaatttgttcatctgttcctcgtccaaagctggaactctaacgagtagcatactcacggaaagtctcagtaggtttcttcttaagattctggatgtagaaaacatctggtgcattatctgtattgaacctaaaccgatccatgaaatctgacgccatacttacccaactggatcatttcttgggatcttggctaatgtaccaggacaaacaatccccagtaagactcctcataaagagattcattcggatctttttgtctttccccaccccgacaagtttgtcgcaataagtcctcagatgaactatgggatcacctgtatcgtcaaacatctcaaacttgggaggtttgtatccctctggcagttctacattcggttgtatgcataggtcttcataattcaaaccttctattcctttgccgccttcgacaccttgaactcagcttgtcaacttcttgagttcttcagccatgtttttaatgagcaggtccttttcggaggattctggtgtataagacatgggttggatggagtgaggtacaatttctacgtatatagggttgctttgatgggtgccaggaacttaggcgtagtgatggtcgttggtggagttttggggatggggaatgggttgtggtgtgttttggggagtgtggtaagtggtggttggtgggtactgagttggctgatggtgatgttgtggcggagtcaatattggcaatggattgagattttggggtggagttgcatattgatttggtgcgggaggattttgtggatgttggttttgtgtgttttggggaggtattgggttctttgtgttctgttggttgatgtcggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcaaggtgagtgacaagtttgccaagttgtgaacctactcaagttctccttgcaattccaatatcttttattccaatctcaggactagataatttggggctggagtactacggccatctgaggtttctgcgttctcaacattctcctttcggataccacttaagtcgtccatttttgctttccctctaccctttgtattgcttggaggaggaggaggtggagggcctctagatctagtatgatatgctgatgaggccagtatgagtgaaccaacctaaggagatgggaataattaaaaaaaatatgcaaaaacaaaaaggtaacaagttagtgaggattctgaaatgtttgtagtatttaaacacatattgtggaaatgtaaattcgtgtcctactttggaaacctcattgtgcccgaggtaggcctagtgataaataaatttggagaactttaaatgccaataaatgcttcatttaataatataataatagatgaatcccaaatcgacactaagataataaaaaataagtcactattggcacttggccttattacattttaggaaaatagataaatctagcctatttggtcatagaaggaccttccccagattcaatcttcctgactccatcatatatatcccccagctcgcgcagacccagcagcaagtaggctctgtccagatgttctccttcagcgttctgacaatcctcgattctctttatcactttgcctttcagctctactattcctcgctccacatccagtttcctgttggaagtggctgccatctctttccattcttcaatcatcgtacatttctctcatgtatttcccagtgctcattctcagagtcgtggaccctcttgcgcagcctgttgtatttgacttgagcctcagcttcttcgtttatgatcctattccctcgaccagttcctagcatcaccatccccttcagattgtcctccaaccatgtcgggtagagaggctcacaccccacatgatacctgtctggctcaatgtgttcttttccacaatgattttacaatgccacacgtgctgagcttggcacttataagggacatcgttgttttgaaagtctgccctgaaatgactcatattggcaacccttggtacaacctgtttcctgcctgcttgtcttatacctcggatagggatataagggtatatccctctcaacccgatcagcaccaagtgtggagcgtttctggatctgatgatgaattcgtctgttgggaactattctaacatccattgcacatattcatcagtcagattgtcgaagaactctacccattatttggcactttttggctgagcaaatctgtctggaatgtaagtcatccgcttggggtgatgaaaggcaatatggtcgttccaagcccttcgcgaaaattcttggcagtagtgacccttttgaaaatgttctaacaaccacaattgcagcaacaagttaaaaccctcgaaatgtttggccccttttggcagcactccagagccctgtagatgtcagctatgatcatggggactttagtgtatgtctatctattgatcccttccctcaaaatcttggcaaccatggccaacctagtgtggattctttcccttttcattgggaacactatcaggcccaagaagcatacgatgaacacgaacactctgcggtggatgtggcccagataagtgagagagaactcatcatggtaggtacggtaggacttgctatggccatacctctcatacaaagggtatgtaatattctttcaggcataccaggttagcattattctttaaccccatcatttttaagaaccttttaccggtatggttctccggtaccaataacccgggactatcccaagtcaacccgcaagccctccaatttcttctagaagtggtatcatttctacgttgcgaaaactgaacacagacctctcactgtcccagagcaaagtagtagcctcgatcaacttgttgtttggctcaatgtctagcagggaaggcaagttacccaggtacttccttacatgtttcttgtcacttgaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaatctagcagcaatggtggaatgttgctaaccatacccaatctggggaccccgtacctcattttctgcaaaacaaaagggttaggcctttatcccccaccagactcgactatttatacattcatgattagcatattggtatttagtttgccaaattaatgcacagatcgtggttgtgtccgttgggattatggaacctccggtggactttggataagtctcttcttaaaggatcattatgtggataacataattgctccgacttggtttgaccataatgcatgcacaattttgatcagagtaaggtaactatggggttttatacttgtaccctcaaacggacaacttgagggggaaacacgcgaaaccgtcgactgcaccgctgatcgattggttttatcacaaataagcctttccgtattcaagggtaataaataggaagagcgcaaccactcattaagcgtcactataggatttgatacgtacgagtggaatatgatgtggagcataatttattcaccaattaatagcataaagtcatgtatttgaacgtaggaaaaataaatacaatatttaaataattgaaaagacagttacagaaaaaagaaaacaaaaagacaagtcagttttaggaataaagaaacataaatgcttaaaataggcaattaaatttaaataaggggaaaaggcttaggatagagcatgcttggactaattcataaaaataggttcgttatggtaagagtctaagatattcccagcagagtcgccatgctgtcgcgctcctttttttcccttcgctggaaaagtccaggttccgacgttcatgaaggtaatgacttatttccttttgggaatttgggtactgaagagtcgccacctaaaggattacggtgcgttaagtcacccagagtgattaactcttggattggtttgcattaccagagatttagggtaagggcttgagataacctagaggggaaggtgttagacacccctcttggtccacaacgatgggtcccagccgaacttatatttacgaactagtccattaacaaataaatagttttaaacacataattacaaataagagcatgtttttggacattacatgactcaaataatgaaacaaaggaaaggcttaaacaaattgtatacatatggaaagtaaagggaatttgggaaggaggggtcctaggttggttagcctacaagatcaacccacacaatgtccgataaatactcctcaatgaggagctacacgtgacattagcgtgtagtcatcatatccctttctacccaagtccctccccttggtcatagcctaaagcgttctagcaactttgacaatgtcctatccgtgcactacccattccttcttcgtagccctggaggtattttaggacctctattctttggacaattctagactttcctaaggttttaaaggataaataagtgcacgtcttcaaacaacattcaaatacataagagaaaaccctagaacatgatatctaggtaagcaggggttatatagcgttgaattaggacaatatgtgaaagaccctatttaacttgcctactgatttgaacctgttaaatctgaatagctttaagtagcaaaaaaatagttttagagttgcagaatttaaaacgccctataggcttgcctaaacgcagaacagtgatgtcctaagagcatgataactacgttgatgtagtaaatcagtgaacagttttaaaaggacacttgatatcctataggcatgctttctagcagtagtgagtgaaggaagtgttttaaaaactcaattaaagaagtggatagttgattaaaacaattttaaagtgaactaacatgaattagactgacttgtgtaactaaattgattttaattctataggcagaatttctgatttatttccaataggcatcgtatctaattgttaagagctgatgttggaacttataggcatgattttagtgagacaaatataagcacatgcagtaccaggaattgaactcaatcactttacactatataggcatggtatctgattatgaagttgattttaaacctatagacatggattctattattgaatccatttaaaccctatagacatgagttctaatatgggaaccttttcaaccctataggcatggtttctagtgtggtaaagcaaacatagcaagtatattaatataatcctataaatatggtatctacacgaatcaccccataaatatgtaactacccaccccttttcagtaatcaccccaatgttgtttacaaataattattacagacaagctgaacaaattacataaaagaactagagttccttgttatcgttgttataatagtgtaatagtgtagatgaactagagtgccttgttatcattgttatgaacttaaaagaagagaaggtttatataggagtcgaaaacttaacaaaatgaggcaagagatcaattgagtagaaaatcagggaagttacccataaatcagcaagatcttcccttaatcgagggacagttcaatcaacggtaaacatgccaggtatttaagaaaaagaataaagtaaagccttaggtatagaataggtaattaacggctaggtacataaagttctaattagggaaataatcagtaagaatcaagtaataatgcagacaaggtaagggaaaattaattaaggcaagcaaatcaatcaaattgagtaaataagcaagaatcacacgtttgaaggaaagtaatcaaattaaaccagaaaataagggattcagagtaatcaaaggttcagaaaatcgtgaaagaagcagtatgcttagcatataaaatgaggtaaggcatgaacagtcaggatttcacacagcctcgacaaaacccatggttaaacgacactgattcaaagagaagcnnnnnnnnnnnnnnnnnnnnnnnnnnnnnnnnnnnnnnnnnnnnnnnnnnnnnnnnnnnnnnnnnnnnattttgcatgaatggctagtacacacacaagttcataatatcagtgaaagtttgaacaaagaagattcaatagaatcatactaggacaagcaaatcatgaaaagtcacaagaaactaaggcaagaacatagtcagaagtacccatatcagaaacaaaatgaaaaaccaccaacattagggtttttagtacaaacgggatagggttacaacaagtttataaaattagtcaaaaatgtgtgagaatcagaagtttaaacacaaagaatcatcaaacaaagttttaaaagaagtttcgaaaaccctaattttagaaaaggtgaagaaatcacttgaagtcaaatgattctggtagataatctcaaggatattgtaaaacacacaagaaacagactcaaatcgtcctagatctgcagatctaggaggtttagagacaaagttagggttttgtagaaaaccatacagaggtgaagaaacatactgaaaacccttagatcgtggctaacatagaacgatttcactcgaaatcacatcggaatggccaagatcaggcaagagatgaaccctagatgcaagtcgacatggctctggtcccttgagggccttagggatggcaagaatgacatgagagaagatgagaggttgccggagatggccatagatggagggtcggcatttggagattagggtttaggttgagagtgttttgagagcatagaggattttagtgcggcggggtgggttgtaaaatgaattaggtttgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggtattgggtcgggtattttaatcaaaaattgggctgggtaatttggggtccggtttgggctgaattgggattagggaggggttggaatttggctaaaattgaaatgcaattaggctagattttaaatagccattttaacactacataatttataataaataataaatgatttctaaaaaaataatttcgtgtattaaaatgatttaaaatataaaagaccattttatgtattaaaaacataattatgctttaataaggctaaaaatattctaataatattttggcataaatatagaatttagatggctaaatcaccataaaaataatttgaaggatgattattggagattttatgagtagaaagggaggaaataaatcaatttgaagcctttaaaaattatagaaaaattataaaaatgcttatgcatgctgatcgtggcctactccgcactactaattatttagcgagagagggtcaagatcgatatccacagagagctagaattggaattgagtgtctatttagcctatgattgcttagcgttccaaattgcacttctcataatttttagggttttcttttataattctacttttaacaaactacaaattgtaacttaagctaagagttaaatgctatgggttgttcaaatattctaaaagctttagggtagtggcatccacctaggtggtcaattgacgggtacttgaaactaaggctctattgacattattggggagtatgatataagagttgcactgctttacccactctacacctctcggtggctcaagtgattttgcccaattggctttctcaataccaatgggtatgcaaatttgctcaagcaacttagggttcaagtcgggtattactctctcgaagtttaaccctttaattgggactatcaattctcttgagtccatcccaattccttgttggatcaatttcggagacttaggcactctttttcaagaagagcccaagtcaaattagcacaaactagtgtttgcaaccactaattcagtaattaaaccatgaaattgatccaaataacaaacatccatactcaatatagccgtaaattgcaacactcatcaattgcccacactagggttgagccacaaccctagctaatgggtctagccactcatacttgaagagaaaaacagagaaatagatgaagatgagcacatattaattaattgctaagctaaataaaaagattcaatgataaaaagtaagtaaaaatgcccaaaatggctacaagatacgttcccatgagcgcaacaactattctaaaatgcatgatcccctataaatggaaaaaggatctatttatactaagctaaaaaatttggacaaaaatgccctgcggggttagtgcggaccgcacaaaatggtgtgcagcctcattaagctcttgaacttgaaaacttgactctctgaactcaggctctgcggatcgcacaaaatggacatcggccgcggaggcttctagtgcgttccacacaaattggactgcaaaccgcacaggtttgaaagctgcaactttaccctctctgaatcttggctctacggaccgcacagaatggtagtgcggactgcacaaaaccttctgcggccgcactgccttaatgcctgaaataccagctctctgaatctccctagtgcagaccgcacaaagtgtagtgcggccacactaggcctgtttttcctgagtttgtcttgtctttggtacttgtgcaagtttcactcctttcgagccgatatttgacatcttgtcactttgttgatcaaacctgcaatcaagcacaacttatgagcctttttggactattttgtgtgaatttataatcaaagcgtaagcaagaaggagtataaaatgcgtcaaaatccctagttatcaactcccccaaacttaagcttttgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctcaagcaaataacataagacccaccccttaagggaaaattcaagaaattttcagctgtcctaaagcaacctcaattaacatcaattgggactaacaattgtcttcaacacacataagtcataaacaactttaacctttgaaaaaccatggatcaagtgtgacacaagagcatcaagagttgactcaacacatcaaagaacacttttcacttaccttggtcattgtggaacccaaactcacacatcctcaactctccctaagccaaacttacctttagaatagtggcatgcaaaacgaggttaatggaaattcaatcttctctctcaagaaaaagtcacaagttcggctctaaataccatatgctttccccttatgtgagtatccactaatgtaagctttattcaactcaacatcatataaggcttttttggagacattatgaaggcttttggttcagggtaggacatgttttggtcgaagtaggttccatcttcccttaagcacttcttttgattcatttggcgtaatttacttgactctttgagtcatttcacttctttctaaggggttagagagacacactgtcactctttcttatgtctttcagaccttttctccttttttagctttccacacctttcattctttgcttttcttgaatccctttttattctttttcagattgaacattctttttgtctttttgcttttctttatttttcattgcctttccttttcttcattttctttgtgactttttaccactttgttgccatccttgtctctccccccaaatttatactttttccatgtgctaaaggaaaggttgggtgccaagagagggtatctttttagaacgggtataggcttgtatcatggttcttgaaagaaaaaagtctaagactcaaaagggttgactagggatcttatcattggtaggctatggaattgttcgagatatcatttggatcaaggagagtctataatcatgtctcaagtcaaaatgcacttaggattttgcctcaaaaacatttagggaaagttctagaccaatggctcggtacttggatatgcaattcatttactcaccacacaagctaagggaacattaaagacatagagttaggggcctacaatgaccttagatacgatttgagcaaacaatgatcccgaaaaccacttgataattatcggtcaacgcaagagtctcaaggtcacacctttcaccatcctaaacacaacaatttgtttttgaccataagatcaagggaaaatgtgctaggcccaagtgaagctttgcttgaggcacccttaactactcactactaaaaccagaaagaaaaacagactcaaacccttaagaaggttgtcatgccatccatcactgggaagtgccacccggttcatacaacactccacctttggaaagaaccgtggtattaagaaaaccaaaggcttattggaaatgtccaaaacaaaacaaaaagctacgaacataaataagaagctaagaatgaaaaatttgcggaaaatagaatgaatatatacaagaggggatttaaatatacattagatgggatgaatatgtacaatgaaacgtaactttatatacagaactaaagtaaaataaaagtgtgataaatgtaacgaaatatcagaattatatacagaccaaagatgaaaaatcaagaaagcataaaaatgtatcaaatatatatgtacaatcatccaaaatgtaaaatgtagggcctaagccctcaaatgaaagctggcattgtccccaatgccaactagtctaaataaaacatcaaaaagataagaggaaaaaaggaaaaaggatgtagaagcctccctaagccctgcttgtctgcataggattatgagtggtccctggttcctctgtgtgctcgggaccctcagactggttcccagtggcttgctgctctactactgggacctagacaggctctggacctagtacatcctgtggctgattggaagaggtctcctgtgggtctgccaactggatgactgcatcgagcaataagtccaaaggcagctgatcttccttcaatcggtcaacatcaaccctcaatgctttcacggactccttggaagctcgtgtcttccgcagcttctttgctcccaagcaagctccttgagagccttgctatgtgaatcatatacctttgagagcacaacctgagtgtcaaggatcttcttctgattgtctaaaatctctttcaaagcatcctctatcaactaggaaacctgtagggctggaggtgccgactgagcctctaccgtggtagtctagatggacaacttagatgaggcagtcttcatccagttgttgaaatttagaagtgcctggcttagacggtgggtagtaatatgatgggcccagtaagatgggatctccgggcccgctgatgtggatagaccagcaggaatagctgtggatgtggaaggtccgggagagatgtcagcaggagtagaggtaggctcagcagggacctctaccataactggatctttagactggacaattggggcagaagcatgagctttgtagttcttgctcttggggttgttatcccccttcatgctataccaggaaaatggggctatctccttgaccttgatgtcatagggcctctcatccactttcaggtcccggaagtactcagtcaggaagctggggaatggattgtttctatcatgctcggcacccacaatagtaataatcctcgacatcacattccccatattgatggggtaccccaccataatagaagtgaccaatacagcccgatggagaggaaaggcgttgtcatgagtggtagggtccaaccggctgcaaacaaaagtctctcatcccctcgcttcaaagttcaggctctttctcaatattttgattccagcagccaaccagtcagggacggtacgtgggattgccaagtactgtgctagccatggacaaacctcctctcccatttccaaatttgccatgtataaggtctcgtcctctcattgaagctcaggtattcatttatatacttcccatcaaacaacaccttccaattttgaaccttggtcactttggagccctttttgatgtgggctacattgctgtaaaattctttgaccaagtgttcgttggaatcctcacacttatcaaggaaatggtcccagccaactctcatcctaaactgtctcctcatgttggggttgtgaggtagcaagtcactatcaatgaaactccgctccgggatcaactttctcaccggccaccactcctagaatttatggtatgccacttcactaacaaacctatcttgccaaacctcggctttctagttctcacaatcccccccccccccacacttgtggttcacctccttcttctacttcatcgtcaccacctacttcttcctcatctcctacaacaccctcttcagataatgaagctgtgggagtggtagagtattcatccctactacccgctggtgagccctcagacgacctagaagaaatgttcactgatgcttgggctgcggggaaaggggaagagtgtctctatgtctggccctctacggatacgagatgtattctgggattgagtccaaagagatatcccgagatggctcgtactcactccccgaaatgtcaatgtctttgtcagccacttttatggccttccttatgttcttgatgttttgcctagcttggggagtgagtttgaccattttctgtttccctcccagggaggattctcctcggcctggttgtttagagcctttcccttgttgtttcaccattgtctgcatacacaattcagttgaacttgttagaatcaatttcattagttgaaagcagtgtttcaacaagaaagcagaaagttgtagaaaatacctagtgcggaccgcacaaaatggagtgctgccgcacaagggccagtgtggaccgcacaaaatggccatgcgatccgcacatgggtggggttcagaatacccaccctctgtatcttgacagtacagactacacaaaatgtagtgtggccacacaggggctagtgcggaccgcacaaaatgtagtgcggccgcactgcccaatgttcagcttcccagaagttctttagtgtggtccgcacaaaatggtaccgcggaacgcactagggaatcgcagaccgcacaaaacgaccacggtccgcactgagtgcccaggtttggcattgagttagggttcgttggatttttgcttttaagtccaaattttcacctaatgagtgcccccaagtcatttcccagtccattaaactaacaaagtcctcatgaattcaaaatttaactactctagtctaggcaattgaaataaatacgggagggagaagaacagaagctaagaaaaataaaaattaaatgaaattgcaaaattaaacaaggaaagggaagattttgttaccagattatgagatgaagtgaaacgaatcaatgccaagcaagtaattacgatcaaatgcaagggatgaacaatattagtatgctttgagagttaaaattttgaaaagggtaacaagagaccctcaaggtctatttatagagaagccactggggcccagtctcacctactagtgtagactgcacaaaatggaccgcagtccgtactgaactgttttgttcaagtttgataaggcaacactctgcggtccgcacaaaatggactgcggctgcagaggtccaccgcagaccgcacaaaatgtagtgcggccgcggtggcaaactttatagaggcttcattttacccacaccagtgcggtccgcacaaaatgtactgcggccgcactggaaacttcagagacctgtgcatttttttcactatgtcttgcactgcattaacacaaccctgtaacatctcataaccagttagcccaaaaatcaatcctatacttcaaagaaaatcaaagaaagcaagaagaaaagcacttgggttgcctcctaagaagcgcctgatttaacgtcgcggcacgacgcaggttaccatcacatcatttgaaatgaagaagtgccaccacgtggctgtcatcaattttcccaatataatgctttacccgatgcccgttaactctgaaaacttcactatttttatttttcaaatcaagagcaccaaaagaggtcacaaacacaacttcaaacggcccaccccattttgatttaagttttcccgaaaacagacgtaaccgagagttgaacaagagaaccaaattatctactttgaactcctttccacaagcatatttatcatgaaggtacttcatcttgtccttatacaaggatgaaatggagtaggcatggaatctaaattcatcaagttcattgagctgctctacaggaagattggctgcaatatcccattcaagattcaacttcctcaaagcccatatggtcttgtgctctaactcaatcggaagatggcaactttcccaaacaccaaccgatacggagatgtaccaatcagagtcttgaaagctgtcatataagcccatagagcgtcatccaacttcttcgaccaatcggtcctattagcattgaccatctttgacaatatacttttgatttccctgttggagactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtaaaaactttatgattgacaccgtacttagaaagcaacgtgttgaaagctctattgcaaaaatgagacccccatcacttatgattgcacgaggagtaccaaacctcgtaaaaatgcttttcttgagaaatgaaacaacactctgggcctcattgttgggtaaagccacgactttaacccactttgaaacatagtccaccaccacaagaatgtaagtgttcccacaagagctaacaaatgggcccatgaaatcaatgccccatacataaaaaatatcaacctctaggatggtattgagagtcatctcatctttcttcgaaattccagccgctctttggcactcgtcgcatcttttcacaaaatcacctgcatctttgaataaggttggccaatagaatcctcaactaagaactttagaggcggtcctcaccccaccatgatggccaccatagggtgaagaatgacaagcctccaagttactcaattgctcttcctccgggacacacctttggatcacaccatccgtgcaaatcttgaaaaagtatggctcatcccaataaaaatccaaactatccctattgagcttcttcctttggttagaagagagctcacacagaattattccggtcacaaggtaattagcaatatcggcaaaccatgacatatcattcattgacatcgcaaggagttgttcgttgggaaatgaatgattgatctcaaggccatcacaaggcctcacctcctcctccaaatgggacaagtggtctgccacttggttctcactacctttccgatccacaatttctagatcaaactctgtaagtagtagcacccgtcgcattaatcttgacttggagtctttcttcgtcgtcaagtacctaagagcgtcatgatcggtgtgcactatgactttggcacccataagatacggccgaaacttttccattgcaaacactatagccaacaactcttcttgataactgtgtagttcttttgagcctcattcatggtcttgcttgcgtagaacaccagatgaaatattttattaaccttttgacccaaaacagccccaactacaatgtcgattgtgtcacacatgagctcgaaaggcaagctccaatttggtgcggtaatgataggagtagtggtcaacataagcttgagaagctcgaatgcttgcatacatccctcattgaacacaaacttagcatccttttctagtagcttgcacaaggggtttaccacattcgaaaaatcttttataaacctccgataaaaccccgcgtgcccaaataaactcctcacccctttgacagaagtggggggaggaagccttgaaataacctctatcttggctttgttaacttcaatcccacgctttgaaattttatggcccagcactatgccctcctctaccatgaagtggcatttttcccaatcaagcacgagattggtgtcttcacatcgggttaatactctatctaattttttcaaatactattcaaagaaattaccaaccacactgaaatcatccatgaagacctccaagatatcttccaccatgtcagtgaaaatagccatcatgcatcgttggaaggtcatcagagcattacacaacccgaacgacatccgagagaaagcgaaggttccatacggataggtaaaaatggtcttctcctagtcctccggggcaattaaaatttgattataccccgagtatccatccaaaaggtaataaaagctctccccgcaagacgatcaaacatttggtcaaggaatggcaataggaaatgatacttttgggtcaccttgtttagcttctggtactccatacataccctccatccggtaactgtccgagtgggaataagttcattgttgtcatttgttaccacagtcataccaccctttttcggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacattgcaccggagaagtccatgagctatcggaaatggggtacacaacaccagtatctaaccacttgatcacttctttcttcaccacttattgcatttccccattcaatcttttttgatgctccaaggaacgctttgcatcatcctccaagataattttgtgcatacataatgcggggcttattccccgaatgtcagccaaagtccatccaattgcccttttttgcctttgaagcaccgccaaagtggcctcaacctgcatgttagttagacaagaagaaagaataactggtaaagtagaatttgagcccaaaaactcatacctgagatgtggaggtagtggtttcaactccaacaccggtgactcctcaattgatggttttgttggtggagtttttcggttttcaagatccaaagataatttcctaggctcataagaataagagcctatcccatgtaaggcattcacgcactccactctgcttgcattatcattgacatcaagatttaatagcatggcctcaaggggatcctccacgttgatcatagcactggtgtcatccacaatcacagctgtgacaaggtctacaaatgagcacacctcggtgctattgggtttcttcattgatttccaaacatgaaagacgactttttcatctcccacttagaaagtgagctcacccacttcaacatcaaccaatgccttccccgttgtaagaaaggccttcccaagataataggaacctcatagtccaccttacaatccaaaatcacaaagtcggacggcaatatgaatttgtccacccggacaagcacgtcattaataatgcccaaaggtcgcttcatcgatcgaaccgccatttgaagtctcattgaggttggcctagcttgcccgatacccaaagttttgaaaaccgagtagggcatcaaattgatactagctcccaaatcatatagagccttggcaaagtccgcactcccaatggtgcaaggaatggtgaaagcaccgagatcttcaagtttcgaggccattgaatgcactatagcactaacttggtgagtcatctttatagtttcacaatccatagaacgcttctttgtgaccaagtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaattttgcatagcccgggatttgttcaagagcctccaccaaaggcgcattaatggacaggatcttcatcatgtcaatgaactttttaaactgattatcatttttctgcttcgcaagcctttgaggataaggtggaggtggcctaggcaaaggaaccttggcttttggcacaactaactccggcatgtcaattatgtgtttcctagacgggttcacatcattttgagtttccacctcgacatcgttaacatcaatcctcacttcattgttcacatttttatcaaccacatcttcaactaccaaagggatttcctcttcgtgcaactcaacatcatcatccaaaacttgcttttgcttagaggcattcacatcaccacctctcccacttcttgttgtaaccgccatcacatgattgtttccactcttcgggtttactaccgtatcacttggtagagcacccttcaggcgggtattcaaagactgagagatttgtcccaattgcacctccaagtttcggatagaggtattgtgggatgccaattgtgcatcagaatccacattcttcttcatcatttgttcgaacatcatttcaattctacctaaatcattgctagaagaactaggaccttgagagaggaaagggggtggattgtttggttgttcgtacattgggggcctttgaaatccttgcccccggtttccttggttcccattattccatctaccttgattgttattattgcccccattgttattattaccattccaattcccttggttgccttgattgttgttctgattcccccaattgtcgttttgattattgttcccccaattaccactattttactgttgattgccccaatttccttgaggtatccattgttgttagtttgaagagttgcctcgttgaccttgatagttgtttacatattgaacctcttcactttggtcatcataaccataattttgacacccattatagtcatcaacaaattgctcagaattcccttgattttattgccttttttgtcttctcttggtaacaagcatattgacaccctccatggcattcacctggcaaggattctggacttgttgcaactgatccttagccaattggttcatggtagtcgtcaactccgctatagcttgtccatggtcatgtaatttcttatgcaaatgaataaccgtggggtcaccttgaggcacattggctctactttgccatgcagaagaagtgtcagccatctcatcaagtacatcacatgcctcatcatatgatagcttcacaaagttgcccccgaaaagttggttcactatgcattgatttgttgtattgatgccctagtagaaggtttgttggatcatagcttcggtcatatcactccttcaccatcgttctacaccgctcccaaatctcatgcaaaggttccgtggtctcttgcttgaaagccaatatctcatctcgaagtgccgccatatgcctgggtgaaaagaatttagaaatgaatttatctgccaactcatcccaagttgtgatggaatggttggggagtctctcgagccaatctaatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgaaaatgggaaaagtctcaatctaagcacatcttcggacacattcgtttgcttgctcccccagcatgtatccacgaaccccttgagatgtttgtagtcattttgatccgcagcgcccgtgaagtatccacgctgctcaagtaaggtcaacatcatattggttatctgaaaattgccctcacagattcggggtgggacaatagcacttgcatagccttggttcggtaatactctgggagccactcttggaggtggagaaggagggtctggaatattgccatttggattagcattggcatttcggcctctacattgtccttgaggtacaagaggcacctcatcttgttcaacatcatctacctcctcccccgcaatcacgtttccaagagggtcattagtgttgttcaatgccatattggtacctgagtcgcaacacaaacaagtaagtaacaaagaaggaaagaagaacaatacacaacactaactgaatagatagccaaaaccgttagctccctggcaacggcgccaaaaagtgatcgcgacctactccgcactactaattatgtagcgagagagggtcagagcagcttttacccaattttgggtcgggatcgatatccacagagagctagaattggaattgagtatctatttagcctaggattgcgtagcgttccaaattgcacttctcataatttttacggttttcttttataattctacttttaacaaactacaaactgcaaattaagctaagagttaaatgctatgggttgttcaaatattctaaaagctctagggtagtggcatccacctaagtggtcaattgacgggtacttgaaactaaggctctattgatattattggggagtatgatataaccgttgcactactttacccactatacacctctcgatggttcaagtgattttgcctaattgactttctcaagaccaataggtatgcaaatttgctcaagcaacttagggttcaagtcaggtattactctctcgaggtttaaccctttaattgagactatcaattctcttgagtccatcccaattccttgttggatcaatttcggagacttaggccctctttctaaagaagagcctaagtcaacttagcacaaactagtgtttgcaaccactaattcagtaaataaaccatgaaattgacccaaataacaaacacctatagtcaatctagccctaaagtgaaacacccatcaatttcccacactagggttgagccacaaacctagctaatgggtctagctactcatacttgaagagaaaaatagagaaatagatgaagataaacacatattaattaattgctaagctaaatacaaagattcaatgataaaaagtaagtataaatgcccaaaatggctacaagatttgttcccacgagtgcaataactattctaaaatgtctgatcccctaaaaatggaaaaaggatctatttatattaaactgaaaaatttggacaaaaatgcccctgtggggttagtgcggaccgcacaaaatggtgtgcggctgcactaggctcttgaacttgaaaacttgactctctgaactcaagctctgctgaccgcacagaatggactgcggccccagaggcttctagtgcggtccgcacaaactggaccgcggaccgcccaggcttgaaagctccaacttcaccctctctgaaccttagctctgtagaccacacagaatggtagtgcggccgcattgcctttagtgcggacctcacaaaaccttctacgaccgcactgccttaatgcctgaaataccagctctctgaatttccctagtggggaccgcccaaagtgtagtgtggctgtactaggcctatttttcctgagtttgtcttgtctttggtacttgtgcaagtttcactcctttcgagttgatctttaacatcttgtcactttgttgatcaaaccttcaatcatgcacaacttatgagcctttttggactattttgtgtgaatttataatcaaagcataagcaagaaggagtataaaatgcgtcaaaatccctagttatcacatgcttatatatgcatatatgttattttgaaactatatttatgtattaaaaaaatatatataggaaaaaattgggtatcaacatcgaaaattacaagtttcaagattatctgttgtgatggtcggtacttcaaatcttgtcttcaagtttcagcaagcctacacctcgacaaaccttgaagtagggggcagttgtagacactaaaattttaacagattaagataaatcctaaattcaagacgattcttgaattattaggagtctattagggtacttggtggctactccatccaaaccctaattcatgcctacaaataaggctacatatgttcttcaaagacggtctcaacagttccataaactctcaaaacatgcacgagatcaaatatacgatctctaaaattccataaaattcttggaatattcattaatagatcaaagacatgccaaatatgtcttgctgaaatttctagcaacagtcaagatccaaacggagtgctgctatattcttcttgatcatcaaatacatcaaggagatgcatatcattctactttcgagaaatatgctgctaagaccctcgaatcacatagaataaatcggagggaagaatcaagggataaacagagttgtaacctataatgtttataaataaaattctttttttctttatagttgtttgtgattgcaattttgtttttctctgcataaatttgttgcaaacaacatgtattattttcaatcaagaacaaaaaatataaaaatagtgcaccacctgtagtatatttgcacatcctgttgttacagttgatttccatgttttaatttctttcttccgacgtacgtaccaatattcattaagctagatttaaatttacattaaagaacaaccacaaagattaattaatgaaatttacatgtacggttccaatttattccgatgttaattgtatgggccaaaaattatcttagctgtatttgtcgcgcctcctttttccctcttcgcatcggaaatcggggttatgacatttttgaggtaggacaactcattccttttgggaactggatttgcatttgaagagtcgccacctaatgatttaaggtgcattaggacacctatagggttcattttgaagtttgtttgatgaccagagataggtaatggcttgaaattatcctaaggtgaaggtgttaggcacctctcaggatccactagtgtggttcccggccagacagttttgtgaattttgtacaattagcaaacagacaaatataggctcaaatagtaggggatttaagtttaaacacataagagtttgaaaaacaactgtaacaaggcaaattttgaaaaggagttacattttacaaatacttgagaatgtaaaaagaggggggtgggggatcctaggtttatttataatatggatcacatcaatgcgatacccggtatgacactcatcgaaagagggaatacacgtggtattagtgcaccggtcatcatattcatatctatccttcccacctcgttaaggtatcaaagtgcagattggtctcgacctctattgtatgttattacccgtcccattcctatcagtcccggaggaatttaggactactattcctataagagggaggattttaggctgactcttgagttttaaaggtaaaaagtctaaggcgacatacaaaacacgtagaactgcatattagggaaaacatataaataaataagaggctcatatatacctccgcagacaatgcacataaatagcatgacttaaaaacagttagggtctaaatttaaagtactaagacagggtgtttttgttgaagcagacaaatttattacataactcagataagaagccccaatcatgcctgcctgctagttgtagcagttgttaattaaacaaaggcggattcagtttaatcatcaatacctgaggcttgcctaagtgtgtattggtgatttcctataagcatgatatatattactgattaagaaggcagcagagcagtggttaatttttaaacagacgatttggaccctataggcatcctttctaaaccgcattaatgaaaggaataggttgttcaaactgattctgaacagtacaagtcaaactgattttttactaaactggtctcagatcctatagacatgatctcgattatcgctgattttaattcctaccagcatggtatctaaatattaaatgctgatttgggtcctataggcatgatatctagttgaacgtgaagtgaaacaagcaggatttgatcacagcgaaattcctataggcatgacttttataaaaatattgattttaatcttataggcaatacatctaatttcaaagctgattttaaccttatatgcatgatgtctaagtgtggaagtaaaacatgcagaatttattaaacagatcctataggcatgtcatctatccttctaatagctaaaacatgtataatcaccccatcccttttcactagccagcccctcaatatttgttacaaattattacagaccaaaaatgaatgagttacatcagaaaagtgcgaaaacaaggagttacaaccataggaagcctgattcttgacttcctctctgagttatggaataaactacctcaaaaaccaatgttctcaaagcctttcttagatctggttgtgtcaaagttccctaagggtctcaagggaccccgggtagtgcttacacccaagttgcataaccagacaaagatgagtgcagtgtggaagggccagggcatgcccacaaactagccagagaacacaaacacatagaggggatatgggggtttgggattcctaagtcagcaaatcacataacaagtgactgacagagtacatatataagggaaacattaatttaaaaggggatggagcatattacaacatgctagtaatgtaacttgattgcataaacataagcagaagtaggcaagagtgaaaggaactgagatagctaaagaaacatgttgttgttgatgcttcaaaattagcatggacataccagtagagaaacagagtgcagaaagaaagaaataagcaagattccacagtctagccttgggctttcagctggctaaacaaagcagtagcataagcagcagtaaagaaaagagagaaagttttgagtgtaagtgtgtgttcttgaactcaattgttcgtgtctttgaaagaagagagggtgcagggtatttataatttttgaaaacgagtgaaaagtaaggtaagaagtaaagtcttaacagaaatatggaagcaatcccaatcagaatcaattaacataagtggttccctttaattaagaaatcagttttgggaaaagattgattattgccatataagggagtagtaaaattatgaagtaaataatcaagtctaagtataaaataggcttattttgggaaaggattcagcaaggtaaaacatcacagtaaagggaaaggaatcaattaattttaaacaggtgagtgaaattagggttcataaaagaaaagcctttgcaatcagtcacaagatcaagatcaatcaaaggagaaacatggttctgcatttcagtacataaatagagtgaacagaagcatcagacatgcgaggccaaaaacattggcaaaagagataatacaaacatacagtagtggcaaaaataagctaggattcagtagtaagaaaaagtattcaaagcacagtagtcaagtaggtcaagtagtcacatagaatcaacagtgaagaagaacatagtatcaggtaagagaaatcggaaataagtaagtgagcaaaaacttctaagaaatttagggcttcaacagtagtcgagtttaatagatgaaaagaactcaaatcaaacaagtcgaacaaggaaaagagagtcataaacgaagaacttaagataagcacacatttaagcaaataatttcagaactcggataagactaaaaagaactagggttttaaacatgctgactcaagtagaaggaaagcataaacaggtaacatagcaaaatcatgaaacaacaccaaaatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatagtaagcacagatctaaaatagatctgaagaaaaatgaaagatcttatagattaaggttttggaaaacgcagaaaaggagagaaagaccttgaaagttaccgatctaaaagtcaaggatctgccttgaaaggccatgaatggccggagaaaggtcatggatggccagagaaaggccatggacagaaatagagcaaggaatggaccagattccctcgaggtctggccatgaaaccatataaacaaacacgcaggagccgcagaaggctaatacacatctcaaatgtccatgagaggccatggattaggcaggggttgaggtggattcgggtgggattagatggcgacggctagggttcatgagggattgtagagagagttgagagaagagggattcaaggacggagtttggtgaagaatgaggtagggtaaggggctttttgggtttaattatggaagggtgaatggtggccgttgatttgagtgatcaacagcctggattcaaaagggtaggtgaggaatccgggttgggttgtttaattaggttagggatcgggttttaatgggaattgggccgaggaaattgggtttaatttggggtcatatttaggctaaaattgaaatgtaactgggctattatttaaatagacaatttttcccttttaaaattataaaaaatagtaaattaattcctgaaaataaattgagagtactaaaatgatttgtaacatataattaacaatttaaaaatacaggcttaattttatgaatataaaacataattgaatcttaaaagggccaatattgcaattatatgcaatttagcttaaaaatagtaaataattttataaaaaatatgcaaaaattaccttagctatatcgtagtataaatataaaagtccaacaaatgaattacaaaaataataattttggtcacaattattggttttttatggataaaagagggaaataaattgatttaaaaacctttaaaaattatgaaaaaataataaaacacttggatatgcttaaatatgcatatatattaaatttgaagttattttgcatattgaaaatatatagggaaaaattggatatcaacagttgccctctttacccgggaaggatgaaagagttgtcgggtaaagatatgatggccaattttgaccaagcgaaacagtttgaagagatttaggacgcaccatggattttgatctacctacatacccctggttttacaagaatcaggtcatatgtagttcaggatccgtcggtggagtatgccgatggagacttttcaagaacggacgcaatatccaggatggggtgagtggacggcttgtgggaatggttaaggttttatatggctgcgggaactggagtgggaccgcttctgccgggatgtccgttgctcgccggtttacctgcaattagaaacaatacaagcgtatatcgcgcataaatttaaacatgatgcaaattcacgtcggaccatgaatgttgtcttcggacgatgaggatgatgtccttagaccatgattccctgggccatgaagcgtacaataaaggactcgccggccatgaaatgatgctctcgggctatgaggatggtgcctccgaaccatggtgcctttgaataatgatatgcaacagattaaaaggggtcctcaggccatgacatggtgttcttaggctatgaagatgatgcctctgaacgattacgcctttggataatttggcgatcttttagcccatgagatgcagtatgaggcaatctttcagcccatgagatgcagtagcatgatgcggacaagacagagcttagtcttgcgaattgaaggacaaagcttagcccgtaagagaaatgaaatagacgatgcttgagatagtgcttagtttcgaagaaaattggaggcagagcttagcctcagaaggtataatgatagccttatgcaaagatgaagaatgcggagagaggtagagcttaacctcggaagacagaatgttaaccttatgtaagaatgcagatggagacatcgtttagtcttggaaggcaggacggtagccttatgcaaaaatgcaaatacagaaagaggtagaacctagctttggaaggcagaatggtagccttatgcaaaaatgcaaatccagagagaggtagagcttaacctcgaaaggcagaatggtagccttatgcaatgcaaatgtagatggagacagcgtttagtctcagaaggcagaatgatagccttatgcaaattggaaggtagaatagtagccttatgcaatgcaaatgcagatggagacaacgcttagtattggaagacaaaaaggtagccttatgcaagaatgtagatggagacaacgtttagtcacagaaggtagaatgatagctttatgcaagaaataataaaataacgaatgacaatagagttttcttagctgatagcagattgtggcattatgattattgggagcattgtgactacggagaattacttgtgtactgatagcaaatgttggcaagtgcaatggttcggagagtcgtactcataggcatatagtatgtttaatgattttgcgattctagtacctgcatccaaagaaaaatcgtgagtttagatgaaccgacgactgctaaacaaaacaatttcaataataaacatgcatgcttttgtaaaaatatgacataagtgtataaatataattttttagatgaaccgatgactgcgacgtagcttgggacattgtaacctctccagctatggaattttgagggtccttctcaaaattctaccttagtttaacaggtttatgtttctgactgttgctcatgtggtgatcggctgaaattacttcagaattttgagggtcctccttaaaattctgccccaacttctaattgtggtgggaaatgaaaattttattgaattgtgaccgaacccatagggttgcctatgtatcccctcttaaacaggaaacaggtcaggtgtagttcaatttacatcatataaggaagcataatgattacacacagtaatgcttgactgcatctgaattgatcgactttggccaaacttcttctccgtccatttctacaacatccatctagatctgatgataaccagcgaagtaatccacaaatgactgtaactcatgcttggtgcaattgtcaatcaggatgtgtatatttggcaaagggaagtcgtcttttggactcgcccagttgagatcccggtagtcgacacaaactctgaccttcccatccttctttggcactggtactatattggctaaccatgtcgggtactctactaccctgagaaccttagctttgacctgcttggtgacttctttcttgattttcggactcgtatcaggtatgaactttttgagcttttgctttaccggtggacacgttggatcggttggaagtttgtgagacataatagacgtactcagaacagtcatgtcatcatacgacctgacgaatatgtccttgtattcctttagaaattctgtgtattcttccttttctaatggcgataggtgaacgttgattcgtgtttccttgacattttctacatctcccaagttaacaatttcggtctcatccaggttggacttaggtctattcttaaagttctcaatttctttgacaatctcatctggtatgtcatcttcctctgaatcattgtccatttgttgcgttgtctcattacatgtcacagttattggttcatcaagataagtaatagtaatgttgtataagtaaagtaatgggagaaaatgataatgagtgttgatttatgagaaaaaatcaaaatgctttgataaattgcataattgttttgaacattgaaggttttattgcgggaattgaaaaatgcgaaaagaaaatcatttaataaataaaacagagaatgatgcttgttttagccttgccaccccgaggctcgttaggttctggttgtcctaatggtccaattattgaggcgtgcctctctgctcatagcttgtatggaagggccttcctccccctcctccttgagaacaacacaatagtccatgtcattgtcttctaggaataagctcttcaccgctgaaagtgcttcttattcgtctgacccataaacaatgtcagcctgttggaaaatcttctctagatccagtattggctgctctagtggatagtaaggactgcgccatggtggcgaccagttgttgaattcttcccaagtgtagtcatatcccaaaccgaaggtagtgccatgcttcttgagttgtatgggcttggtgatttcttggaggttcttgccgagacccttgccaggttcgtacccactccaattcagtatactctcgattttgttatcccaccatttatctttgtcaacaacattttcccgttcaatgtggtggtaagtctctccacttagctttcttcttccttcgattgccggaatggtctggagactgtatatagggttgctactgtcgccgtgaatgatcacctcctagtgtttccattcgaattttactgcctgatgcaatgctgacgctacggccccagcaacatcaatccatggccgccccaatagcagattgtaagatgctggcacgtctatcacctggaaattaacatcgaaccatgttggtcccatttgcaagcataggacaatctcacaaatggtggatctctaggaaccatcgaaggctttcacattgatagctccatcttatatctcgtgtagtcccttacccaacttcttgagtattaccagtggacaaatgttgagactagaacctccatcgatcaggattctggtgataaaatagtctttgcattgcacagtgatgtgcaacgccttgttgttccccaacccttcaggtggcagctcgtcctcatgaaaggtgatcttatggctctccaacacttgtcctaccatgttagccatttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatgcttcactcagcacctttagcagagcattcttgtgtgcctcagaattttgtagcaaagcaagaatggatatttgcgctggtgttttgttcaactggtcaatggccgagtattctttggcctgtattttcctccaaagatcgtctggacccatctcaattgggcggcctattagaggcctgctttcttaactcagctagatgttcaggggtatagactctaccagttcttgtcataccctgtgctgcaacggtctcttcgaacctgaccttgcctttcctcctcgcctcggctgtataatcccaagatacaacctttgtatggaatggtgtcatggttggcattgctactgggattggcacggctaacctcactccgaatggagcatatgcctcgggtagtaaaactgtaacctcaaatattgtgggtgcattttacggagacacgaattcaacctcaattagtgttggtgtctttgcggatgaagttaattcaaattcaagtggtacagacaagtctacctcagcatcctcagacggttgtatctagactatgattggattgagagtgactgttagcttctttgggtcatcacattctatgatcaacccgatagatccatcgagatcctaatcatcctctatttcaatcatgtggatacctctacccttatggtctggcatagggttgttgtggacatttggagcaggttcctttgccataataatcttgttatcaattaaagactggatcttgtctttcagggaacgacattcatcgatggtgtgccatttcatgccggagtggtatgcacaggatttgtttgggtaacccactcagaagggttctcaggggttgcagcagagatggaggtgacataactagcagctttgaatctctcgtacaattggtcaatgggtttggcaatggctgtatattgttttggaggactgcgatcaaaattaggtcgaggtctagggaagttttggcgtgtaggaggtgattgatagtgggatggtggagcattgtaggtttggtagacatgagcgggttcgaagtatctggttgaagtaggttgatatgtgagaggtagaggtgattgataagttggtggtgagggtgcttggtagtttggagttggctgatatatgagtggaggtgttgggtaagtttgttatttgaggggagattttttcctttgtgcaaccatcacggaccctacgtcccttttcttggatgcaccaccagactgcaaggccttatttgaagtttgcaaggccttgaagtttgtaaccatttcgtttttgataccctcttcaattctttcacccagtttgataatgtcggagaatttgtgactctcgatcatcatcaatcattcataatactgcgggtcttgagtccggacaaagaatttgttcatatgttcctcttctaaggcaggtttgaccttagcagcttcagacctccagcgagtagcatacccgcgaaatgtttctgtaggcttcttctttagattctgaatatagaacacatccgcacattttttgtgttaaacctaaacctgtacataaaatcgaatgtcatgcctacccagattgaccacttctttggatcttggctgatgtaccaggacaacacatctcctttcaaacttctcatgaacaacttcatgcggattctcttgtctttccctactctaaccatcttgtcacagtatgttctcaaatggatccttatatccactgtatcatcaaacattttgaattttggatgtttgtaccccttgggtagttcgacatcgggctatatgcaaagatcttcatagtttagcccctcaattcctttacttcctttaatgccctgaatccggctagtcaatttcttaagttcctcagctaggtttctgatgagcatgtctttttcatcagactcgggtgtgcttgagataggttgggtggagtgcggcatggtctacacgtagataggggtgtgaaaatggtcatttgtggagttttggggttctgggatgagtactggagtattgtttggtgtatggtaggtgttgcattgggtctttggtggaatagtgtgatggtgaggagcgggatgattctgtttctttgggatgttttgaggaggtgtagggttttgagtattgggaaagttgatatttggggtgctgagggaaaatgagaggcttgccagattccgaacctgatctagctcttcttggaatttcaacaacttttgttcaagctgggatacattctccagataaacctaagtaccatggccattagtggcctctacccgttcagttggattctcctttctgacgttgttcaaatcttccatcttgcctttattcttgtttttgacagaactaagaggaggagtgggtggagggcccctggatctcgtggaataggatgatgtttccagagtgcatgaactaacctttggggaggggaataataaaaacaaaaaataaaaacaaaaggtaatcaaattattgaagaatataggaagtattgcaatatttaaacacatagtgcgggaatgtaaagcgcgtcctaatttggggacctctttgtgcccgaggtaggcctagcgacaaatttatttggagaacttaggatgctaaatgcctcattttattgataaaaagtagacgaatcccaaattgataaataaacaggaaataaaagtcactaatggccatgggccttattacatttataaagcaaaaagataaactcctatctacttggtcccagaaagaccttccccagattcagcatccttggctccgtctaacagcttccccaactcgcgaagtcccagcaacaggtatactctggttaggtgtccgccttcggtccctttcgcattttgacaatcttcgtcccttttgagaaactttctctcaactccactatacctcgctccaagtatcctagtcgcttgttggcactgacagccatgtccttccattcctcaatcagcttctggttggactcttgtatctcgcggtgttcgctttcgcactcccggatccttttgcttagttggttgtatttgacctatgcctcagcactttcatctataatcctgtgaccttgagcaaaccctagctggcccagaccatcatgattgtcttccaaccaaccagagtagaaaggagcgcaactagcatgatacctgtctggctcgatggtatctctccccattatgatcttgtagtgccacatatactgatcttggcacttgtaaggactatcatcattcttgaagtcatcccgaaaatgactcatcttgtcgacccttggtataacctgcttcctaccagcttgcctcataactcggagagggacgtaagggtatgttccgctcagactgatcagtatcaggaaaggtgcatctctagatcgagcgatcaactcctcggttgaaaactactcgaacaaccattggacccattcctcagtcagaatatcaaatagctcaacccatcctttggcatcctccgactgagcaaacatattggggatgtaattcattcgctttggatgatggaaagcgatgtgatcatcccagtccctttgctgaatcacttgttggtattctcccctttggagatgttccatgagccatagttgaagtaataaatttctggcttcaaagtgttttgctcctcgttgatagttgtccaaggctcgatatatgtcttcaatgatcatgggcacgatgttgaatggctgcccaccaattccttccattagggtcttagttaccatagccaacctagtatggattcttgctttcttcatcggaaacatgatcagacccaggaaacaaaacatgaagacgaaaaccctacgatgaatgtgccccaaggatgtgatggcgaactcgtcaaggtaggtatggtaggatttgctgtgaccgtacctttctaacaaataatcacaagggatgtagaattccttcagacatgtcaattctagattcttcttcaaacctatcatttttaggaaacccctgcctttacggttctcaagcatcagtagacccggagtttcccatactagaccggccaatcctcctatatcctctagcaagggtgtcatttcaatgtccccaaagtggaatacagcccttgataatcccaaaacagtgtggcagcttctatgatcttgttgttaggttggatctccaaaaggggtggtagatttcctagatattttcggacgagagtttgatcactagagtgatgatctttccaccagattagcagtcttatgtggatgatggtgaccatgctaaatctagggacttcatgcctcatatttctgcaagacagaaaaggttaggcccttacccccaccagacttgactatttaataccaacaattagcatgcatcatttagttctccaaataaatgcacagaacgtgacgatgtccgtttaggcttagggaaacccagtggactttggtcaaggccatcttaaaggatcattatatggataacatagctggcctgactaggtttgaccatgatgcatgcacaatttgaatagagtaatggtttctatggggttttagactagtacccttgagcggacaactcaagggggaaggcacggaaccgtcgactacaccgctaatcgaatggttttatcgcaaatacgcctttacgaatttagggggtaatgatataggaagagcgcaaccactcattataagcgttgctatagtatttgtttggcacgagtggagtatgatgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattaaaacatgttggcacatatttgcacgttaaaaaagcgataaatacaacagtttcataatttaaagcagcaataaaggaaagaaacaggaagacatgtcagttttgcagttgaaaaggatattaaatgcttaaagtaattaaacaagtaattgcacataaagaggtacaaattcacaagaacaatccaaaatggtaaaaccctaaaaatccccagcagagtcgccatgctattgcgcccccttttttcctctttgcatcggaaaatcgggtttatgacatttttggggtaggacaactcattccttttgggaactgggtttgcatttgaagggtcgccacctaatgatttaaggtgtattaggacacctatagggtttatttctaagtttgtttgataacatagatagggtaagggcttgaaattatcttaaggggaaggtgttaggcgcccctcaggatccactagtgtggttcctggccagacagttttgtgaattttgtacaattagcaaacagacaaatataggctcaaatagtaggggatttaagtttaaacacataagagtttgaaaaacaactgttaaaaggtgaattttgaaaaggagttacattttacaaatacttgagaatgtaaaaggagggggggtcctaggtttatttattatatggatcacatcaatgcgataccaggtatgacactcatcggaagaggggatacacgtggtattagcgcaccgatcatcatatccacatctacccttcccatccagttaaggtattaaagtgcggattggtctcggcctccccatcccattcctattagtcacggaggaatttagcactactattcctataagagggaggattttaggctgactcttgggttttaaaggtaaaaaggctaaggcgatatacaaaacaagtagaactgcatattagaggaaacatataaacaaataagaggcttatatatacctctgcaaaaatgcacataaatagcatgacttaaacacagttagagtcagaatttaaagtactaaggcacggcattttaattgttgaagtagaccaatttattacataactcagataagaagccccaatcatgcctgcctgctagttgtagcagttgttaattaaacaaaggcggattcagttttatcattaatacctgaggcttgcctaagtgtgtattggtaatgtcctataagcatgatatctattactgattaaaaaggtaatagagcagtggttaatttttaaacaggcgatttggatcctataggcatgctttctaaaccgcattaatgaaaggaataggttgttcaaaatgattttgaacagtatgagtcaaactgattttttactaaactggtctcagatcctatagacatgatctctattatcactgattttaattcctaccagcatggtatctaaatattaatggctgatttgggtcctataggcatggtatctagttgaatgtgaagtgaaacatgcaggatttatttgatcacaacgaaattcctatagtcatgacttttataaaaatattgattttaattttataggcatgacatctaatttcaaagcttattttaaccttgtaggcatgatgtctaagtgtggaagtaaaacatgcaaaatttattaaacagatcctataggcatgttatatacccttctaatagctaaatcatgcataatcaccccatccctttttactagccagccctccaatatttgttacaaattattatagaccaaaaatgcatgagttacatcagaaaagtgcaaaaacaaggagttacaaccataggaagcctgattcttgacttcctctctgagttatggaataaactacctcaaaagccaatgttatcaaagcttttctcagacctgggtttgtcaaagttccctaagggtctcaagggaccccgggcagtgcttacactcaggttgcataaccagacatagatgagtgcagtgtggaagggctagcccttatgtgtccaagttcagagggagctcaaggtttccaagtcaaggctcaaacaagaggggtagaaccaaggttataagattatagtggaagtgcagaacatagttgaaagagatttatttaaaactgggttgggaactagcaagtggtaagggtgatttgaaaatagtagtagtaaagctcaaactgaacagaataagtaattacacaaaggggtcaagggggttttgggaatacattgtatgaagcatatgaccccagaaagggtcaggtttgattcatgcacaacaatagataatgctggcatacccacaaaccagccagagaacacaaacacatacaggggatatggggttttgggattcataagtcatcaaatcacataacaagtgactgacagagtacatacataagggaaacattaatttaaaaggggagggagcatattacaacatgctagtaatgtaacttgattgcataaacataagcagaagtaggcaagagtgaaaggaactaagacaactaaagaaacatgttgttgttgatgcttgaaaattaactaggacataccagtagagaaacaaagtgcagaaagaaagaaataagcaagattctacagtctagccttggactttcatgcggctagacaaagaagtagcacaagtagcagtaaagaaaagagacaatgttttgagtgtaagtgtgtgttcttgggtgaagagtgtttatagtttttgaaaatgagtgaaaagtaaggtaataagtaaagtcttaacacaaacatggaaacaattagatcagaatcaattaacataggtagttccctttaattaaggaatcactatttgacgtgtaatagcaagtttatttaaggaaagaaatcataaaagaaaagcctttgcaatcagtcaaaaggtcaagaccaatcaaaggataaacatggttctacacttaagtatataaatagagtgaatagaagcatcagccatgcgaggccaaatacattggcaaaatagataatacaaacatatagtagtggcaaaaataatctaggattcagtagtaagaaaaaatattcgaagtacagtagtcaagtaggtctagtagtcacataaaatcaacagtgaagaagaacatagtatcaggtaagagaaatcggaaacaagtatgtgagaaaaacttctaagaaatttagggcttcaacagtagtcgagtttaacaaatgaaaagaactcaaatcagacaagtctaacaaggaaaagagagtcataaacgaagaacttaagataagcacacatttaagcaaataatttcagaactcggataagactaaaagaactagggttttgaacatgctgactcaagtagaaggaaagcataaacaggtaacatagcaaaatcatgaaacaacaccaaaatcagagaagagatctttaaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcgaaaaaaatgaaaagtcattttgaaagaaaaattgaagaaccttcgagaaaacacttaagaaattcataacagatctaaggtagatctgaagaaaactgaaagatcttaaagattagggtttcaaaaaatccagaaaagctgagaaagaccttgaaagttaccgatctaactaggaaagtcaaggatctaccttgaaaggccatgaatgaccggagaaaggtcatggatggccggagaaaggccataaacagaaattgagcaaggactggaccagattcactcgaggtctaaccatgaaaccacagaaacaaacacctaggagccacaggaggctaatacacatctcaaatggccatgagaggctattgattcggcaggggttgaagtggattagggtgggattagatggcggcggctagggttcatgagggattgcagagagagttgagagaagaaggattcaagggcagcgtttggtgaagaatgaggtagggtaaggggtcttttggatttaattatggaagggcgaatggtggcagttgatctgagtgatcaacggcctggattcaaaatggtaggtgggggaatccgggttgggttttttaattgggttaggggtcgggtttgaatgggaattggtccggagaaattgggtttaatttggggtcagatataggctaaaattgaaatgtaactcggctattattgaaatagccaattttccacttttaaaattataaaaaatagtaaattaatttctgaaaataaattgagagcactaaaatgatttataacatataattaacaatttaaaaatacagggcttaattttatgaatataaaacacaattgaatcttaaaagggccaatattgcaattatatgcaatttagcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatatgcaaaagttaccttagctatatcatagtataaatataaaattccaacaaatgaattaccaaaataatattttggaaacaattattagtttttttatggataaaagagggaaataaattgatttaaaaacctttaaaaattatgaaaaaataataaaacacttggatatgcttacatatgcatatatatgtcattttgaagttatttttcatattgaaaatatataggaaaaaattgaatgtcaacagtatttagaccacgtcagtataaatagggccttcgagggctgccacgtattaccaatgtaactttaagaaaaaacagattcaaggtcgaagtcatatgacaagagatgaagggctagatcgaggggttaacagagatcaaggtcgaggacaaacactctccttaaacagagtaataatggctagttttaggataagactttaaaaagaatatttcacagaatattttctggatctgtactattagggttttgtggcacatgtacccttataaatagaaagagacatagttataggggataatgaacacccatttgtaaaacaacaacactttgatattctttgagattttttctttattacatatatataaaagatacctttttcttgagatccctgcctagattttttcccacgatccaaggaaaatatgaatattcaaaggcttatcaatcatttatcattgtcggaaggaatattagacagcttcattccctttttcggtcacctctgtcacatatatttacataaataccattatacatcatttattgctactgaatgttattcacttcatatttgtgccattaagtgttgttcattattatatatttatcactgttaccacatatcttgtaacattttatcacgacactagttaaacattctaagggatattattattggctaacattaaccccaccttgttaaaaaatctaattgtttaaacttgatctaaattttggtcaaaacgtttggcgtcgtctgtggggatttcttagctaatcttttagtttctattaagtctaaaactcaagtgactttctaacctaagaggccacaaattttttctcctctctgcatgcacaaacatttccctggaaagtaaccaaggaaaagggactagggcgacatgggacataccagtaacctcatgagctccatcaacgagagctatgaaatacagtgcgaggatatgacgcccactgcctcccctaggcgtgagaagtcatctccccttattgcaacacaatgaggctaaacagaaaaggatcttccatgtatacgggagaaaggaagccacctgcaatgaaaaaacccctcgaagcatgactaactgataccctagtaagcgtgctcaaaaaacaagctccatgcacgaccatagaaatcacaagagcccacatggtacaacgaggggacgaacatggcgatcaaccagaccctccaactctaggtataacacacaatgttactgacagtgcagatgacaacgtcctcgccgctattttgaaaagaatggaagaaatggagaatgaaaataagacgctcacagaccaaatgaaggaacatggggagcgagtagacaagatatcgggtgcccctaagttaccgccaaaaagggacgtcggtaggtttgtagagtagccatagcgaggaagaggccctacatgccataccaaataccttcaaaatgccactgtatctctaatatacgataggacaaccgacctcgaaaaccatgtgactcattacgtcaccgccataaagggcaacgacctcaccaaggaacaagtgtcctccactttgttgaagaaattcagtgaaaccctccctagaggggtattaacatggtattcacggctaccagcctgctccataaaaacgttcgaaaaaatggctgacaagtttgtgatggcacatgttggggccaagaaaatcgaaacgagagtaaacaacatcttctccatcaagcaatccttaggagagggactgagggacttccttacccgattcaacagggtaaggatgaccttaccaaatgtatccgaagggattatagtcacagcctttaagaatgggttgagtagatagggttcaagagcgacaagatagctgctgagccaattgatgaagtatcctccaacgacttgggatgaaatccataatacctattgtgctgtagtccgagcatatgatgacgacatcaatggaccaactcgatgactcatcttgatacaaactgaacctaggaaagaataaagagataacatgaggagggattttccaagcaccgcgtccggcgaacgttggaaatcagacctgccttcggggctgcgggagatgatatcctccaccgagggaaaagtttcattctttatggtggtagctgcattctccccttgattagggaacacaaccaccaacggaacaatgtggctcccttcatcaacatcagatgatacatttgacatctttatgagaaagtaaagacggatactggaaagagagtttaggatgcgaaagaaggaaacaatgcataaaatagaggttccaaaaggatgttttaagtctcaaagtttggaagaataaaagattcaaattcaggtttggccatccctacatatagagattgaggcaccgattccgaaatggttgtcataatgggcaccaaatctgaaatggctcatcataattgacaccggaactaaaaccacagatccaatcaaagtgctagcttgagtaagtttgttttgatgattgacaaaggaacacatgcatgaatcaggtccaaggacagtgtacacatgtgatggattaaataaagcaaaaggcttgcacttgaaagagataagtataagtggttatatctaatattccttgaacgaaaaggttgcatatttgataaggagcaggactccttacttgaagagaactctatccaagataagagaagaattataagttgaagttgactagaactcttttaccaaggaagagtaaagtattagaactctagttaatctttatttactaattctataaatattagtgttgttttcttttacaggtgatacacacatacttaagtaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaaattgagagcaaaatagcaaggcattttgtgagcaattcctgtgagatttatgagtgcgatcttgatgttacacgaaccagattgaagaaccagctccataaagagttttatgtgtctttctttatttctagttcaaagtgtagtaggcgttttaagttatacctttcagttttctaagaagcaaattatactaggtacctgagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagggttagagttaatccttaggtttgcaagagtttgtaaactttgtggttggctcagagttgtggtgaagtgtttggagaaaatcctactgggtagtaaatcgtggttattactccccgcagtattatgtcgatattaggacctgtaatattatatgaagacgatgttacaccctttagtattatacatgaaattatcataagataattgacctcagtttaaggacaagattctttggtgattataagcattaagctatttcaaacaagtgatggataaatttgtgaagatgagagggcaagcaaatcgaagaaaataaattttcgtcaaagtttgatattttggaataaaatacgggccgagctaaaataaccggtacttatggattaataccatctaagttaccatatgaccgtgatagtaaggtgcataaggtgtgttaaaagtgagtatcaatctaagtaatttgagataaatcttaattatgtggattattggttaatggggagaatttgcaagttaattaaaattagtgggtaattaattattaatcttgggataagacttagacccctcccccccccccaacttggtaagccttctttatctatctaatgactattactgaaggtggaaaggtgtcacactttgagaaaggaaagtgacaccaagcttggaatgtggggcctacccaaaaattaaagataacattcataattgaacaatattttctaatctcttaagaagaattttagccaaactttccattacataacgttaattctaaatatcttgagaaagagtttcaacaaaaataattttgcaatagcaacgttttggctttgagcatttcatacggattgtttcctattttgatctcgccattacgtgtttctttacaatcaacgtgtgttggaggaattgtcaatagaatcagataaggtatgttaaagctaagcccttccttcattttgacatgatctcattattacatatggttgataaagaggcataaagagaagttcatgctcccgaatttatatacattatcctagtctcataagttacagtattctaccttattgggacttcatattctattgagtattgtctttttccagtcaagagagtagagagcctatagatacagtattacagtattttcattatcgttgagttataatgtcacgatcccagttctccctccgtgaactatcgtgacggcacctagtctctatgactaggtaagcctaacaaatgtagaaaagaaacaattgtggaaagaaaataattaaaaaccgagataacaaagtgaaacagtgtttaaggtgccgttcggcatataacagtacaagaatctcaacctaacactcccaaaatctagaaccccatgaatcacaagctaagagattacataaaaagctctaagtccagaaatgtctatcaacaaggaaaatacagaagggctatactagtactgagaatagaaagggactcttcggtctgcggacacagcagatataccttggagtgtctacaacagcacctcgcctaaagtgtgataagactgagtggaaatacctggatctgcacatgaaaaacatgcgcagaaagggcatgcgtacaccataacggtactcagtaagtgccaagcctaacctcgatcgggtagtgacgaggaaagtcaaggccctattgagattaaatgaaatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatgacagtatagaataagacagtaaaaattaagtgcaacagtaagaaataacataaaatagaaagaacaacaacaactataacagagacaaaataatcacgaaaaagagtacaactcaacacagagataacatccagggatctctcagtatcccgaggatctcttagtatcttcaatatgtgtgccagggatctcttagtatcccgaggatctttgagtatcctcaatatgtatgttggggatctctcggtatcccaaggatctcttagtatcctcaatatgtattggggatctcttggtatcccgcactacagtccaaatcgatatatatgtgtaggggatctcccgggataccgtcctgtagtcctaaagtaaacacgcagtaacaacacgaagaatactcaattaaattcaatttcacaccaaggtaacaagtatttctaacataacatgcttcacatagtccaaataaggcagtttgagaaaataaaaacaattaaggcaattagacatgattctctaagctaacagcatgcttgattgcaagtagaataaacaagaagggaaaacacaattaaagttacttagtgaaaacaagattttcaacgattagcacaagtacgcactcttcacctcacgtgcaaggaatttcaaatatcaataataccaaatattaaggggagttccccccccccccacaaagttaggcaagccacttacctcgaacaagctcaaaatcaacccgaaaccaggttcttgccacaagtacttgactccaaatggcccaaatctattcaattcaattgcataatataaataagacttcaaataactgattttataaacaaattctaagctaatatgcaaaattagataaaatgaccaaaacgccccctcgggctcacatctcggaatcggataaaaattttattttcagaatcctcatactctcacgagtctaaccataccaaaacttgaaatttatgtctaagaactttctccaaattttcccccaattttcatcccaaatccgaaattaaatgacaaatctaagattagattataggaatacaactagaaagggattaggaatcgttacccacttatttcttcttcaaaatcctctgaaaatcgccatctcccaagatccaaatcggtgtcccaacttttgaaactaaacccttgaaattcttattttctgcctagtaaatccgcatgtgtagtcaaaattcccgcttctgcgctaccgcttctacgattgagggaactgcttctgctgttttcactaaaacctccatctccgcacttgcgacccatattccgtatctgcggtcccgcaggtatggtaacccttccgcttctgcggtatctgctgccttcacttgtggccacatctgcgtctctatgctctcttcttcgagtccacacctgcggtcccctagtcgcaggtgcggttatgacagcaatggaaaaacttcagctgccaaaccaaactaaaaaaccccccgttaaccatctgaaaccaccccgaggcccccgggacttcaaccaaaagcacgaacaagttatataccactatccaaacttatacaaaacttcaaaacacctcaaacaacatcgaatcaaccaattaaccatagattcaagcctaagaacttcagaaactctcaatttatgcttttgatcaaaaactctatcaaacctcgtccgaatgacctgaaattctacacacacgtcacatccaacactatggagctactccaacttccgaaatttcattccgaccatgatatcaaaatctcactatcaaaccgaaaacttcaaaaattcaacattcggcatttcaagcctaatgaggctacggacctccaaaacataatccgaacacgcccctaagtcctaaatcactcaacggagctaacggaaccaatgaaattctattctgaggccgtctacacactgatctgactacgatctaatttctagaacttaaactctcatttagggattaagtgtcctaaaaatacttcgaaactcaaaaccaaacatcccgacaaataaaaatagatgaaaacacggtgaaagcagttaatatgggagcgggcgttaattctcaatacgactagccgggttattacatataatcggtggacagacctctattgggcaacctctaatcagatggtaagttatataccgatcctactgcggctgagcggctatgagcgagcctagttggccgagatacagatcctagtatggttgagcacctatgagcgagcctactacggcagagcagctatatatatgccaaaccttataaggtcggatagctattttacttactatattgagagagttgagccagtatcagcaggtgagcatatcttcagattatctttgactcccagttactttaagttattatattatcaattcagtttcagctttcataatattgccttacatactcggtacattatttcgtactgacgtcccttttttgggagcactgcatttcatgcgtgcaggttcaaacagacagagaggtagacatccccattaggtgttgcccaagtttaacttgatcggtaagctccatgccctttagagttgtcgggtctagagctttacgtacatcttgtgtatatatgtatatatgttatgagtagctcggggccctattatgatcatagtatatccatcagtagaggcctgtacatatatcctgtcagttagtgtggtatattgggcttgtaggccttgtatgtatattttgattggttttccagctgtagtagttatgatagttttgtcggcccaacattatgttgatgtttagttagcatttgcaaattgtcttgcaatgtggcccatggccaaagtatgacattatatgttcaaagtcccttagtcgcaagtttgtacacaaggataggtgaggcacctcgccccccaggttcggggtgtgaccgaagtggtatcaaagcagttctgtcctatggagtctacaagccatgtctagtagagtcttgtgtttgtttgtgtaggtccactgaactatacagtacctggtcctctacaagattctgctgagaatgctaataaaatagtatgtaaatgaggtagaggatttttacgtgaaaaaatcccacacatggagatcaaaaaaactacgacttacacatgtaggcttttaacttcactaacttgtaatctacctattataagccactttacaataattcctgttgtaaaggatttactcaaataacttgtggtactcttaccacaaatcactttgtgacttcctagtaacaaagtctttttctaacttgtgatgctctcaccacaagccactttgtaactctacaattacaatgacttttccttataactaaatctagtcacaacataaactcaaggagtttatggattttcaagaggattcctaatcaaatgcttctaggtaagcagtttaggagataaaataagtatagtaacaaggttacaactcaactaggacaacaacaagctatcttttaggaaatggtccgtagttgcgttcaaccttattcttcaagcttgtaaggattgatttctctatttttgcaagaggcttgaatgagaaacagaaaccttccagtgttgttttgtataaacctcattgtgggtacatcttgatcacatcacttgaaatgatgtgagtactttgttttgttagagaatgagtgggaggacagtgcagtacggcagaaacagtgacgccagtcacttcatttctagttgtgtccaattgactctgtacagctatgacgaaaccacaagagcatcaggtccttgtgtgggtttctagctcctgaagctgtagcagttcacctttagctggaatacgttaaagcttgcagcaatccaagtaggtcaggttccctatctagttcttaacagtaagtttgttagattatcaaaacataaggcaagagtatttaaaatatatcaatttcccctttttgatgatgacaaacttaacatttataaactggaattagggcagtaccagttttaaagtatcagggaacacagagagttccccctaagactatgccttatcttttacatgatcagagtagtaagaactagttcctccatgtgtgttccccctgattattatttttttccttcttttggcatcattaaaaaaataacagcacaaagaagtccagtgaagctaactcatgccacatatgtgcacacaatcatgatagagaatagaacacatagagtactgacataataaaactagaattaatattaataacgatttaatatacctctgcctatgaaaaaggctagaggcaacatttggacttgctaacgggagtagtaatgtttcctcccaaccatcaaaaaaagaaaacaaaaaaacatccgccaaaccatcaacaatgaaacaaaaacataagaaacatatccagaaaactggtcactaaaggggtactttagggcactaggagtaaaaggattggtagcagcagaaaatgcctggagaacgaggtctattaaggtgtttgccgacttttgctcgttgagcagttccgccttcaagttctcaacttgcgccctgagattagcattctcctgtgtcaaacaagccacttcatcattcgacatgggaaccccttgggcttgctgatcttccaggataacattcatggccttcaaccgatgaatttcctcagctgcactgttttggacgttgataagctgagaaacggttgatgtatttcctactcctcccccccaatacttttccacacactcacactcttccaaagttgtctatgagaatgtccgctttcgagaccccactttacctattcccagtggaactttaaagaatttgaacactggagtaagaaagaatccatagggaagtccatgattaccgtccttgaaggtggaaaccttttgcatgtgttcgatcataatagcaggaagaatcataggattgaaaccgtcaagttgctccattaggaataggtcagacttagaagtcactaacctcctttcggctcgaggcaacatgactttgttaaccaatttaaataacaactggtaaacagggagtagtgctttcttatggatctagtcccctttctgattagcattttctttcaccattgcatttctgaagttatactgacaaacatctcgtacactcaacaccctaactgtaggaacttttaaaatctctccaagcaattttacatcaaacacgatgtccaccccattgaccaaagcatagacatggtcagtatcaactggaaagaggctagcaaagaaactttgtacctcctcctcatacaccttaggtgcatccatgtgaaatagatgcacccaacgttgaaactcgaccatttccagaatttggcgcattccagccatatcagagattgttgggtcaaacatacgacccaatagaactttttgatgcctcaaaagctcagagccaaggctgacttcacttctcattttcttcatagaactaggttcgtcaaaagattccgacttgcgtttcccaaacttctctccactgactttgccttttgccttagacttaactagtacatcctcatcagacatagaaaactcactcactacctccttctttttggacttagatgttgaccctttctctattgacacaggctttgtctttttcaaagatcgcctaacaagtgaaccgggttcctctggagttccctcttccacctcgactacaaggatagcctcatcacttacaggtacaccatccttcaccaacttttttctttttttttcttactactcttcttgctcgtttggagagtagagtcgtaggccactttgacttgaagcgtggtagtaggtcgtttgatttcagactcaagggtggacgcaacccttcgcttacttatgaatgcatcaagagccacattatccaggtcttattcatcactagatcgtatttcaggtgcttgaattcccaggggcacaacatcaaatgcaggaatagtactgtcctagggatgagagccctaacctgggtcctccggagagggatcaggttcctcatgtgatgccccagtagtatctgctattgcatacccttcaatagccacaatggccccttattcctccacatcgtgtatctcatttttttgggatgtaatttcatgcaataccccatcagtggatactacaaacatagttacaacatctttcttttcttcaaccggtgcttccaaaaccatgaaatcggtggcaacgatttcagaacccttgtgaactcagtattttgaccttgttctccacttagggtttgattggtgggaacaacagacgatggggagaacaaaatagtagttttaaaggtttctgagttgggaagatattgggaaattggggaaggtgtgactgcagcagcaagagtggtagagggtgaggaaggctcagtcaaaatgaaaggttccatatatgggtcagtggtgtagaacctgctcatctccatagaggcaaagagatcggaagttttttcagccattgaaagaagtggtgttaggatccttcccttttgggtgattctagtgtaggacttatggttaagaagagcagaagagaggggttttaaaaggagaggataattataaagggaaaggaataagcacttgttctgaaacggtggttgggcatggagaattgcaatgtttcagagggagatggaacattttgaattgaaaggacgtgacagcaagatctaaaaagttgatgacatggcagttgtattttgtacccttagacgtgtattaaaaggatgcatagaactactaacctttagtacaagaacctagttcttgaaaaaaaattcttctctttttttttgttttgaaagaaatcaatcctctttcatcaatcttgcattgcatctatttcctctatgctcatcatgtgtgtttacctgcaacggtattgaagtgagttagacatggccagaaaacactttgagccagttatttcttaaggataggtgccaaccaaagaggaaacaggttcttaatttggcttcaacagtcccagctttactatgtttctttcaaactgttccctacttagtgccttggtgaaaatgtctacaatttgatcttttgtgctacataacttcatacatatcaaccctttctccacgttatctctcagaaaatgatgcctcacatcaatatgttttgtccttttatgttgaactagattcttggccatatcgagtgcactggtgttgtcacatagaaggggcacactctcagtgagtaccccaaaatcctccagttgctttttgatccatagaagttgagcacaacaggatgctgtagctacatattcagcttcagctgttgacagagccactgaattctacttccttgttccccaagagataagacatgaacctaagaagtgagccattccagaagtgctttttctgtccacaagataacctgcatagtttgcatcacaagataacctctatacattgtttgattcagaggagatccagtttcatccatgtctagtcgagtggcagttgcaatgggagtgtctatcacctttgatgcttccatgttaaacctctttaagagttccctgatgtatttttgctgacaaatagaagtaccgtttggggactgttttactcgaagacccaagaagaggtttaattctcccatcatgctcatttcaaattcacttcccataagttttgcaaattcttcacatagagagtcagttgttgctccaaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaacgatgagcaggttccttcctcgtttttttaagaaaatagtgttgtcaatttttcctcttttaaaaccattttctaagaggaactttgacagtctttcataccaagctcgaggagcctgctttagcccatacaaagctttgtccagtttgaacacatattcagggtgctcgtgacattcaaaccctaagggttgcttcacatagacttcatccttaaggagttcattcaaaaatgcactcttgatatctatttggaacaaggtgaatattgtatgagatgcaaaagcgattagaattctgataaatcccatgcgagccactggagaaaacgttttatcatattcaaccccttcctcttgattgtagccttggactactagcctggccttgttccttgtggtaactccatgttcatcgagcttgtttctgaatacccacctggttcctataatggtttgatctggggttctaggtaccaggtgctacacattgtttctctcaaactaatgcaactcgtcttgcatggctgtaatccaatctgcatctttcaaggtttccttgatatttttgggttctatctgggagagaaaggctgagaaggcaagtaaattttggctcttgatctggtttgtactccagaatctagaggagtgatgatgttatctatagggtgagagctttggtgtctccagttagacgcccaaggttcattctgagaggaggaaggtatgtttggctgattttcctctatccttctctcagatgctagaggagttccctaaactgcatcaaccacccttttttcagcttcagtggttgtaattgaagtgcttggttctgcttatgatgaggcagcgttgtcttcatttggctcctttacttgactcatcatatctactttttcgtttgtcatgttaatgccttcaccaggaacaagtaagggttctccatcttgatctttctcagcactcttctcaaatgatggatatgattcatcaaaaataacatggatactttcctcaacacattgagtccgcttgttatatattttgtaagccttgctttgagaggagtaaccaagaaatattccttcgtcacttttggcatcgaatttaccaagatgatattttccattgttgagaacataacatttgcatccaaatgttcttaggtgaatcagcttgggttttcttccattcaacaattcatatggggtcttgtttagaagtgatctgatcacgcacctattcactaagtagcaggcagtgttgacagcttcagcctagaagttctttgcaattccactgtcaaatcagcattgttcttgccattttttctagagttatgttctttctttatactactccattttgctggagagttttgggagctgagaagttgtgagtgatgccattttcattacagaattcatcaaatttgacattgtcaaattctgtcccatgatctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcttcacaaaagctacaaacacttcaataatttcgtcttttgttctgagaaacagagtccatgtgaatctggaatagtcattcatgattacaaaaatgtatctttgtcctcctctgctttgcagcctcataggtccacacagatccatatgtagaagctcaagcggctttgaggtgctcacatctcttatagacttaaaggatgacttcacatgttttcctctagcacagacatcacagactttctgcatcttaattagtgacaaaggcagaccacaaaccaggtccttctgaattagtttattcagaaaggaaaagcttgcatggcctagtcttatgtgccatagttcatcatcatcatcaacaactttcagacaactcagatcaccactctataaatattcaaagttagcaacatagatgttcttgtatcttttggccaccagtactatttcatcgatcacaaggtcagtgactgtacatattttggacaagaattccatcttgtttcctttatcacagatttgtgaaacactcaggagaccatacttaagtccattgacatagtacacattttcaataggatgagtgagtgacgtcccaactttttcaactccaagaatgtaccctttttaccattgccaaaggatacactccctcattgtagggattttagtgaaagaaagtttgtggtattcctagtcatgtgtttcgaacacccactatccatgaactattgacggccgcctcctttcaccgttccctgcataagagattaggagttagttttaggaacccaaacaagcttgggtcccttgtagtaagcaagaggatgaataagagctctcttagtccatgcagttaatgtgtgtttttttgtaagtggaacctggtccctcttttatggtcacggtttcaacagccactttgtctttctgaactgattgattcttggcctggacacctttcttgaagcgcccagtgttcccacattgggtacgaggctagttatcagagatagtgacatacttactgtgagggttgtgacgcattttctccctttggaaccctgcattcagccttttttcacaatcattattaagtaaggcagtggtagcttctaaggaccgggttcactttaaagacttttcaagatcattcattactctttctagattggtttggagaagctcatttttctcaatttcagcacacatcctaaatcttatagctttcacctcatcttcaagcttaatgtattcctcacttgctatctcctttcctctttcagaactttcaagttttgacttagtccatggttttactattgtttccctttggtatgcaatttttgccaacatatcactcttttcttttctaaggatttcaatggttttcttatggtcagtaactgcagccactaagtcttctatactatgttaagattcttctaattctaagatcaaagaatccctatcctccgcaagactacaaaaggcagtgattaaaacaacacctaaacacatgcgtttttttagagaatagaatttcagatttctcttaacatccctgaagtttacctctttgttgccattgtcttcatcatcatctgattgagccatcaaagcaaaagttgagtcatatccaatctcctcgccttcaactaccatcatggaactaccaccagtattaggtttatcttcagactgttttacttgtgtagttccctcatgagttgtttgcaaagcttcccatatttcttttgcagtgtcactggtagagattctattgtactcttcaggtcccattccatatactagaattttcttggcacaaaaattcttctccaccgctttcttgtctgcttcagtgtattctttgctggtttttgccattgaaaatggaaattcatctagtaacttgattggaacttaaggaccgccgcaaattatatcccatagctcacaatcctcagtcataatgaaatcatgcattctagctttccaccaccaataacattgtccattaaactttgggggtttgtatatggaatgaccttcttcaaaatttggtggagttgccatgaggatccttcctaggtgttagcctaatatgaggaacctgctctgataccaattgttagtttgtatgggtccaccaaactatagagtacctggccctctacaagattctactgagaatgctaacaaaacagtatgtaaatgaggcagagtatttttacgtggaaaaatcccacacaaggggataaaaaaactacgacctatacatgtaggcttttaacttcactaacttgtaatctacctattacaagccactttacaataattcctattgcaaaggatttactcaactaacttgtggtactcttaccacaagccactttgtgacttcctagttacaaaggctttttctaacttgtgatgctctcaccataagccactttgtaactctacaattacaaagacttttccttatggctaaatctaatcacaacataaatttaaggagtttacggattttcaagaggattcctaatcaaacgcttctaggtaagtagtttaggagatacaataagtataataacaaggttacaactcaacaaggacaacaacaggctatcttttaggaactggtccatagttgcgttcaaccttgttcttcaagcttgtgagtattgatttctctatttttgcaagaggcttgaataagaaacagaaaccttccaatgatgttttgtataaagctcattgtgggtacatcttgattacatcacttgaaatgatgtgagtactttgtttggttagagaatgagtgggaggacagtgtagtgtggcaaaaatagtgtcgtcagtcacttcatttccagctatgtccaattgactctgtactgctatgaggaaaccacaagagcatcaggtccttgtgtgggttcctagctcctcaagctgtagcagttcacctctagctggagtctattaaagcttgcagcagtctaagtaggtcaggttccctatctagttcttaacagtaagtttgttagatcatcaaaacataaggcaagaatatttaaaatctatcatcttgtttatgggtgtgttgttcaccacacttataagcaggaggcgacgcatttaggactgtcactctttcttcttactctagatcatgttgtagagcttatttgtaagaattcaaactattaaactctattttattcataataaaacgatacctacatctaaaaatattgttggtaagagatatgtctatggaagagttgcgccagtagaccttgactttgtatcatgtttatgataagtaaatgtgaggtcttcagcagatcatgtgtatactgaaaggtgtaagcttcttgataatgatccctaaggaaagaacatctatccactcttatggtaaaaagcaatgaaagaatcagaagatacaagtttcaacaaataaaagaagcaacgtgaacaagggtacaaggtacctaattagtaaagatgagcattatctacaatttaggaagagaaatataagcatttagagtcaccttcaacaataacaaaggtatgtacaattggccacactcatcttatttatgccctatgagggctaacaaaagaagtataagagagggaaggatattaggattcgactagggttagagcaacccaaaatggtggatagaatgtttgtgtttattcacatttttgaaggatattgcaaatgtgctaatagatctccttgtgagatacctaggtggtgtactctaaaatagtgaagctagatttgtgtactataaagataggcactggaagccttgaagggataaatattaccttagcatggctcccgtccctagtagataaagaatgttacgtaactcgaagagtcagtggatggagcaaggggagctaaaagcaaatgaatatcttgttgaagtatttaaaataaagtgatagacataaatgttagcgggaaataagaagagagataatgaagcattatgagtaagaagtgatacatggatgacaacggtagagtattactgaatctatggtcaaaggaaggaaaagacgaaaggtgacagaccttgatgcaacaaaagagtataagtcataaagtcacatcctcatttcgagaaataaattcgtgaccctaacgtgaataccagaaggaaaagttagaccccaaagtagcagaaatcagtatggattggtgaacaagctaaaataaacatgaattagggactgagtggtttgataatgttcaacatcatgagaatttcatattgcgttctggcgataatagaatggacaacaaacatagattcatgagaaatttagggaatgttcattcaggaagacgcttccttaaagcaagaaatgtgagaaaagttaagcttaagggactgtatgtgccagttacactaagtgtcaccctcgtgaataaggaatttcgttatccttggtacagaaaggatttttgcaagacgagtaagggtcatcgatgatgtgaaaagaagccaaagataaagaggtaaagcatctatacgtagatcttcgtagcactcaacttagcaccttcgtaaagggggaatatggagtaatgtgacattaagtcagaattaagtggttctagtaattatagaatggtaaagaagaatacgacaaaaaaagagggatgagattgcacttattcaaatgctatagataagctacgattctagaacattatgcaaacacgaaatcaaggaggggaagtgagggttcctgcctgagatgttattgacaaataaggagccagtacgagacttaagttaagaaaaaggaaataacccaagaaagattacgcgggatgttaatatgagagtgggctaatgattagtttgtagttgattcaggaagagcctagttatggctagaaaagaggacacagactaatcaataggtagtgcaagataaacatagtaaaccccaacatgcggaattcagtctcgtagatatgacatcatgatccttgagaaatattcagataggagttggggcagttaaaggtaccatatgagtgttactgaaataaaagagaatgccactgggaagacagtcaaaatattagttcagaagcaaccctacaagtacaagggcgtgaaggtaagtaactaaggataattataggtgagtacgaacataaaaaattctgtcgggtaaacgatataaccagcttgtaactttacaagagccaaaaggtccccctaagtactacaatgaaaaactagctgaggaaataaggaagaaggcttcaacctaagaacattgacctaaagagaaaatggtcatgtaacaacagtctcacaactacattatatgcacttcataataaaatggcacctaccgtgggtaatgaacgggaagtaaaattagaagtgatattcaagaccatatgagttttatggaatttcagtatatgtgggaactaagataagctaaatatgcacgcaaaaaggggacagaaagaccattaaaagaatttgcttacgtttgaagaaagctgagatggaacaaaaagaattattcgattaatgctccagagttagttacgttatgaacgcatttaagagttcggagtattatccacttagcatatatgttgacaatcatacagtcgtagaagattttggtataagttaaaagaaaggattgagtccaggtcatcgacaaaggatttaattgttagaagattgtatcctggatcttacatagcgtccatgagaggctaaactaataccatgagccgcagatcgaaagatagcttaagcctgcataaaggatgatcacatggaagaggaaactaaagaattatatcaactaagtaaatcaggagcctgattattggacctagaaagttattgacatcatgatggagaacattgcataatcactcttaatatcagaggtacaagagagatagtataatatctatattctataatggctctacgataaagctagttagaagagtacaagccttataagatgtcagtatgaagctcccaccgtattatgtatgcaccaaaggtgcaagtgttataatgagagattcaagttgtggatgtgaattgtacctatatggaaaggaggtcatgaaagagatagaagatatgatgcgagattttaaggcaaaagtaaacaacgtatgagatactcaaatgcagaaggttgtgaatagtccatactgtagatagaaggctagaagcgctggtatttagtacccaggaatgatagagtcgtcgttagtggcatatattccgtcttatggtttctagatatcgagaggtctagttaagggtgtaaaagaagagttatagacgatgtgatatctagcttgatgttccagaataataaaagaaaatgggtgcaagcaaggttgtgagcaatataaatggatatatgtaggtctcaagataaaatatgataaagcgacaaggttttaggaagacaagagcaaggacaagaaagggtgagtgagaaggtaatgagaaatagatgagtcctcggaattaagcccatgaaaacaagatagctgatggcttctctaagttatagaaagctctgtatagcttgaatggactcaaaggaatctacgactagtagcatttagaaaagatggaatgctaaataattgtgatagataaaggataacatttgtgccttcgaccgagtaatgatttgaagaggatttcatggattttacggaattaaattaccaacgtaaagtgaatcacattggaatgctataaaatacgattattgaagtacaatatcacccctaagtggatcaggaaaatcacttctaatattcctcgatgcagcataagctctagtggtaatgtattatgtaaaaagtttcaagttatcaacggaagattgtagatcaacattgaggtgaatcgataatggatgaacaaaagatacaaagtacgagatgagattaggccatcagacttaagatggatagtaatgaagaagtgttaaaaggcttagctttatgcatataggataagcaatgagagtaacctggagtttggtcgcaggcctcagtaacaataaatcgaagtaagagttatggtatagtatggcctacttagatatagtaaagctaacgattcccagagggacagcttggcatagttttgtatatgttcacaaagtgaggcctagagatcggctaagagctggaggaaataggagagaagcattgcataggcgcacataaagagttagagtcgtacaggcttcatgatagaaggtagcaatagttacgagattagaaggattccgactacatgtcatggtgtgaaaaagatgcttaaaggggggaatgccctagcctttggatttattcaaagaacaattgcctaaatggaaaggagaatattaaagtattcataagggctatgggttatgagaacgataagtgcattagccaacattcgaggacgaatgttccaagggggggggggatgatgttatgccctacagtattacgtcgatattataccctacaatattatacatgaaattgtcataagataactgaactcagttcaaggacaagattgtttagagattataagcattatgctatttcaagcaagtgatggataagttcgtgaagatgagagggtaagcaaatcaaagaaaataaattttcgtcgaagtttgacattttgggataaaatacaggcgagctaaaatacccggtacttatagactagtaccacacaaggtaccacatgaccatgatagtaaggtgtataaggtatgttaaaagtgagtagtattctaagtaatttgatataattcttaattatgtagattattggttaaagattgaattagcaagttaattaaaattagtgggtaattaattaataaccttgcgataagacttagacccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagcttggaatgtggggcctacccaaaaaattaaagataacattcataattcaacaatattttctaatctcttaagaagaatttcacccaagctttccattacataatgttaattctaaatctcttgagaaagagtttcaacaaagatgactttgcaatagcaacattattgctttgagcatttcatacggattgttccatatttcgatcttgtcgttacgtgtttcatcgtaatcaacacgtgttggagggcttgtcaatagaatcggataaggtatgttaaggataagtccgtccttcctttggcatgatctcgtaattacatatggttgataaagaggcatcaagagaagttcatgatcccgaatttatatacattatcctagtcttataagttacagtactctaccttatcgggacttcatatttaattgagtattgtctttttctagtcaagagagcatagagcctatagatacagtattacagtattttcattaccatcgatctataatcgatgggcaggcccctattgggcaacctctaatcacatggtaagttatataccaagcctactgcggcggagcgcctatgagcgagcccagttggccgagatacagagcctagtatggttgagagcgtatgagcgagcctactccggcagagcagttatatatatactgagccttagaaggccagacaactattttgcttactatattgagagagttgagtctgtatcaatagatgagcatatcttcagattatctttgactcccagttactttaagttattatattattagttgaatttcagattacagtatattgccttaaatacttggtatattattttgcactgacgtcccttttctgggggcactgcatttcatgcgtgcaggtttagacaaacagagaggtagacctcctcattaggtattgcccaattttagcttgatcggtaagctctatgccctttgtagttgccgggtctaaagctttacgtacatcttgtgtatacatatatatatgttatgagtaggtcggggccctaatccgatcatagtacatccattagtagaggcttgtagacatatcttgtcagttagtgcagtttattagacttgtaggccttgtatgtatattttgattggtttgccaactgtagtagttatgatggccttgtcggccagctttatattgatgtttagtcagcatttgcaaattgtcctgaagtgtggcccatggacaaagtatgacgttatatgttcagagtcccttagtcacaagtttgtacgcaaggatagtaaggcatcgggtgccggtatctccccccaggttcagggcgtgacaataggtttttcaccttttgagctgggtgtttttcacgtaaaaatacttgttttcttcactttctgcatttattgttccacaacagtagcataaggaacacatacaagaaccgggttctcctataatctgtgcatgcaaaaaattggataccacataaatccccccccccctcttgtgtggtatggaagtataaaataataattgatatcagagcgggttatccttgatgaggctaacaccttaggaaagatcaagatgagtgcactacctgaaaactataaagagcaatccaccactaggccagtactattcaatgatcgctattatttttttgtggaaggagagaagaagagttcacttgcagatgactgatggatgctccaaatatggtataaagaactacatgatcaagaactttcctatgtgaaaagtcgggtggaaaaaggagaaatctgaaagaaggaaccaaaagaaggaacacgttcatgacaagaagaactacatcaaaaggtcatccaaagcaatggttactacttggaaagatagttcagatgaagacactaatgataatgctgaacgagctctcatagcaattcaagaatctgaagatgaacctgatcaagaatatgagataagttttctagaccttaaggataaaattaaactcctttctaaagatagactattagaattgttgctaactttaattgatgaatccatgaatattgaaaaagaacagttgtcaaaagagtgtaactttttaaaagcaaaatgcaaaaacctggaaataaacatttgtaaaactaaaaaggaaaataatactttgaagaaccaggttcatgcacttgatacatctgtcttagaacttagatctgagaatctaaaattgaagttaggaacaggtaaagaaatagctagtgacacataactctcactagaaaaggatctaggaaaggtaaaagatgagctttataaaagagatgaactggtaagaaccctgaaggaggacttgactaaggttaagcatgagttagatagaacatgtaaaaggaacgtgtcctctgatgaactttcatgggtacaaaaataccatagtagcaacagaaagggacttggctttggaaattctgcacctaaatgggatcccaaaaataagcacctaacattccctgagaataagatttgcacacactgtgaaaacactggtcaagttgggcttaaaataaaaggaaggtcaaaagaataaaaaaattgttctaggaaaaataggctgccaaattgggctaaaaagaacttaatttttccttttgcctatagaaagggacccaaactagcttgggttcctaagactaacctctaatttttttttgcaggtccaagtgggagagagcaaccaaaagtgatatatgataaaaggttgatcaaaacacataataggaaataataaaaggttcctttcacttttggcctttaaatgaggtaatgtctcctttgaaaatggaaatcaaggtaaaatcattggagttggaaagtcttgcagggaagaagagtgatcaatatatatatagtggatctatccacactttccgataatgaactcacttgcttgagtgtcctggacagtgatcccctcatttggcataagaaacttggacatgctagtctaacaactcaacaaactagtctccaaggacttggtgatagggttgcctaacattaagttcgaggaagataaagtttgtgaggcttgtgcaagggggaagcaggtaagatcttctttaaaaagcaagaaaatggtaagcaccaccagaacgatagaactggtccatatggatctttgtggaccaatgagaacattgaccagatatggtaagagatatgttatggtgcttgttgatgattactctcggtttacttggacactgttttttaatatctagagatgaagcatttgacatgatcacttcatttgttagaaaaacttagaaagaactaggtaattaacttgcatcaattaggtctggacatggtactgaatttgagaatgttaaatttgttgaattgtgcgatgagcatggcataggtcataacttttctgcccctaggactccacatcaaaatggagtagttgaaagaaaaataggaattagaggaaatggctaggactatgctacttgctagtaaattgcctcaaagcttctcgacggacgctgtgaacactgcatggtacatcataaatagttgcatgactagacctcttgttaagaagattccctatgagtcacttaaagagagaaagataaatatatcccatcttagggcatttagatgcaggtactttgttcttaataatgaaaaagattccctaagaatgtttgatcccagaagtgatgagggagtattcttgggatattcttcacatagtaaagcttataagatatacgataaaagaactatgtgtgtagaaaaaagtgtatctgttatttttttttaaaactaatattctttctaagaggcaggaacaagataatgaagagattgggctaataaaaaattcaaatagtgaaaccacagtccatcctgaagatgcatcacatgaaggaataggtgatggaataggtcattccacccatggcaacatgacagggagaactaactagagaggaactgatcctcaaacctcgagggaacctgtccatgaacctattcctcagtaacaaaaccaggaaggaacatccaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacatccatgaatttggatataaatgaacctagttcatctattgatcaaaagttttataggtaaatgattggttctctattatatctcactactagcagacctgatattcttttcagtataggactttgtgattgatttctggcaaatccaaaggagtcgcacttgactgatgttaagaggatcttgagatacttgaaaggcactactggcctttgtcttcggtatccagaagatagtaacttcaacatagtgggatatgttgatgctaattatgcaagttttcttatgtatagaaagagaaacctaggtatgtcatactttcttggctcatgtcttgtgtcttggactaccaaaaagaaaaattttgtggccttatctactgctgaagttaagtatgttgttgctgcctcatgttgtgctcaattgttacggatcaaacaacaattaatggattttggaatttatgaaggttgtatccctatattctgtgataacactagtgcaattagtatgaccaagaacctggttcatcaaaagggaactaagcatatagatgttaggcaatacattttgaggggcaactatgagaagggtttgatcactatagaattttgtgctactgacaagaaaatagctggcatcttcacaaaagctgtaagtatagatcactttgaaagaaacaagttaatattagggatgattaagatcacctaaaaggaaccagttctaactcaaaaatttgttagaaaattgtgaatttttgtacataattagattagattttgctcagtctcatactaccataagtatactcttgtgccatatgataacatgactcattaatatatataatgatattatctctattttcttggaaaattcatactcacacaagagatttttcagtgaagaacctagttcatcaagattatttggtacgtattctccattctgcatagtttgaaataattatattggatcatgattaagagaagagtcacattcaatctcaaaacccattgtacgtatccattataaaaatggaccagtttcgttcaaaagaggagtccaaaccgcattaagtgcctagattctagggaacctctctaacatcttttcaaaacagaaatgcagtttgattagacctctgaaaaggctgtcatcactcaattgaactcctccactttatattgataaggctttacttgtttcttgacttctaaatcttcaagccgtcaaaattctctccaacttctctcatcttccaaacacgctcaaacctccttttctttctccctagcgtagaaatggctaacacctttgataatccctaatcaccaccaaaggaaacctcaccctcaccatctgatacacattcaactactcccatctctaagaaataaagggtaaaaatgatggctcgtaaggttgttgctggtggagaggaaatcaagaaaataaatgaaaaattgaaagcaagtaaggaagaagaacccaaaaatccgatgagtcattcaagtctacaactgagggggaagaaatggtttcttttgagtctaaacatgtaacgtctggccccaaagttaatcctgaaactatttctaaggttgctacaaatttagagaataggtttgttctagtaggatcgatagcagtattgaaattactgagtctggaaaggtgggtggtaaaaataaaagagaaaagaaaaagagagagagggtgattgaaatactgtgagggtaatgggaaaaggagtggccgaatcttcacctactcttgttgtccttactaaagaatcaagtgatgtggtagtctggggtgaataatctgatggagaaaagcagagtgtgagagtaacaggggaaagtgggtctagagaagttgttgaggggttggttaggctaagaaaaaatgttgaagaacttgttccatctgaacagaaaaccctcagacctactaaaaagggtgactgacagttacaatcccaagaagaaaggaagttcaggagctaaaactcttggcattgctagggaaaacaagaaaaggaaggctgccccttctgttatttctgttattatcccacaagaggcagagccacaagaagccagaaaaagcagaatgaggcagaactggagaaagccttggaaaaaagtagaagaaaagtagttgctaagggaaagaagaagatgagtgagaccgttgagactgttgatattgatgagatggacctagtccgtcgagatgaagataagacagaagaagtggaggttatgactcctaaaccagagaaagccaagccttccacaaaaaagtctatttcatagtcaaagtttgcagaaccatccactttagcaaagagaaccaggtctgctgtaaaatcaagaaaagtgaaaattgtagaggaagaagaatggagtggggaggaagaagaagatgattctgatattgtgaaagacaagctggccaagtttggcaagagaactaccttgaaaggcagacttctcaggaacttagaggaggaaggaattttgctgcttttggaaaagttacaattacaaggctagaataacatggtccttcagatggatggcaggtttgccagaactaaaattattgagtttatgcccaattgtgaggtaaaagatggaagggtcaccagtacagtgaaaggagtgaaagtcgcttttaatttaaaaggagctgggtgagattttaggtgtaactgttgaagggtacagtgactataagaagctcaagtggccaagcctagaaaatctccctattgcccttgccattaccagaaaattcagtgacaataagagagaaaattgagcccaaggttgtgtaaaagagtgagatgaagccaccccacaaagtgatgttcaaatttgtcaacaaatgtattctgccaaggtaggaaatgaggcacattgcaaacttcatggacttggtcctgatggaatgtttggatagtgggaggcagattaattggcctggatttattatccaacttattgatagggttataaatggcaccaaaactcatgcaattccctatggcttcattctcacaactgtgcttgcacatttcaaggtacctatgaagagtgggaggttagtacaagaaaggatcattttggtgcaaatactctgctttcttgtgactacgaagtccatgccactcctaaagaacttggttcatccaacaaggtaccagtgaatagtaaggtgtgggccttggtacaagaaaatgggctaaggatgctgagattgaaaggctgaagaagaggttggcagaggtggagaatgagagagatgctctcagaattgagctggcaagagaaaaaaagaagaatgatggcattcttcaagaagtgctgaaactcctccaagccaaaaaccaagcacatggtccttcccagccttaagcctcctagcctagtgtagatcaaccagtgacctagctcgggatttcttttgtttcttttgcccatgatccagtgtttatatttctttttatgctttgtagtaggatcttatcaatcaatgaaattcactgccttttgctctaactgtttgttgatatttcttagatgactaatatccttagattgatagatggtgcttaaatccatgattgtatttgaagtagccccagtggccatgagtaatttttattaaaatctggttatctaacataattatgcaacttttcgatgatgccagaagggagaattaggttgtgcttttactttaaactgtgatgtttataacctaatgaaccccgtcgttgataatttatgtctttaaaatggaaagttttccaacagtgtattgatgttgagctgagttaaaacaggtttcatgcttatgaagcacggagtttgtcatcatcaaaaaggggggaatttattagcttgagtaagtttgttttgatgattgacaaaggaacacatgcatataaccaggtccatggacagtgtacacagatgacggacagaatcaaacaaaagacttgcacataaaagggataagtataagtggttatatctgatattccttgaacgaaaatgttgcatacttgataaggaccaggactacttactcgaagagaactctatccaatataagagaagaattataagttgaagttgactagaactcttttaccaaggaagagtaaagcattagaactctagttaatctttatttactaattctataaatattagtgttgttttcttttacaggtgatacacacatacttaagtaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaaattgagagcaaaatagcaaggcattttgtgagcaattcctgtgagatttatgagtgcgatcttgatgctacacgaaccagattgaagaaccagctccataaagagttttatatgtctttctttatttctagttcaaagtgtagtaggcgttttaagttatacctttcagttttctaagaagcaaattatactaggtacctgagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagggttggagttaatccgtaagtttgcaagagtttgtaaactttgttgttggctcagagttatagtgaagtgtttggagaaaatcctattgggtagtaggtcgtgattttttcaccttttgagtcgtgtgttttccatgtaaaaatccttatattctttactttctacatttattattccataatatagtataagcaatacatagaagaacatggttcttttataatacgtgcacgtgaaaaattggacacccctcttgtgtggtattgaagtataaaataacacaaaggttactcgcaaatcgacccaatgcatcgggaacaagcatcgtcataacgtatgacgtcactccctctcttggaccagattgctccaacaaatcacccgggaaatttaagggatttgaaatacgcagcccacagagagccacattgcctgctctctataacgactatgacccatgttatctcttcgacaagcccgaccatgaacgacattatccgctcattgagcgcgcccgcgaagacgacctcaagaagcggaggaactaactgtatgggcaaaaaattatcatagttgtatttagattacgtcaacattaagagggccttcgaaggctatcacgtgtcatcagtgtgacttcaataatagacagattcaaggctgaagtgatttgacaagagatgaagtgctaggtcgaggagtcaacagagatcaaggtcgaggacgtgcagtatccttaaattaagtaataacggccagttttaggataagactttaaagagaatatttcagtgaatattctctcgatctgtattattagggttttgtcacacatgtccccttataaatagaaagagacatagttataggggatattgaacactcatttggaaaacaacaacacctttctttgtgattcttgctttatcacatatatacaaaatacaccttttcttgagatcattgtctagcttttctcttacgatccaaggagaatctgaatattcaaaggcttatcaatcatttatcattgtcaaaaggaatattacacggcttcatctcctttttcgttcatctctgtaacatatatttatataaataccattatacatcatttattgctatcgaatgctattcacttcacatttgtgtcattaagtgttgtattattgcatatttaccactgttaccgtagatctcgtaacactttgttgcggcactagttaaacaatctagtggatattataattggctaagattaaccctaccttattaaaaaaatctaattatttaaacctagatctaaattttgggcaaatattaatactaataaaatacttgcacctccagtaatgagttggattatcatgtgcttcctttattttggtatgatcattcaggcgacaacagcaaaataaaaatacaagtgaaaggtttcgtattttaacaatgttaaaaatgataaacttcttcatcaagtctgaagtctcagagtttggttttcgtgctctttaatttcttgcttctattttaccgacagataggatttaaaaaatatacacatccagtattaattggagttgaagtcttgaagattcctcttctctcttgtattattaccagtcatataaaacgacaagagttgcatatgtatgtatgtagtgttgggagttgacctcgatgctttctttcttgcgaggtgctattcgttgatatatcatcacaaaggacaagacttgctggaaatcatgtgtaactcccgcttttctggtgttatgaataaattaaaaacttagcacatcaaatggttggagaagacttctttgttctcttaggatgcactccctccctcccatttcatatgattgtgattcggagtacaaggatgaagctatctactttttgtgtgaatgtgaacaaagaattttcaaataatttgaaatatcatttacatatttaaaagctacgcaaaataatactataaatcatagtaacaagtaacatttcaaaatatttaatagacatgtgaaaacatgaggtcaaagaaaaactcctttgatatcccatgtgaatgttgagatccacatttatttcttcatgtgtcgcgttccttgaaaaatacattgctataccttctaccaagatcgagtccttggttctactaatttttaggatccgtttggatatagattccccaatatttttgttatgatccgaaattctcaccttcggaagtcgtgatggcgcctactagtagaagctaggcaagccacgaacttagaaatctttaactcttctgttttaatcttttttttttcttttttacaacttatattaacaagtgataaacatctaaatggcagcagaatatgagatttaagtgaaagacttaaataaatataaaaccaaaatgtttcgaaagtcaacacatgcctctacccagaaactggtgtcacaatatccacagactattaagagtactacatacaacggtttgaagcaagaataacattgtttgcctcggatacatgagataacaaaacataataaaagataaaggagacgtcgggcctgcggacgcctgcaaggctacctcgatgtctcggtggactgaaggttggctcccctactgctgctgatcaagtgccgctccggtatctgcacaaagtgcatagtgtagtatcagcacaaccgaccccatgtgctggtaagtgcctggcctaaccccggcgaggtagtgaccaagctaggaccagactccagataaacctgtgcagttatataatatatggcggaaaataaacatgaataagaagtttaaaattggagggggaaacatgcttcggggaaacatatcaattctatcagaaacttaataaactatgaaagaacactcgatgtctacaatcaatacgataacaatactgttgcggcgcgcaacacgatcctttatcatttaacattgttgcggcgtgcaacccgatccacatatataactgttgcggcgtgcaacccgatccaatataatatctgttgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcggcgtgcaacctaatccacatatataactgttgtggcgcgcaacccgttccagatatacagtcaacaataatcataattaaccgccccgacaagggatcaataatagactacactatccggcaaaggaactcaacagtacaagtatatacgtcccgataagggagtaaccgccataaccaaacttgttccaacatctaactatctcaactataactcagctagtttcaacatccaactaccccagctataactaaacttgttacaactcctaacacgaagaatcatcaacctaagcgtccgtaatatcaattaagaacacaatgcaagggaacatcaactcaacaatagcccggcaaggggggcaacataatgatctctactctttctcacttttacctcacaattaacttcacaactcgagccaatgctctagagtttcgattatcactgagcccacgctccttaatgttcataggtcacaattctttccacaactttacacaataaatagaaatcttcaccaaggcacgaataatacaacgagatcatgaaaatcacagtataagactcacggtcatgcttgacaccaacgcatagatactcgtcaccatgcctatacgtcgtactcgacaagaaacaaatagcaaataggacacaactcctaatccctcaagctaaggttagaccaaacacttacctcgatgccacaaacacaactcaaggttcaattatagctttaccccttgattccaccgccaattcgctcgtatctactcacaaattacttaattacatcactaaccgctaaatgaatcaattctaatgcatgaaaataggttttaccaagatttccccaaaaattcaaaaattgcccccgggcccacatggtcaaaacccgaggttccaaccaaaacccgattacccattcccccacgagctcaaatatataatttgttttgaaatcggatctcaaatcgaggtccaaatccccattttttgaaaaatataggttttacccaaaacactcgatttcccccatgaaaattattgatttgaagttgaaatcatgttaaaagatattagtgattgaagacaattagttaaaaatgacttacattgatttggagaagaaagagtgtttgaaaaatcacctcttatgtttttggggtttttgaaaagtgcaaaatgactgatagtctcgtctatttatacccctctcagaccctctccgcggaccgcataaaaaggactgcgtccgcggagctccaccgcggactgcgagacctggcttcagagacctgcaacttctctgaatctgcaactttttcctaagtgtaaaaacatcccgaaactcacccgagccctcagggctccaaaccaaatgtcatactaactcaaaaatatcatatggacttactcgtataatcaaatcctcaaaataacctcatgaacatcaaattaaatctcgagatcaatgaaattttctccaaaacttctttaaacataaattttgcaatttaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatcacgtcatatgacatctgtttttcaccaaattccacagaaaggtcttaaaccatatataagatctgtaccgagcaccgaaacacaaattcggtcccgataccatcatgttctaatcaaattccatttcaaatttctttaaacaattccagaaaataatttcctttaaaaattcatttctcaggcttgggacctcggaattcgattctgggcatacacccaagtcccatattttcctacggatcctccaggaccttcaaatcacgggtccgagtctgtttacccaaatgttgaccgaagtcaaatttatttattttacagtcaaaacttatcatttttcacagattatcatatttaagttgtctggctacgcgcccggactgcgcatgcaactcgaggtgactctaaataaggttttcaaggcctcagaacatggaagtttcatattaaaacaagttatgaccttttgggtcatcacattctccacttctaaaataatcgttcctcctcgaacggacagtacctgaaggaagtacctgagtcgggaaaaagatggggataatggctccgcatatcggactccgactcccaggtcgatgcctccgtaggctgatctctccattgaacatgaacagaaggaaaactcttcgatctcaactaacgaatctgcaggtctagaatagccaccggcttctcctcatacgacaagtccctgccaactgaatagtgttgaagtctaacacgtgatatggatcgccgtgatacttacgaagcatggacatgtgaaacactagatgcacggttgaaaagctcgacagcaatgcaagtctataagccacctctcccactcgatcgggaatctcaaacggaccaatgaacctagggctaagcttgccctttttcccaaatctcatcactcccttcataggaaacactcggagcaatacccgctcaccgaccataaatgccacatctcaaacctttcgttctgcataacctttttgcctggactgagctgtacgaagcctatcctgaataatcctaacattgtccaaggcctcctgaacaagatctgtacccaacaaccgagcctctcccggctcaaaccatcatatcggagaccggcactgcctaccatataaagcctcataaggagctatctggatactcgactggtagctgttgttgtaggcgaactctgctaaaggcaaaaactgatcccacgagcctccaaagtcaatacacaagctcagagcatatcctccaaagtcgtacttaacctgctgacaattcaaacaccgagctacatatgcaatgatatccttcttcattctctgccaccaataatgctgccgcaaatcctgatacatcttcgcggcgcccggatgaatagactatcgggaactatgggcctcctctaagatcaactctcggagtccatccacattaggcacataaacttgtccctacaatctcaaaactccatcatcatctaaggtaacctgcttggcacctccatgctgcaccgtctctaaggaacacacaaatggggatcatcatactgccgattacggatacgctccaataaagaagaacaagcggctgtgcaagctagcacatggctgggctcagagacatccaacctcatgaattgattggccaaatcccgaacatccaaagcaagcggtctctcaccgcccggaatataagcaagattgcccatactggatgacttcctactcaatgcatcggccaccacattggcctttcccggatgatataagatagtgatatcataatctttcaacaactctaaccacctcctctgtctcaaattcaactcctgttgcttgaacaaatactgaagactcttgtgatccgtgaacacctcacatgccacgccatacagataatgtctccaaattttcaatgcgtaaacaatggctgccaactccaaatcatggaccgggtagttcttctcatgaatcttcaactgccgcaaagcataagcaatgaccttgccatcctgcatcaacactgcaccaagttcaatacgatatgcatcacaatagactgtataaggccctgaatctgtgggcaaaattaacactggtgtcgtattcagagctgtcttgggcttctgaaagctcgcctcacactcgtccaaccatctgaattgggcacccttctaggttaatctagtcattggggctgcgatagatgaaaacccctccacgaaccgacgatattagcctaccaatcccaagaaactctgaatctgtgtagctgatgctggtctaggccagaaatgcaactaaactcaaccagaactcacacttcgagaacttagcatataaccggttatccctcaaggtctgatgaaccactctaagatgctactcgtggtcctcccagctacaagaatatatcaaaatatcatcaatgaagactatcacaaacgagtccaaataaggcctaaacacgcggttcatcaaatccataaaagctgttggggcattgatcaacccaaatgacatgaccaagaactcataatgcccataccgagtgtggaaagctgtcttagggacatcggatgccctaatcctgaactgatgatagccagatctcaaatcaatctttgagaacaccttggcaccctgaagctgataaaacaaatcatcgatcctcggcaatggatacttattcttgattgtaaccttgttcaactgccggtaatcaatatacattctcattaatccgtccttcttcttaacaaacaacaccggcgcaccccaaggtgaaacaagggtctaatgaaacccttctcaagtaggtgttgcaacttatccttcaactctttcaactcagacggagccatacgatacggcggaatagaaacgggctgagtgcccagatccaaatcaatgcaaatgtcaatatccctatcgggtgtcatacctggcaggtctgaagtgaaaacctcaggaaactcatgaacaacgggtacagaatcaatagagggaacctcggcactagaatcacgaacatatgccaaataggacaaataccccttctcgaccatacgccaagccttcacataagagataaacctacgggtagaatgactaggagtacctctccactctaaacgaggtaaacccgataaggctaaggtcacagtcttggcatgatagtctaagatagcgtggtaaggtgataaccagtccatccccaatataacatagaaatcgaccatgtccagaagcaacagatctacacgagtctcaagaccctcaatcacaactataaaagagcgatggactcgatctaccataatagaatcacccaccggtgtagacacatatacaggaacactcaatgaatcactaggcatgtccagatacggtgcaaaataagatgacacatacgagtacgtagaccctggatcaaataacactaaagcatctctatcacaaacaagaaccgtacctgtaataactacatctaaagcctcagcctcgggcttggctggaagagcataacatcagggatgggccccaccaccctggactacatttctgggacggcctgtagctggctggcctccacctctagcggtctgagctccacctctaaatcctctacctccacatctagaacctctagctggctgggtggtctgtggaaaacctggtgccccaaccatagcgcggaaaccctgctgctgcgactgagtacccactaacctcggacaagtcctcctaatataaccatactcaccacactcaaaacatccacctaagtgttgtggctgaggaaactgagactgaccctggcgacctgaataaccaccccgaaaactctggagcagcagtgcactgataggagctggtggtgcactgtaggactgctgatcagaatattgcatctgcggactacggctacctgaagcaccgtgagaaacctgaagagctgactgaatacaacccgatctaaaatactcggtatttatggactagtgccatacgaggtaccacatgactacgacataaggtatatataaagtatattaaaaatgagtagtattttaaagtaatttgagacatttcttaattatgcaaataattgattaattaccgggtaatagaacgttacctaattactggataaagattaagctttcccaccctaaaacgtggcagcaagactagctctaaattgtgactcttaatgtcacatattaaggtgtcaaaacttagtaagatttgtggccaagtcactaaattagtggggcctacagcattaaaacataagacctctctaaaaagagttgcttatataaaaaatggtaggcaatttgccttagtaacgtgactggcattctgtttcaataaattcaagcaagcatatcttagaaatgtgatatttttgaaattctaacgaagcctggtataatttttctcaagaatatcatacggatttttctctacttcaatctgtcattacatgtttttcacataagacgtgtgttagaagaattgttaagagaatcggtccgggtatgttaagactatcccttatttcttttggcatgatctatacgtcacaaacgaaacgagtaaatgcacaatttcaataaatgactctaatcatagaaatactaggggtgtctatattcttgattcccaatgtagattattattatatcttctattcacggtctcagaaaaatacgtatttgataaagtttatccgaaaggcatatgaatttttatggcattctgagaaaatcttattgacatattttcttatgcatttcatgcatttatacatgtacattgacccatgactagatggcgttatatatgcatatatatgtatattatatgtatatgggatatgggaaaaggttacgatattgtatacgcaccaccacctgatcagctggtatacgttgatgattttgcccatagtggacgagatgatatgatgggatgccctcagaggcttgatgatgttatgaacacatgtacctatacacgacatgacattcatacatatatgcatgacactaaaagtatttcataatttacagagttatccagacttacaggttgagtcatttactttatatttcttccatgtcttttacgtacttatttatgtgccttacatactcggtacattattcgtattgacgttccttttgcttgaggactctgcatttcatgtccgcaggtctcgatagataggtcaagagtcctctaagtaggcgatcaactcagcggaagatgttggtgctctccatttgctccggagttgcttgtttggtcagtatgatttatatgtgtattgtttggtatggagggttctgtccctacctttataacaattatgtatccttagaggcttgtagacaaatatcatgtatgtaagagattgtatggccttgacaacctatgttcagtgcacgagtgattattttggtcttagaggctcatatgtcttatgtataagttggtattacatattgtattctacctatttcacggtggcctctccgacccagttatctatgatagtatgatatgaaaagatacattatgttggtactcggttgagtaagatatcgggtgcccgtcacgaaccatcgattttggtcgtgacataattacttctataaacaaacatatatttgaattttttatttttaaaaaaaacttccaaaacttatggccaaacgcctacttaaacttacttatgcttttggcctttgaataaagttagaaaatccatttgtgtattccttgaaagcgagccatgcattgtcgagtcaacttaccagcaaatacttcttgtaagatttaatttttcatataacattttcctttttcttttccttttttttttgtctttttctttgcatgcatgtcatcaggcccagctggcgcctaaggccactaaggcaatggccttaagcccccaaaatacttacggccccaaaatataaaaataatatatatatataatattttgataattatatactattgttagaaattttaaatcatttggttaaaatagttatagctaaaagttttacaaatattaaatttcagttactagttattttctgtctttaattcgtcccaacttaagttgatcttcttacaatgttagtttagaacagtttttcttaattctttgagtgcatttgtagacatttttcaagctactttgattagtaactattaaaatttgtccttaacattaattgactcttgaaacatagtagttactataatattatttgtttcaacttatatttagatttaaaagtgctaagagaaactgtatacgtagaagaatactctaatgggtaaacttaatcagctaaaaagtgttaattcaatattgttaattaacaaattaacttgagatttttaaattaaaataggttggatttttctatatcagttgtctcggttgaaaaagtttttaaaaactaagtcaataaagttcaacaaaataatacaagagagattaaacaaattggttagacattggcaataattaaaactgattataaatttcgataaattataagagagaaaaaaattaaggcctcacttttaattttcgccttaggcctcatattatgtcgatccgccccagcatgtcattatttatagaatatatgccaaaacaataaagtttatatacaatacaggtatgtgttaaaactgatgatcggtcctaaactatatgcacaaaatttaaaaaatgagattatgtgagcagaagggacctacatatatatatatatatacttacggataccctgaacatatccaccattagtggatcatcggataatgacattggactaataaagctcagttagcccatttgttttgaaaatcattgggttgtgtttcattgtagaggaattttcaaaaagtattatagtttagagtccaattattaacatagttatagttggcctaattatcattcgtaggtaatgtatttcaatttcgctgtatcaaacgcatacaaccaaattcaaattttgttgtatcaattcattgtcaggctgcatcaataaataccgttttgatggaaaagttgtattaactatattaattcgtgaataacggttgtatcaatgaatataattttgatggaaagcgatatcaattagaggcagaactaggtgtcggcccaagaaaaggtttgttttgaagattgacaaatgaagatcaggcatgaaccaggtccatcccttgtgagcatagacacgggcagattcgagcatatgggatgcacgtgacgaagataagcttaacttggtatatttgatatctccttatcgaaaaggttgcataattaataaggagaaggactccttacttaaagtgaatactatccaaaataaggaaggagctagaggttgaaggtaactagaacttttccactaaagaagagtagcattagaactctagttattttctactctactaactctataaatcacaggatattctcactttacaggtgatgcacacatactgaagttaagagcaaattgagagcaaaatagcaaggcattttgtgagcaactcctgtgagttttaagagtgtgatcctgaagctacacgaaccagattgaagaaccaactccataaagagttttatgtgtctttctttatttctagttcaaagtgtagtatgtgttttgagttgtacctttcagctttcttagaagcaaattgtactaggtgcttgagttgtatcattcaagttagagttaatgtgaagtagccgcaacggcctgtggcgggttgctataatgattagagttaatctttaggtttgcaagaggttgtaaactcgatttttattattcatgttagagttaacatgaagcaatcgcaacagcctagggctggttgctataagggctagagttaatccttaggtttgcaagagtttgtaaactttgttgttggctctgagttgtagtgaagtgtttggagaaaatcctactaggtagcaggttgtgggttttttacattttaagcgggtgttttctacgtaaaaatccttgtgttatttactttctacatttattattctgcaactgtagtataaggaacacatagaagaaccaggttcttctataatttgtgcacaaaaaaaattggacaccacacaaatcaccccatcccctctcttatgtggtattgaagtaaaaaatatcaattggtatcagagcagattatacttgaagaggcaaataccttaggaaaagatcaagatgagtgcactatctgaaaactctaaagagcaatctaccactaggccaccactattcaatgatcactattattttttgtggaaggagaggagaagagatcacttgcagatgactgatggatgcttcaaatgtggtaaaaaaaaccacatgatcaagaactgtcctatatggaaagtcgagtgaaaaaaagagaaatatgaaataaggaacaggttcatgacaagaagaactacaacaaaaggtcatctaaagcaatggttgctacttggaaagatagttcagatgaagacattgatgataatgttgaacgagctctcatagcaattcaagaatttgaaaatgaacctgatcaagaatatgagataagttttctggaccttaagaataaaattaaactcctttctaaagatagactatcaaaattgtttctaactttaattgatgaatctaagaatataagttatgaaaaagaacagttatcaaaagagggtaactatttaaaaacaaaatgcaaaagcctgaaaataaacatttgtaaaacttaaaaggaaaatactgctttgaagaaccaggttcatgcacttgatacatttgtcttagaacttatatctgagaatctgaaattgaagttaggaacaggtaaagaaatagccagtgacacacaactctcactagaaaaggatctaggaaaggtaaaagatgagctttataaaagggatgaactggtaagaaccttgaaggatgacttgactaagattaagcataagttagatagaacatgtaaatggaacagatcctttgatgcactttcatgactacaagaataccatagtagcaatagaaagggacttagcattgggaactctgcacctaaatgggatcccaaaaataagtacctaatattccctgagaataagatttgcacacactgtagaaacacgggtcactacaagagtgattgcattacaaaagaaaaggcagatcaaaagaataaaaattttattctagggaaaaatgttgccaagttgggctaaaaagaatttaatttatccttttgcctatagaaagggacccaaactagtttgggttcctacgactaacctctgatattcttttataggtccaagtgataaagagcaaccaaaaataatatatgataaaaggttgctcaaaacacatgacaggaaattagaaaatgttccattcacttgtggcctttaaaagaggtaatgtctcctctgaaaagagaaagcaaggtaaaatcattggagtcggaaagtcttgccaggaagaagagtgaaaaatatatatgttgtagatctgtccatacttttcgataatgaactcactttcttgagtgtcctggacagtgatccccttcttttgcataagagacttagacatgataatctaagttgactcaacaaactagtcttcaagaacttggtaatagggctgcctaaaattaagttcgaggaagataaagtttgtgaggcttgtacaagggagaagcaggtaagatcttctttcaaaagcaagaaaatggtaagcaccaccagaacgatggaactggcccatatggatttttggggacgaatgagaacattgagcagaggtggtaagagatatgttatggtatatgttgatgattactctaggtttacttgtacactgtttttaacatctagagatgaagtatttgacatgttcacttcatttttttttagaaaaactcagaaaaatctagataatcaacttgcatcaattaggtctgatcatgatactgaatttgagaatgttacagaagttatgaataatgcatgctacgtcataaatagttgcataactagacctcttgttaagaaggcttcccatgagatatttaaagggataaagccaaatatatatcctactttagggcatttggatgtaagtgctctgcgcacaataatgtaaaagactccctaggtaagtttgatcccagaagtgatgagagagtatttttgggatattcttcacatagtaaagcttataagatatataaaaaagaactatgtatgtaaaagaaagtgtgtatgttatttttgaaactaaaattctttccgagaagcaggaacaagatgatgaagatattggactgacaagaaactcaaatgatgaagccacagtctagcctgaagctgcatcacaggaagaaataggtgatggaatgggggtttccaccgtgggcaacctgacaaggcgaagtgactagagaggaactaatcctcaaacctcgagggaacttgtccatgaacctattccttagtaacaaaaccagaaaggaacatccaaagaaattaacactcctattgcaacatccactaaattggatatagatgaacctcgttcatctgttgaccagaagttgtatagaggaatgattggctctttgttatatctcactaccagcaggcctgacattgtttttagcgtaggcctttgtgctcgatttcaggaaaatccaaaggagtctcacttgactgccatcaagaaagtcttgagatacttgaaaggcaccactaacctttgtctatggtatccaaaaggtagtaatttcaacttagtgggatatgttgatgctgattatgtaggttttcttgtgaatagaaagagcacctcaggtatggaacactttcttggctcatgtcttgtgtcttgggctactaaaaagtaaaattctgtagcgctatctactggcgaatatgagtatgttgttggtgcctcatattgtgcttaattattatggatcaaacaacaattaatggatgttggaattgatataggttgtatccctatattctgtgatatcactagtgccattagtgtgaccaagaatccggttcatcataatagaactaagcaaatatatgttaggcatcattttttgagggacaactatgagaaggggttgattactatggaattttgtgctactgacaagaaaatagctgacatcttcacaaaagctctaagtagagatcactttgaaaggaacatgttagaattaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcacgaccctaaatccggacccggtcgtgatggcacctctcatgaagacaaggccagccgacactttcttatttcagttttaagcaattaaacaataagaactaaatctaaaacgtaataaataatcccaaagtaagcagtgaatagtacaatgtagaagtaaaaccaacacagcccgataccggggtgtcactagtcatgagcatctacaatccggatgatacaagaaaggtctatatagtctaatacaaatttaaaacagaggaagataagataaaggaagaagctctaggatgcgaacgccgacaactacctagagaatcttcgaatccgcctgagctggaaaagatcaacactcgttagcgggacctgatgcgcttgaatctgcacacgggttgcatggagtaaagtgagtactccaactcagtgtgtaataatcataaataaagactgaaagtaagaaatcacataaggcacattataggctataaggaagtagtaaaagctagtaaaacagtgaagcagtaaagctgtataaaattaccgagttcagtttaaaacttcataaaatgcctttttaacaattaagcaagcaaatgacaggaaattaggaaagataaacatataaaggatcgcccctctggcacagtgtcaacaaatccaccctcgggcaatatctcagaaacaatactagcccctcgggctatatcttacatcacaatgggtacccgcgctcactaggtatgtgcagactcctggaggggctccttaaggaccaaccgcaatatcaagcactcttgtggcatcatcactaggccctcggccttatatcaacaagccaccttgtggcttacaaatctcaggccctcggcctcataatcataatcaggtgtttcctcacaacataggccctcggccttactcagtcaaaattatttcaagccactcgggcaatagtaaaacatgatgcttaactcaaaagatcatttaaaatctcatttaagtgttaaagtagagtaaacacgactgagttatgaaaacagtagaatatagcgtgactaggttcaagtataaagtcaaaacagtgagaaaatatcagtaaaaatcccataagtgttcaaatagttggcacgaggcccaattatggcattcagcccaaaacatgatgataacaaacagtttttagtcaaatacgtggtaaaatagtcattcgggacggactaagtcacaatccctaacagtgcacgaccccatgctcatcatctagcgtgtgcgtcacctcaatatggtataacgatgtgcaatccggggtttcataccctcatgacatcatttacaattattactcacctcaatctagtccaaatctagcccgcaacgcctttgcccctcgaatcgtcctccgctcgcgtcgaatctatccaaaatcagaatcatgatgtcaaaatatgctaagggaatgaagcccatacgaaaataatcaatatacaacacaaatcccaaaattaccaaaatccgacccccgggcccacgtctcggaattcgatgaaatttacatcaataggttccttacaatccccacgagttcatacatatcaaaagtaccaaaatccgaccacaaatagtccctaaaaccctcaagtctaggtctccaatacaagccctagtttccctaattttaacccttaaattccattaattacggctctaattcgtgaaataataccataggaacgagttttaggtccaaaatccttacctcaatgaagttcccttgaaatcattcttcaaaatcgtccaaaaagctccaaagcctacttagaaatggtggaatagctcaaaaatcacgaaggaaacaatttatatgttctggcccagggatttcgcatctgcggccaaattcccgcttctgcggtattgcttctgcgctcaagaccaccgcatctgcggtcctcacttaagtcctcattttcgcatctgcaattcactatccgtgcctgcgccatcgcaggtgtggttctccaaccgcttctgcggtttctgcctccctatctcctttccacttctgcggccccctttcatcgcatctgcggcatcgcacctgcggtccccaatccgcaggtgcggaaacaacagaagctgaaaatctgcatcttcaccacgaattccaaactctctgtcaaccatccaaaatcaccacgaggcccccgggacctcaaccaaaagcacaaacatatcctataatcttattcaaacttataccaatctttaaaacacctcgaacaacatcgaatcaaccaaaacacatcaaattcaagcctacgtttccaaaaaccttccgaattatgcttttgatcaaaaacccaaccaaaccacgttcgaatgacctgtaattttgcacacacataccaaatgacataatgaaactactgcgactttcggaattccattctgacccctatatcaaaatctcacctatcaatcgaaaaacgccaaaaatccaatttcgctaattcaagcctaaatctactccgaacctccaaaatacatttcgatcacgctcctaagtcccaaatcacctcccgaagctatccaaaccatcgaaactcacaatctgagccctctaacacataagtcaatatccggttgacttttccaacttaagcttactcaaaagagactaagtgtctcaaaccttaccaaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaccccagccaaccaacccgatcacatatagaaccgatagataaagaaataagaagcagaaaatggggaaaatggagtggtaactcaggagatactagtcggatcgttacatcctccctctcttaaataatcgttcatcctcaaacgagttaagaaccatacctgaagcctcaaacaggtgaggatatctgctccgcatctcccgctcagcctgctaggtcgcctcttccacgggctgacctccccactgcactttcactgaagctatatccttagacctcaactttcgaacctgacgacccaaaatagctactggctccacatcatagatcaaatcaccatccaactgaaccgtgctgaaatccataacatgggacggatccccaatatacttttcgagcatagaaacatgaaataccagatgcacactcgacaagctgggtggcaaagcaagctcataagccacctccctaatcctgcaaagcacctcaaaagccccaatgaaccgaggactcaatttacctttcttcccaaatatcataacacccttcatgggcaaaaccttcaacagaaccttctcgccaaccatgtaggacacatctcgaaccttcctgtcagcataacttttttgtctcgactgcgctgtacgaagcctctcctgaatcaccttcaccttttctaaagcatcctgcacccagtctatccccaatagcctagcctcacctagctcaaacgaaccaactggagatctacaccacctctcatacaaagcctcatatggagccgtctgaatactcaactggtttgttgtaataagcaaactctacgagagatggaaactgatcccatgaccctccaaaatcaatgacacaagcacacaacatgtcctccaatatctgaatagtgcgctcggactgcccgtccatctgagggtgaaaagttgtgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccatgcaatcgaacaatctcccgaatatagatctctgctagccgctctaaacaataagtagtacacacatgaatgaagtgcgcggacttggtcagccgatccacgatcacccaaatagcatcaaacttcttaaatgtccgtgggagtccaactaaaaagtccatagtgatcctctcccacttttactctggaatatccatccgcggaagcaagccacctggtctctgatgcttatatttcacctgctgacatttgagacaccgagctacaaatcccacaatgtctttcttcattctcctccactaataatgctgtctcagatagtgatacatcttcgcggtacccggatgaatggaataccgcgagctatgggcctcctccagaataaactcccgaaacccatctacattgggcacacatatctggcccatcatcctcaacaccccatcatcaccaatggtcacatctctggtatcatcatgatgaactttgtccctaaggacaagtaaatgaggatcatcatactggcactctctgatgcgatcatataaggaagaccaaaaaaccacacaagccaatacctgattgggctccaaaatatctaacctcacaaactgattggacaaggcctgaacatcaactgcaagaggtctctccccaactggaatatattccaaactccccatactcactgcctttcagctcaaagcatcggccaccacattggccttccccgaatggtacaatatagtaatatcataatcctttagcaactccaaccacctccactaccacaaatttagatccttttgcttgaacaagtgctggagactacgatgatcagtaaacacctcacaagacacaccatacaagtaatgtctccaaatcttcaacgcgtgaactatggcaaccaactccaaatcatgaacggggtagttcttctcatgggacttcaactgacgagaagcataagcaataactctaccctcctacatcaatatacacccaataccaactcttgaagcatcacaatacacggtatataaacctgaagctgatggcaaaactagcattggagtcgtgatcaaggctgtcttgagcttctgaaagctctcctcacactcatttaaccatacaaatgaagcacccttcggagtaaacttggtcaagggcggtgcgatagatgagaatccctgaacaaaccagcgataataacccgccaaaccaagaaatatgcaaatctctatggctgaggacggtctgggccaactctgaaccgcctttatcttcttcgggtcaacctgaataccctcactggacaccacgtgtcccaagaaagccactgaactgagccaaaactcacacttgaagaattttgcataaagtttctcctccctcaatctctgcaacacaactctcaaatgctccatgtgctactcctaactacgcaaatacaccagaatattgtcaatgaagaatttgacaatcgagtctagataagtaaggaacacgttgttcatcaagtacatgaatgctactggggcattggttagcccaaggtgataacctgaacagagatcaatcttgaagaacactctcactccctgaagctggttgaagaaatcatcaatatgaggcaaaggatacttattcttaattgttactttgttcaattgcctataatcaatgcacatccttataatgccatccttcttcgttacaaatagaactagcgcaccccaaggtgacacactaggccaaatgaacctcttatcaaggagttcctgaagttgcttctttaactccttcaaatctgctggtgccatacgatacgacataatagaaatgggctgagtgcccggcaccaggttaataccaaagtcaatatccctgtccggtggcatgcccggtaggtctgcaggaaacacatcatgaaaatccctcacaattagaacgaaatcaatactgggagtctctccaccgacatccctcacaaaggctagatacgaaagacaacacttcccaaccatacgttgagccttcaaaaatgagattactctactgggaacataatcagtcaaaccttgccactcaatctgtggcacacccggtatagccaatgtgactgtcttaacatgatagtccagaatagcatgacttgtagataaccaatccatgcccaaaacgacatcgaaatccaccatacacaataataaaagatctactagggtctccagatccccaatagtcactacagacaaccggtacacattgtctacaataatagtatcgcccatcaggatagatacatgaacaggtgaaacaagagactcacggggcatacccaaataacgagcaaagtatgatgacacataagaaaaggtggaaccaggatcaaataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaggcatctctagggcaaactgaaacaatacctataataacagcatcaaaagcaatagcatcgggtctagatggaagtgcatagaaacgggcctgaccgccatctgatcgacctccccctttgggacggcctctagatacctaacctccacccctagctggctgggcaggtgatggtgaagtaactcgtgctgaagccgatgactgactcctctgctgagatgaacccgcaagacgacgaggacactgcctccacatatgacccatctttccacactcatagcaactctcgagtgctggagaaggggactgaagggacccctagcaccggaatgactagtagatgcacctagcatagaagatccctgaactgattgagcacgagataaactctaagctagaaaggcactaagtgatgactggccctgatgagaactgtgagaaccatgactcgatgatgccccatgataacctgggcgagctggctgagcatgcctaaatggatgccctctgccgtgctgaaactgacctctcgaaggagcactactctaactaccagatcctcgaggcctcttggcatccctctcctctcgctcctagcaatgaacaaactcaatctcactagcgatgtctacaacctcctcaaaagtcgcaccagtcacactctccctggtcatgagagtacgaagctgataagtaaggccatcaacaaacctcctactcctctctctatcaatccaaaccaaccaaatagcataacgagctaactcgaagaacctcatctcatactacatcatagtcatctctccctgatgcaaccacttaaactacctacgcagctcctctctatgagactgcagcacatacttctccaaaaagagaacggagaaatgctgctaggtaaggggtgctgcaccaataggcttacgcctctcaaaagtctcccaccaagtgaaggatgttctagaaaactgataagtagtgaaagcgaccacgctggtctccagaatacccgttgtacaaagcatcctctaacacttatccaagaaaccctgggcattctcgccatctgcaccactgaaggtcggaggctgaagccaaccaaacctctccaacctatgttgttcgtcctctagcatagcaggaaccacatagtcctgagcagctataaccggctcggctagatgcatccccggtgtctgaagtccctgcacgacctgctcaagtgtgcaagcggcgggagtttgagtgcctcctctagcctaagaagtagttgtggctgtactgactgaaactgcctgagctaggccagtgcatactgataaaatctgagccaaggcctcctgaagaccctgaatcacaatgggcacaactggtgcctgagctagtgctgctggagcgtccacaactgggacctgatcctgaactagggcgatagaaggattttgcaggtgctgctctagctactatgtgggccacacctatgtccctacggtaaccacgaccgcatcctcggactctagtggccacgctggtggtgctggtggtcgtccatcttgactggtagcgcgtgtcctcaccatctatgagagaatagaataacataagtttagtactcggatcaacaaattcgcaagacaagaatttcaagaatatgaaggtttccctaaagattctacagcctctcgaggataaatacaaatgtctccataccgatccacgagactatactaaacttgctcatgactcgagagacctatgtatcctaggctatgataccaacttgtcacgaccctaaacccggacccggtcgtgatggcacctctcataaagacaagggcatccgacactttcccatttcatttttaagaaattaaacaataagaattaattctaatacttaataaataaacccaaagtaagtagtgaatagtacaatgcagaagtaaaaccaacacaacccgataccggggtgtcactagtcatgagcatctacaatccgtatgatacaagaaaggtctacatagtctaatacaaatttaaaatagaggaagattagataacggaagaagctctaggctgcgaacgccggcagctacctagagaatcttcgaatctgcctgagctggaaaagattaatactcgctagcaggacctgatgcgcctgaatctgcacatggggtgcagggagtaaagtgagtactccaactcagtgagtaacaatcataaataaagactgaaagcaagaaatcatataaggcacattataggctataaggaagcagtaaaagccagtaaaacagtgaagtagtaaagatgtgtaaaattactagttcagtttacaacttcataaagtgcctttttaacaattaagcaagcaaatgacaggcaattaggaatgataaacacataaaggatcgcccctcgggcacagtgtcaacaaatccgcccctcgggcaatatctcaaaaacaatactagccccttgggctatatcttatatcacaatgggtacccgcactcactgggatgtgcagactcctagaggggccccttacggcctaagagtaatatcaagccatctcgtggcatcaccactaggccctcggcctcatatcaacaagccaccttgtggcgtacaaatctcaggccctcggcctcataatcataatcaggtgtttcctcacattataggccctcggccttactcagtcaaaattctcttaggccacacgggaaatagtaaaacatgatgctcagctcaaaagatcatttaaaatctcatttaagtgttaaagtagagtaaacacgactgagttatgaaaatagtagaatatagcatgactgagttcaagtataaagtcaaaacagtgaggaaatatcagtaaaaatcccctaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgatagcaaacaattttcagtcaaatacacggtaaaatagtcattcgggatggactaagtcacaatccccaacaatgcacgaccccacgctcgtcatctagcatgtgcgttacctcaatatggcacaacgatgtgcaatccgggatttcatacgctcaagacatcatttacaatcattactcacctcaatctagtccaaatctagcctgcgatgcctttgcctctggaatcggccttcactcgcatcaaatatatccaaaattagaatcacgatgtcaaaatctgttaagggaacgaagcctatgcgaaaataatcaatatacaacacaaattccgaaattaccaaaacccgacccccaggcccatgtctcgaaattcgaggaaattcacatcggtaggttccttatcttcccacgagttcatacatatcaaaagtaccaaaatccaaccacaagtggtccatcaaaacctcaagtctaggtttccaataccaagccctagtttccccaattttaacccttaaattccattaattacagccctaatccgtaaaataataccttaggaacgagtttaggtccaaactccttacctcaatgaagttcccttgaaatccttcttcaaaatcgtccaaaaagctccaaagccgacttagaaatggtggaatagctcaaaaaacgcgaaggaaacaatttatatgttctagcccagggatttcgcatcttcggtcaaattctcgcttttgtggtatcgcttctgtggtcaagaccatcgcatctgtggtcctcacttaagtcctcattttcgcatctgcgattcactatccgcacctgcgccatcgcaggtgcggttctccaaccgcttctgcagtttctgcctccctagatcctttgcgcttctgcagcccccttttattgcatctgcggcatcgcacctacggttcccaatccgcaggtgcggaaacaatagaagcagaaaatctgcagcttcaccaaaaattccaaagtctccgtcaaccatccgtaatcaccccgaggcccccaggacctcaaccaaaagcaaaaacatatcccataaccttattcaaacttatatcaatcttcaaaacaccataaacaacatcgaatcaaccaaaacacgtcagattcaagcctaagcctccaaaaatcttccgaattacgtttttgatcgaaaacccaaccaaaccacgtccaaatgacctgaaattttgcacatacatcccaaaggacacaaaggaactaatgagactctcagaattctattttgacccatatatcaaaatctcacgtatcaatcgaaaaacgccaaaaatctaattttgctaattcaagcctaaatatactccggacctccaaaacacatttttatcacgcttctaagtcccaaatcacctctcgaagcgatccaaaccatcggaactcacatccgagccctctaacacataagaaaacattcggttgacttttccaacttaagcttcctcaaaagagactaagtgtctcaaaccttaccaaatcctttctaagcccgagccaaccaacacgatcacatatagaactaatagacaaagcaataagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttggttagaaaattatgaactttgtacataattaaattagattttgctcattctcatacattcataagtatactcttgtgccatgtgctaatatgacttatctctaatgatattatcgctattttcttgggaaattcaggtttacacaagagatttttcaatgaagaacccagttcatcaagattatttggtacgtattctctactctgcatagtttgaaataattatatttatatcatgtttaagaaaagattcccattcaatatcaaaccccactgtacttatacattacaaaaatggactagtttgttcaaaagaggagtccaaactgcattaaatgcctagattgtagggaacctttccaatgtcttgtcaaacaggaattcagtttgattagacttctgagagactgtcgctacccaattaaacactcctctttaaattgattaggcttagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttttaattcattaatctactcttcatcttttctcatcttcgaaacacacttaaactttcttttcttacttccaagcacagaaatggataacatctctgataatccctcttcaccacccaaggaaaacttacccacaccatatgatacaccttcaactactcccatctctaataaaggaagggtaaaaatgatggctcgcaaggttgttgttggtggagagcaaattaataaaatcaatgaaaatttgaaagcaaatagggaagaagaaccccaaaaacctgatgagtcattcaaatctacaactaagggggaagaaacagttccttctgagtgtgaacaggtaacgtctagccccaaagttaatcttgaaactttttttgtggttgctatgaatttgaagaatacgtttgttcttgtaggatataggccaggtgttgaaagtactaagtctggaaaggtgggtggtaaaaataaaaagagaaaagataaagagagagagggttatcgaagtactgtaaggggaatgggaaaaggagtgactgaatctttacgcactcatgttggtctaactaaagagtcaggtgctatggtagtttagggtgaggaatttgttgaaatagaggagagtctgagaaaaatagagggaagtgggtctggagaagttgctgaggggctggttcaactagggaaaatgtagatgaacctgttccatctgaacaggagtccctcacagacctactgaaaagagtgattgaaagctacaatccaaagaagaaacgaagtctaggagttaaaacccctggcaccactagagccaacaagaaaaggaaggttgtttattccatccctgtagaaattcctcccacaaaaggaagatctgctaggagttagaagaagcagagtgaggctgaactggacaaagccttagaagaaagtaaaagaaaagttgctactaagggcaagaaggagatggttgagcctgttgaggttgtttaaatttatgagatagacctggtccttcaagatgaagatgagatagaacaagtggagactgtgactccaaaagctaagataggcaagacttctacaaagaagtctacttcaaatacaaagtctattgttccatccactttgtctaaaagaaccaggttttctatgaaatcaagaaaggtaaaaatggtggaggaagacgaacagagtggagaagaagaagaagaagatgatgaagaagaagaataagaatccgatgttgagaaggacaagatggttaagcttgggaagagaaccatcttgaaaggtaggctgcttatcttcccacgagttcatacatatcaaaagtaccaaaatccaaccacaaatggtccatcaaaacctcaagtctaggtctccaataacaagccctagtttccccaattttaacccttaaattccattaattacagctctaatccgtaaaataataccttaggaacgcgtttaggtccaaattccgtaccttaatgaagttcccttgaaatccttcttcaaaatcgttcaaaaagctccaaagccgacttagaaatggtggaatagctcaaaaaacgcgaaggaaacaatttatatgttctagcccagggatttcgcatcttcggtcaaattctcgcttttgtggtatcgcttctgtggtcaagaccatcgcatctgtggtcctcacttaagacctcattttcgcatctgcgattcactatccgcacctgcgccatcgcaggtgcggttctccaaccgcttctgcggtttctgcctccctagctcctttgcgcttctgcggcccccttttttcgcatctgcggcatcgcacctgcggttcccaatccgcaggtgcggaaacaatagaagcagaaaatctgcagcttcaccacaaattccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaaaatcttccgaattacgtttttgatcgaaaacccaaccaaaccacgtccaaatgacctgaaattttgcacatacatcccaaaggacacaacggaactaatgagactctcagaattctattttgaccacaatatcaaaatctcacgtatcaatcgaaaaacgccaaaaatccaattttgctaattcaagcctaaatatactctggacctccaaaacacattcttatcacgctcctaagtcccaaatcacctctcgaagcgatccaaaccatcggaactcacatccgagctctctaacacataagacaacattcggttgacttttccaacttaagcttcctcaaaaaagactaagtgtctcaaaccttaccaaatcctttttaagcccgagccaaccaacacgatcacatatagaactaatagacaaagcaataagaagcataaaagggagaaaacagagtggtaactcatgagacgactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttggttagaaaattatgaactttgtaactaattagattagattttgctcattctcatactttcataagtatactcttgtgccatgtgctaatatgactcgtttatctctaatgatattatcgctattttcttgggaaattcaggtttacacaagagatttttcaatgaagaacccagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtacttatacattacaaaaatggaccagtttgttcaaaagaggagtccaaactgtattaaatgcctagattgtagggaacctttccaatgtcttgtcaaacaggaattcagtttgattagacttctgagagactatcgctacccaattaaacactcctatttaaatttattaggcttagtgtattcttcacttaaactttttaagtcgttaatctactcttcatcttttctcatcttcgaaacacacttaaactttcttttcttacttccaagcacagaaatggataacacctctgataattcctcttcaccacccaaggaaaccttacccacaccatatgatacaccttcaactactcccatctctaataaaggaagggtaaaaatgatggctcgcaaggttgttgttggtggagagcaaattaataaaatcaatgaaaatttgaaagcaaatagggaagaagaaccccaaaaatctgatgagtcattcaaatctacaactaagggggaagaaacagttccttctgagtctgaacaggtaacgtctagccccaaaattaatcttgaaactatttttgtggttgctatgaatttgaagaatacgtttgttcttgtaggatatatgccaggtgttgaaagtactaagtctggaaaggtgggtggtaaaaataaaaagagaaaagataaagagagagagggttatcgaagtactataaggggaatgggaaaaggagtgactgaatctttatgcactcctgttggtctaactaaagagtcaggtgctatggtagtttaggttgaggaatttgttgaaatagaggagagtctgagaaaaatagagggaagtgggtctggagaagttgctgaggggctggttcaactagggaaaatgtagatgaacctgttccatctgaacaggagaccctcacagacctactgaaaagagtgattgaaagctacaattcaaagaagaaacgaagtctaggagttaaaacccctggcaccactagagccaacaagaaaaggaaggttgtttcttctatccctgtagaaattcctcccacaaaaggaagatcttctaggagttagaagaagcagagtgaggctgaactggacaaagccttagaagaaagtaaaagaaaagttgctactaagggcaagaagaagatggttgagcctgttgaggctgtttaaattgatgagatagacctggtccttcaagatgaagatgagatagaacaagcggagactgtgactccaaaagctaagataggcaagacttctacaaagaagtctacttcaaatacaaagtctattgttccatccactttgtctaaaagaaccaggttttctatgaaatcaagaaaggtaaaaatggtggaggaagacgaacagagtggagaagaagaagaagatgatgaagaagaagaagaatctgatgttgaaaaggacaagatggttaagtttgggaagagaaccatcttgaaaggtaggctccttatcttcccacgagttcatacatatcaaaagtaccaaaatacaaccacaaatggtccatcaaaacctcaagtctaggtctccaatatcaagccctagtttccccaattttaacccttaaattccattaattacagctctaatccataaaataataccttaggaacgagtttaggtccaaactccttacctcaatgaagttcccttgaaatctttcttcaaaatagtccaaaaagctccaaagccgacttagaaatggtggaatagctcaaaaaacgcgaaggaaacaatttatatgttctagcccagggatttagcatcttcggtcaaattctcgcttttgtggtatcgcttctgtggtcaagaccatcgcatctgtggtcctcacttaagttctcattttcgcatctacgattcactatccgcacctgcgccatcgcaggtgcggttttccaaccgcttctgcggtttctacctccctagctcctttgctcttctgtgaccccctcttatcgcatctgcggcatcgcacctgcggttcccaatccgcaggtgcggaaacaatagaagcagaaaatctgcagcttcaccacaaattccaaactctccgtcaaccatccgtaatcaccccgaggcccccaggacctcaaccaaaagcaaaaacatatcccataaccttattcaaacttataccaatcttcaaaacaccttaaacaacatcgaatcaaccaaaacacgtcagattcaagcctaagtcttcaaaaatcttccgaattacgtttttgatcaaaaacccaaccaaaccacgtccacatgacctgaaattttgcacatacatcccaaaggacacaacggaactaatgagactctcggaattccattttgaccaatatattaaaatctcacgtatcaatcgaaaaacgccaaaaatccaattttgctaattcaagcctaaatatacttcggacctccaaaacacattcttatcactctcctaagtcccaaatcacctctcgaagccatccaaaccatcggaactcacatccgagccctctaacacataagacaacattcagttgacttttccaacttaagcttcctcaaaaaagactaagtgtctcaaaccttaccaaatcctttctaagcccgagccaaccaacacgatcacatatagaactaatagacaaagcaataagaagcataaaagggagaaaacagagtggtaactcatgagacgactgaccgagtcatcacagaaccagttctaactcaaaaatttggttagaaaattatgaacttggtacataattagattagattttgctcattctcatactttcataagtatactcttgtgccatgtgttaatatgactcgtttatctctaatgatattatcgctattttcttgggaaattcaggtttacacaagagatttttcaatgaagaacccagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacttatacattacaaaaatggaccagtttgttcaaaagaggagtccaaactgcattaaatgcctagattgtagggaacctttccaatatcttgtcaaacaggaattcagtttgattagacttctgagagactgtcgctacccaattaaacactcctctttaaattgattaggcttagtgnnnnnnnnnnnnnnnnnnnnnnnnnnnnnnnnnnnnnnnnnnnnnnnnnnnnnnnnnnnnnnnnnnnnnnnnnnaactttttaagtcgttaatctactcttcatcttttctcaacttcgaaacacacttaaactttcttttcttacttccaagcacagaaatggataacacctctgataatccctcttcaccacccaaggaaaccttacccacaccatatgatacaccttcaactactcccatctctaataaaggaagggtaaaaatgatggctcgcaaggttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaacaggtaacgtctagccccaaagttaatcttgaaactatttttgtggtttctatgaatttgaagaatacgtttgttcttgtaggatatatgtcaggtgttgaaagtactaagtctggaaaggtgggaggtaaaaataaaagagaaaagataaagagagagagggttatcgaagtactgtaaggggaatgggaaaaggagtgactgaatctttacgcactcctgttggtctaactaaagagtcaggtgatatggtagtttagggtgaggaatttgttgaaatagaggagagtctgagaaaaatagagggaagtgggtctggagaagttgctgaggggctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagctacaattcaaagaagaaacgaagtctaggagttaaaacccctggcaccactagagccaacaagaaaaggaaggttgtttcttctatccctgtagaaattcctcccacaaaaggaagatctactaggagttagaagaagcagagtgaggatgaactggacaaagccttagaagaaagtaaaagaaaagttgctactaaggacaagaagaagatggttgagactgttgaggctgtttaaattgatgagatagacctggtccttcaagatgaagatgagatagaacaagtggagactgtgactccaaaagctaagataggcaagacttctacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagaagaagaagaagaatccgatgttgagaaggacaagatggttaagtttgggaagagaaccatcttgaaaggtaggctcctcaggaacttagaggaggaaggaatggtaatgcttctggagaagttacaggtgcaaggatggaaggacatggtctttcagatgatggaaggttggccataactgatattgtgcagtttatggcaaattgtgagatcaagatggtagggtcaccagtgtggtaaagggtgatggtgacttttgatgagaaagagctgagagagatcttggggtgcattctaaaggatacaatgactataagaagctcaaatggacaagcctagagaatctccctactgcccttgccagtactagaaaattttgtgacaatgaggaggaaattgagcccaaggctatttacaaaaatgagatgaagccacccaacaaagtgttgctccaatttgtaaacaaatgtgtgctgccaaggtaggaaaggaggcacatttccacattcatggacctggtccttatggaatgtttggacaataggcggcaaataaattggcctgggtctaaaattcagcttcttgacagggttctaaatggaactaagacttatgtcataccctatggttttattctcacgattgttcttgcacatttaaaggtacccatcaagaaatgggaagttggtacaaacaaggatcattttggggctaacactttgactgcttgtaactatgaggctcaaatcactcccaaaaaacctggttcatccaaaaaggtaccagtgaatagcaaagtgcgagttttggtgcaagaaagtagggcaaaggatgctgagcctgataggctaaagaagaggttggctgaaatggagaccgagagagatgctctcagagctgagcttgcaaaagagaatgagaagaattagggcattcttcaggatatgctgaaactgctccaagccaaaaaccaagaacctggtccttcccagccttaatcctcctaacctactgtagatcaaccagtgacccagcttaggatttttttgtttcttttgctcatgatccaatgttcttattctttttatgctttgtagtaggatcttatcaatcaatgaaatttactgccttttgctctagctgtttgttgatatttcttagatgactaatatccttagatttatagatgatgcttaaatctatgattgcatttgaagtagcctagtggccatgattaatttctatttaaatttggttatctcacataattatgcaacttttcgatgatgccaaaggaggaattaggttgtgctttttctttggactgtgatgtttataacctaatgaacctggtccttgataataagtgataaaatgttctaacattgtgttgatgttgagctgagttgaaacagggcttaagcttatgaaaagcacagattttgtcatcatcaaaaagggggaatttgttggcccaaataaaggtttgttttgaagattgacaaaggaagatcaggcatgaaccaggaccccttatgaacatagacacgggcagatttgagtatatgagatgcatgtgaaggagataagtttaacttggtatatttgatatctcctgatcaaaaagattacataattgataaggagaaggactccttactcaaagagaacactatccaacataagaaaggagataggggttgaagttaactagaactcttccaccaaggaagagtagcattagaactctagttattttctactctactaactctataaatcgcatgatgttctcactttacaggtgatgcacacatactgaagttaagaatgaaatgagtgcaaaatagcaaggcattttgtgagcaattcctgtgagttttaagagtgagatcctgaagctacacgaaccagattgaaaaaccagctttataaagagttttatgtgtctttctttatttttagttcaaagtgtagtatgcattttgagctgtaccttttagctttcttagaagcaaattgtactaggtacttgagttgtatcattcaagttagagttaacttgaagtagtcacaacagcttgtagcatgttgctataagagttagagttaatccttaggtttgcaaaaggttgtaaactcgagttgtattattcaagttagagttaacctgaatcagtcacaacagcctgtggatggttgctataagggttagaattaatccttaggtttgcaagagtttgtaaacattgttgttggctctgagttgtagtaaagtgtttagagaaaatcctactgggtagtaggtcgtgattttttcaccttttgagacgggtatttttcacataaatatctttgtgttttttactttctgcatttattattctgcaatagtagtataaagaacacatagaagaactaggtccttttataatctggtgcacgcaaaaaattagacaccacataaatcacctccctcttgtgtggtattgaagtataaaacatcaattggtatatgagtgggttatccttgaagaggctaacactaggatttgaacattctgggtgccataaattttgaacgtagacatatcataatttatatgctccaaatagggtaacatttagtcggttttatctatttgtatttctctcacgacctggattttccaccatcgggagttgtaatggcgcctactagtgaaagctaggcaagccaaccattgagcaatttacctttttcccatttttaatactttaataatgataaactaacagtttataaacagcgaaatttaaataagcggaagaaaaacaaataaaatcatttaattatttccaatacaatttcttaaataaggactacccagaactggtgtcacaacttcacagacggtctaggaatacaataatcaaggtctaaaaaataaatacaacattgtttctgaaacacgtaaatgaaacatgacaaaaggatagagggagatgccagggcctgcggacgcctgcaggactatcttggatctctgtatggactgaaggcagcaacccaaaagctaaggtccaaaagttattgcgtcgggatctgcacacagtgcagagtgtagtatcatcacaactgaccctatgtgttggtaagtgcctagcctaacttcggcgaagtagtgacgaggctaggaccagactaccaaataaatctgtgcagttatatcatatatagaggaaaataacagtaggggtgtacagttaagaatgggaggggggaacatgttgcgtggaaacatcaaatgataatagaaggacaacaggtaattacaaggaacatcataactcaattatcaacaagaatcagaaatcaaacaagtgcacgatatcacccttcgtgtttttactctcgtcctcaccataagagtcaatataatgtacacgacatcactctacatgcttttactctcatcctcaccataaaattaatataatcggcactgaattgtatatcgtgcggcacggcatcacccttcatgcttttacactcttcctcacaaaaattatacacggcatcacccttcgtgctttaacactctctcaccaaaacaatgtacgacatcacccttcgtgctttactcttcctcacccaatcaacaatcataaaaaataatggaaaggaaataaatgaaatcataataaaatcccagcaaggaaataatagtacacaatcatatcctggcaaggaacaatatcaagaacatcaatatcccggcaagggagatagcactaaaagcaacaacatctcgacaagggagacaatataataatcctcttctctttttcacgtttacttcacaactcactacacaacttgagccaatgctctattaggttcaattactaattttacttccacaattcttttacaacttgagccaacactcctcaatattcaattaccaacactacttccacaagctttgctcaacaatgaaatcatcattaaaggcatgaacaatacaaacaaagtcataataatcataatataagactcacgggcaagcttgacaccaaggtgtagatactctgtacgcggcaaaatcagaagacttgatttctggctgtcgagtcatttcggaagcatgccttgggaccccgaggatgggaggccacaatcgagttcccaacctcggggctcattgaagcctgactcataagaaatggagatcgaagccaggacagatggggaagctcccaaggcacacgactaattctgacagggccggcctatccagagcctatgttgaggcatcacgtcaagccatcatatccccatactttgtaattaatctctacatacttgtagtcgagtcccccctcttatataaaggggactcatcctaccttgtaagggcctgatgttgctccatttctccacaagtgcaataatatatctctctcttttctttctagcttgttcatcctcactggcccgaggccgctttaatatatatcgtccttttacttgttcttcaatatatagctcattattggctgaaaagagccttgcttcatcgtatccttaattgttatcccattcctggctgcccccgatagctcgagcccgactcaaacctcgaccccgaggtcctctctgaccggtcctgcatccgggcaacaggccccttcggtttctttactgcctcattttagctcacacttcatcgttaaacctcacaatcttagcatcatctgctctaacaactagctcgagatcatgtatttttagaatctcatttacaaatttaattgttgttaccattttcacggtaaacagtttggcgcccaccgtagggctaaaaataatagtgattattttattgctggttttattgcacaaatacacactatctttcacactttttcttgtccaagatcctttgatttcaggttaaaatgtccggctcggtaagcaaagtcgagaatgactaccccaaaaatcacgacgaaaatggtatggctgttccagtggctggcgtgacaccgcagtaccccgataacacatctggatcaattcaagcggacgcgggcttgcaaggcgcacaataggtcgatgaagcctcgcgcaccgatggtagcatacaacatatcgaccaacaggaagctcaaaaacccccggcctgggaagaataggaagttagtattcatgttatttttggaatgttgcaggcatagtagtttgctatcgctcagctgcaaagccacccagagactcccagcgtagtagccccgaaaacatctccctacgccgagcgagtacccgggagatcaagcaacaacggatcggtaaccgaccccaggatgcttgggaatctcttcgaaaggatcgagtcaggttcgtggaagttcttacagcaaccgtctcctaaggaagcggtcccggaactctcttcacggaaatctggaacgccaaaactccctaggtgcgataggaccttgggtccctacgagcgcaccaccgcttacacgtgcttattcaaaggcagagacctccataatgatgagtgtgagtctgactcattgaggaagttcgaggaaacactctcgaaaaaaaccttgatgcagcaccgcagcctggcacctggcctcgcaaactcgcttaccatatcagcagaccactccacgggagcacacaccgatgttatcgaagcagtaacaaaagggctcgacacacctggggctagacaaagagagagtgaagcactacaagaagtcgcgtctcgttccctgttaggatgaatgagatcgctcccggtttcggatgactggacaacccgggcctccgcccgaaggttaaacgaaatatgcccgacgactccaggacatttcaaacaaatcctgaccagatacccagtcgagatatggtcggatacacgcacctgacactatccacggagcagggccgtggacttccgtccaggaacctcctcaggtttggtatgccgacaaagaagatgatgccaaacaaatggaggtaccctccatgcaccgcgaatggaaggaacgacatgagttgttacttacctcccaatgatagagaaatagctcgagggaaacatccccgagaaatctccaatggaaccagatttgacaaggcacagctagcaggggaaccccgctcagctaagtacaatttcaacattgctttaccgaacatcatgatcaccttaagctaaaacaagaacgataggcgactcaaacctattctaccaagaccccttcaaaagaaccatagcccgacgcagaaaccgtagggcgcgcacagctacggagtaaaaaatggccacccgctcaaaagaacgacaaccgtgctattcaataaaaatcaccaccgagtatcgtcgagcggtcaggctcgaatccaactccaagggaggaaggagaccgggaagaatgaagatgacaagccacgatgtattaccacgacagtgaaggggcggcgacacccttcaaaggccataaaatgtaaagtgaaaatgctcatcaccggggaaacactggtctggggaatattccaaaggacacccttgcttccaaggaaagggacgccgagacttcgcctcggcctcgtattgatgtgttggtaaccctctcactcatttgacctattccaaataaaacatgtgttcatgaatacaggttgttcaattaattataccaacgatgtcaaaccaaagccaatggggcgattcggactaacgaaccaagtcactcccacatctcgaatctttgacagattctaggcaccgatcgccacatcaggaagaccactcccttaatacaacccgtatcagctcggactggaatgccgaacacgcaaggcacgtacgtcttattcagatgacaacgggcacgcctccccggaggcaacttcgaccctactccaccaaatggatgaaaccccaggacaagggtgggactaaagtattcgacaaggagctgcacacgacgagaggaaaaccctcaccatgtaacgcatcgccggcatcaatacgtccgccctcaaaaggatcaaagggtaagcagaatcgcatcttctgctaagcttggttgaacacagcagaaggctgtattagggctcgtgcctcggaacagcagaaacatcccgaacctcgaaaggttacctacgcaccccgcggtgaggaggaactacttcactccttcattattttttcactaacttatatgcaggcaatcagccggggcattcgaaagttctaactccacacggagatccaaggccttagcagggcccgttgtgctctattccctcgatcagactttagacccaaagagggtcccgccaaaaagattattagcagagcagtgtacccccaaagagggtcctgccagcaggatacgacaaaatcacatgccttcttctacaatcgaacgacgggcgatgatcttctttcaagggcaccattccctcagaaggaccgaaaatatcagactgagtgtcaagagggaaccttgtaacgaatcagatggtccgaagagtcgtacctacgtgggccgagctcacaacgacgagagaacatgtatttacaacatatatttatgacaagtaataaagaatatcttttcggcatttcgtacttcggaaaaggggatttcaacatactcatggcaagggcctctctaccgaatgcatcccgagatactcggagacttagcatcagcaattcaatacccgcacgaccccagggttagaactccgggctcaacaagcccctacaaggcaactccgagctcatgaggagcggtcttcaagcttaaacaaattatatgactcagagactgccattgatcgtcatatgctggaaaaatcgaaactgtgagacccctagcaggcagcctcaacgtaaccagatctattatatattacacaaactataagaccttaacaggcatgataaactgtaagacctcaacaggcatgacaaactataagacctcaagaggaatgattaactgtaagacctcaacaaacatgaaaatcctgaagtttaggttatacgtcgcatgtgtaaaaatccctaaagggcataccctcggtgtagacacctaaactatcaatcgggattaaaaatggctacggccaaacgcacatgactatgatcaaaacggttaatacagccaaaataacatgactcggggacacccgactgttactaaaatctcaggacactactccaaatatacttcgaaaagaaccggttaaaatagggttcccttaacaggcaaaaacgaaccccgaccatgtcgactccaaaccgccaaagtgttgatctactcaacctacgagctatgaaccttttgaggtgctcaaaacatcgccgacaacgacttgaaatcgaagttcctctagaaccgaagacgggtcaagcaaaaatattccaaaagaccttaacgagcagaaaacaaagcctacaaaaaagcccacaggcaaaaacagcgtaagagccattgtcgccatctaagcaagcctccgggccatatattaaaaggtctctacgaccaaacagcgtaagagccattgtcactagctaaaatttgacaacttgaggattaaaatgagctcaaatcgtaacccggttcagagatcggatccaaaatagttaactatgcaaacctccgagccacatattgaaaggtctcaacgaccgaaatagcgtaagaggcactatcgtcagtctgaaaaccagaggtacttaagggtcaataaaagatcaagtcacaacgcgactcggaggcttgacccggaataattaaactacaatatgcctaagggcacgacataaatgccactatcgccagccgagcaaatctccgggccatgtgccagtaaggtcatttcgacccggagcacaaaaggccatcatcatccgcctatgcaggcaggaaagagcttgagggtcaattgaagctcgagtcacagtacgactcggagactgaatccaaaatagtcgaaacggcaaatgcccaagagcaagaaataaaaataattaatgcctgcccgagcgggcataaaagattcaagggcaaaaggcttgagacgaagcccgactcagagactaagcctaaaacagtcgggccaagcatggaggccccagcaccagctcacgtaagggattacacttaagagcccctaggtctatccgaccagttccggacctacgaggatcccgccaaacaccaaaaccggcctgcccagtcgaaaagcaataacaaaaaagaggtacagaaaaaataaagcttcaagtttcttcctacatattatatgcgcgaaaagggcgcattctccatctacaagcatgctctacatatatcagaaacaaagcgacaaaatggcgaaatctacactccgcactaaagggctacaacttgtcaaattctccctccgcgacgtcagcaagaagttacagagcgtcgcgctcatccacccttgctcgagccaattctttcgagagaacgaagccccgtacactggcctcctcgagtacctctctccgagatctgcaacgaacatactcctcgatcctcttctcccggtcgagggctcgctttagctcagcttgggcatcagcaacatccttcatatgaatcgccatctcctgatcagccttggtccggcttagcgccactttagcctgggcattaattatctcagctctgaccttcaagagatcagattcgagtttcccaatcatgtccgcttgaactttggcgttatcacgagtcaagcagagttgggcctcgatggcagggaccctggctgaggcacatatctcctctaaagctcaagcttgctcttgagcccttagctccccacaaacaactctgacgcggttgacgtcgcctttgaggtactccaaggcctctgcctttttttgcagctgatataacaaaaggggtgagccttaaggttagagaggagcaaagcgcatactatataaagttacctgctctatcaaacaactctcatagtttgagctctgatacgcctcatatcgccaacgtgccaacttagccccattctcttggctaaggagcctaaaggactcgccatcgttcaagaatttctggagcctggccccttgacagagcagcttagacataagcccatcacaggcctatgcaaggaaaactcaataaagggaggagggcgtgacatacaggaaaaaacgcgcctaaactcacctcgaagagaagccgatggacttcctctaagccagaacacattcctgttgatcctgcctctccggccccaggagaaccaacctcgggcagagcatattcactcggaggaatcgccgcccgggaatctgatactccgggaacatcaggctcagacgatgccctctactcaaagatctgagcccgcccaatgccactaaaagctccatcacaccgcgggtgccgatcccccttatcaccatcctccctcggcttggaggctgacgactctttctcctcttcggaagaacactgtctcatcccaaacaaccgccctgtatctacaaacggtgaatccagtacaaatgaaaggggaaaatattacctcgaatatacgaaggccaagtcaaaggcaacatacgcacataccttggtatttcactccccatttggtacgaaatacagctcgccacctgcgctcgtcgcaagtcgaatgggtcgccaacttatggacccagacgggaaggtcaaggactttgcccggcatccacgaagttgctgcaacaaggtagacaacattattactcaactgattttcgctataggcaaaatttaaaaaagcgccagacactccactcacgtgcatgattccacccttcaggaaatggcaaaagccctgttgggataatgtcagcagtttgagcctgaataaaccaactggcccactctcggtccttgtcttcttcatcatcgacaacaaagggcgtggacaaacggcacctcagagttagcaggcctcgataatgaaatggccggtatagtctaacgaggtgattaaacgtgaattcgagcccaaccttctccacgaagaacctcattatcattaccattcgccgaaacgatggataaatctgcgccagagtaactcgatacttcaagcaaaaatcaagcacaaccctagcaggggggccaaatgcgaaagggtataggtatacgctcaaaactccatcagtggagtctgtaatacccttatttggagaaagcacctgcagtgttaccccctcgctccacccgcagtaattcctcaccatctccaggtgttcccctcttatcaaggatgccgtcttcaaagcaaactccttcggttcttgagcgctgggagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccccccccctgttccctgccgaatcggccctgaagtggtttccatgactatggtaaaactaatagttcaaagcaagggcgtgcaccagcactttttatnnnnnnnnnnnnnnnnnnnnnnnnnnnnnnnnnnnnnnnnnnnnnnnnnnnnnnnnnnnnnnnnnnnnnnnnnngcctggagagatgaagtaccctgtgccaaagcaggaaatcgtctatctaaaaatagtgaggtcttgcgaagaagccgaagccgccccacatatatgcgagaagcagcgacgactcgcctacccgatgcgagacccggggagccgacagcctcgatacagatcgacaaatcgatacccaatctagatagaatccttcaatgagaagtcaagacccgaggggccatccatattatctccaagctcgagacaacatcctacctcgaggatccctgacccaaagaagtcggacttcgggaagttttgtaacaccagcactcgatgcagggcaagtacctggtctcgtgattccctctttctaaaaagaggaataaatgtaggaagctccaatctcgaaagctccacaaaggtctgaggcagcaggaaactcctcagcataagtctatcctatacgctttaaaaaagggagggctatctacatcaagattaaaagggaccctcgggtacctgaagctgaccttcatttaggataacattcccgaaggctccaaaattcgacgcattatctccatacagctcgaagggcctcggtagcccgggcctatcaaatcaatctgggattggtctgaagtacgacgatgagttcgaaagagagccatgtcgatcagtagaggatcggaaggaatgtccgcgcccaagtcacatatcagtagtcaacgaataaaagaaggcattcaaagggcctcaaagggcatgagatgatacagaaacaaagtaaagatctaaagcaaacgtcactggagtatattccatttcataaaagatccatttacaacaaccctcaaggggacattacatacaattacaaaatcctacggaggatctctgcgcctaaaagaagagacaaagggatgcacacgccaagtgaaagcccgaaagactggtccacctttgaactccgcaacaggtgcctccggacgtgcatcctcgaaagtttcatcccaaccttccacactgatatccccaagggacaaggtgagtggcggggagggatgaaaaaatggcatagctctccgaaactcgaggaccctctttggccaagggaactctggagtgacatcggaccaaacaaaccttgatcccgcttgcacgactacttagaatccacttcttggaacgtctagccatgcaagcccccaactcggagcggagcaccacatcgagctagggtatgaaggtgagaaacggtgtttaatccgagcccccttttgagcagcggtgcataatccgaatgactgtctacacgaggggaaaattgaccccccttccatcatcatctcgggccaacaacaatagccacagtgaatatgttaacggccacagtagtagcgggacaacatggttatgctcaacgaagggaagcccctgcaaaaggccacgacacagtctaaggaaactcctccaaaaggacttaaggtcatgagcccctagcatgatgttcaagggtgaaagaagatgataagaagaaataggcaagcaagccaacggaggcactgtgataggaaaagcaaagccaaggcacccccatttatagggggttacaacacgctcatctaggctttggaagattgactgacgggcgcagtcaatgcatccatggaaaaccaaaccaacagtggtaccttcaccttgggaagtgagaattaggagtacaatgaatgaggtcagaaatcacgagctcgtggatgtccggttaccacaaagctcacgaccagagtcgcatcatcgatatggcatcgccgaaagaagctcgaggagtcgagtgtcaaaatcatttcccatcacttcataataggaaatgcggagacaatctatacacagcaaaattagaagactttatttctcactgttgagtcatttcggaagcatgcctcgggaccccgaggacgagaggccacaaccgagttcccaatatcagggctcgttgaagcctgacttagaggaaaaggagaccgaagtcagtacagagagggaagctcccaaggcacatagctaaatctgacagggccggcctatccagagcctatgttgaggcatcacgtcaagccatcccatttacatactttgtaattaatctccacatacttgtagctaagtcccccctcctatataaaggggactcaccctaccttgtaagggactgatgttgctctatttctccataagtgcgataatatctctctctctcttttctttctagcttgttcgtcctcactggcccgaggccactttaatatatatcgtcctcttacttattcttcagtatatagctcagtattggctgaaaagagccttgcttaatcgtatccttaattgttatcccattcccggctatccccgatagctcgagcccgactcaaacctcgaccccgaggtcctctccggccggtcctgcatccgggcaacagaccccttcggtttgattactgcctcattttagctcgcactttatcattaaacttcatgatattagcattgtttgctctaacaactagctcgagaatagatcacgtatttttagaatcccatttacaaatttaattggtattaccattttcacggtaaacatactcgtcactatgtctatacgtcgtactcaacaaatagaacatagcaaataggacacaactcctaatccctcaagctaaggttagaccaaacacttacctcgatgtcaattcgctcgtatctagccacaagttacttaactatatccataaatgctaaatgaatcaattccaatacatgaaaataggttttctaaagtttttcccaaaaagtcaaaaatcgcctccgagaccacatggtcaaaatacgaggttcgaaccaaaactcgattaaccaatcccccacgaacccaaatatacaatttgttttgaaatcggacctcaaatcgaggtccaaatccccaaaatttgaaaaacctaggttttaccaaaaatatccaatttcccccatgaaaacccttgattttgagttgaaatcatgagaaaagatgttaaagaataataaaacaagttataaatgacttacaatcgatttgcaagagtatttgtctttgaaaaatcgcccaagagagtttatgttttgaaagggtttgaaaaatggttgaaatgcgtctaagtaatgaatttgcaggtcgcagatgtcgcaattgcgacaagggttcgcaattgagaacccttaaggacttgctacactcgcatttgcgaccattgttcgcaattgcgaaatcgcatttgcgatggggaagtcgcatttgcgaccatcgggatttctaggcctcttcgcatttgcgaagaaatgatcgcatttgcgatcagccctgcccaggccttctctcgcatttgcgatgggttattcgcatttgcgatctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttgcaagccaggcttcacaaatgcggagcctgcagacctgcaacatgctagctaaaaacctgcaacttctcaaatccaaatttcactatgtggcatatccgaaactcacccaagccctcgagactccaaaccaaacatgcacaccaacataaaaacattatacggacttgctcgtgcaatcaaatcatgaaaataacatgtaaaactatgaattaaacctcaaaactcatcattttcatcaagaacacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcttcaaccggaggtccaaatcacgtcaaataaactctattttttaccaaattttatagttaccatttaaatattttaacaagtttgtaccgggatctggaaccaaaatacgggcccaatgccaatgattttaaacattaattcttttctttatttcataaataattcagcaaaacaatttctttcaaaaattgatttctaaggcttgggaccccggaattcatttctagcatacgcccaagtctcatattttattgcggacctcctaggattgtcggcatatagatccgagtctgtttgctcaaaatgttgaccaaagtcaaccaaaatcaaattttaactctagaaatttttatttctcatattttcacataaaagctttccagatatacgtccggaccacgcacgcaaattgaggtaaggtaaaaaggaggttttaaggcctcagaatataggatttgtttctaaaataagtgatgaccttttgggtcatcacatcctccacctctaaaacaaacattcgtcctcgaacggacataagaaggaagtacctaagtcggggaaaagatggggataacagctccgcatattggactcggactcccaggtcgatgcctcagcaagctgacctctccactgaacacgaacaaaagggaaactcttcgatctcaactaacaaacctgccagtctagaatagctactagctccttctcataggagaagtctttgtccaactggacagtgctgaaatctaacacgtgtgatggatcaccgtgatactttcaaagcatggacacatgaaatactagattcacgattgataagctcggcagcaacgcaagtctgtaagccacctctcccactcgatcaagaatctcaaacgggctaatgaacctagggctaagcttgtccatctttctaactatcatcacgcccttcataggagacttccgaagcaacacccgctcacccaccatgaacgccaaatcacgaaccttatggtcggcataactctttttcctggactgagtattacgaagcctatactgaatgatcctaaccttgtccaaggcatcctgtaatagatgcgtacccaacaaccgagcctctctcggctcaaaccatccaaccggcgactgacaccacctaccatataaagcctcataaagagccatctagatactcgactggtagttgttgttgtaggcaaactccactagaggcaaaaactgatcgcacgagcctccaaagtcaatgacacaagctcggagcatatcctccaaaatctgaataatgcgctcggactacccgtctatttgaggatgaaatgttgttcttaactcaacccgtgttcccaactcccgctgaactgctctccagaaatgtgatgtaaactatgtacctctatccgaaatgatagacatgggcacaccatgaaaatgaacaatctctcgggtatagatctcagctaacctcttagaagaataggagactgccaccggaatgatatgtgctgacttggtcaacctatcaacaataacccacactacatcgaacatcctctaagtccgtgggagtccaacaacgatgtccatagtgatatgctcccacttccactcaggaatctcaatcttctggaacaaaccaccaggcctctgatgcttgtacttaaactattgacaattcaaacatcgggccatctatgcaacaatgtccttcttcattctcctccaccaataatgctgccgcaaatcctgaaacatcttagcggtacccgggtgaatagagtaccgggaactatgggccttctctaaaatcaactcctgaagcccatccacattaggcacacaaactcgaccctgtagcctcaaaactccataatctcctaatgtactttgcttggcacctccgtattgcaccgtgtctctaaggacacacaaatgaggatcatcatactgccgatctcggatacgcttcaaaaaagaagaatgagcgactgtgcaatctaacacacggtccaacctcatgaactgattggccaaagcctgaacatccaaagaaagtggtcactcaccgacctgaatatacgcaagactgcccatactagctgacttcctactcaaagcatcgggcaccacattggcctttcccagatggtataagatggtgatatcatagtccttcaatagcttaaaccaccttctctgcctcaagtttagctccttatgcttgaacaagtattgcaaactcttgtgattcgtgaacacctcacatgacatgccatatagataatgcctccaaatcttcaacgtgtgaataatggatgctaaatccaaatcatgaaccagatagttcttctcatgaatcttcaactgatgtgaagcatatgcaataaccttgacatcctacatcaacaccgcaccaagtccaatacgagatgcatcacaataaactgtttatgtccctgaacctgtgggcaaaaacaacactagcgtcgtagtcaaagctgtcttgaacttctgaaagctcgcctcacactcggccgaccacctaaattgggcacccttctgggtcaacctggtcatcagggctgcaatagacgaaaacccctccacgaactgatgataatagcctcccaaacccaagaaattctagatctttgtagttgatgctggtctaggccagttcttgactacctctatcttcttaggatctacctgaataccctttgctaatacaacatgacccaagaatgcaactgaacttaactagaactcacactttgaaaacttagcatacaactgactatctctcaaagtctggaggaccactctcagctgctcatgctcctcccgggtgggagaatagatcaaaatatcatcaatgaagactatcacaaatgaatccaactaaggactgaacactcggttcatcaaatccataaaagctgttggggcatttgtcaacccaaatggcatcaccaagaactcataatgcttgtgccaagtgcggaaagctgtattagggacgtcagatgccctaatcctcaactgatggtagccagatctcaagtcaatcttcgaaaataccttggcaccctgaagctgatcaaacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccttgttcaactgtcggtaatctatacacatcatcattgatccatccttctttttaacaaataacatcggcgcaccccaaggtgagacactaggtctaatgaagcctttttcgagcaagtcttgcaactgctccttcaactcattcaactcaggcagggccatacgatacggcgggatagaaatgggttgagtgcctagagccaaatcaatacagaagtcaatatccttgtcgggtggcatacccggcaggtctggaggatatacctcaggaaactcacgaacaataggcacaaaatcaatagaaggaacctcggcactagaatcatgaacatatgccaaataagccaaacacaccttctcaaccatacgtcgatccttcatatatgagataacactacgggtagaatgaccaggagtccctcttcactgtaaatgaggcaagcccgtcaaggctaaggttacagtcttggcatgatagcccaagatagcgtggtaaggggataacatgtccatccccaatatgacatcgttcagacgtaacaaatctacatgagtctcaagacccccaatcacaactatacacgaatgatgaacacgatctaccataatataatcacctaccagtgtagacacatatacaggagcacttaaagaatcactaggcatgaccagatatggtgcaaaataagagtacgtagatcttggatcaaatagaactaaagcatctctactacaaaccagaaccgtacctgtgataactgcatcggaagccttagcctcaggcctcactagaagagcataacatcggggctaggccttaccaccttgaactacatatctgggacagcctgctgctagctggcctccacctctagcggcttgacctccacctctaatacctctacatccacctctagcacctctacctccacctctagatggctgagcgagctgtggaacactcaatgcctgaaccatggcacgagaaccctgatgctgagagctactcaatgcttgagggcaaaatatagcaatgtgacccatatgaccataagtataacaagccctcggctgctgagactactgaccctgacgacctgaatgaccacctcgaaactctggagcggcgaggcactgataggagcttgcggtgcactatagtactgttgatccgaatactgcatatgagaatcacggccacctgaaaaactgtgagaaacctgaagtgttgactaaaaaggcctaggatgatggcatctaccgtacaaatccctgcctccagatgaggccccactaaatctgcctaaatgacgaggcctcttgtcagacccctgaccacctccctgtgatagaactatctcaactctcctgtccacattggccgcctcctaaaaagaaatctcactctccgtctccttagacatctaaagtcgaataggttgaatgagtccctcaatgaacctcatcactctctctctcttagtgggaagtataagtaaagcatgatgggccaaatcaataaacctggtctcgtactgagtaacagtcataaaaccctgctagagatgctcaaactgcctctgatggatctctctctgagtgatagggagaaacttctccagaaatagctgagaaaactgctcccaagtcaaagctggtgacccgtctggtctagccaaacaataatctctccaccaagtcttggcggatctagacaagcgaaaagtagcaaagtcgaccccattggtctccactatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgagaacctcatgacagctatctaaataatccaggggatcctcagaagatgcactgctgaaaatggtagtaaagagcttggtgaacctgtccaatttccacaatgcatcggcagacatagctgctccatcaccagtctgagctaccatgcccggctgaacttctccaactggctgagctgttggagtctgaaactagggagccatctactccggagtgcgagtagcaggattctgggctcctcctctagctcgagagatggctggtgctacaggaagcaagcctctccataaggcccaccagacggactagagcatcctagagcactggtgtagtaatgaacccatctgggacctgatctgggcccaccggaactacctaggccggaacctcatcatcaaactcaacctgaggctccgccgctggtgctactactttgggctaagctctgcccctactacggcgtctagcacggcctcggacttgccctacgaacctcgtgggagctgctgctaggggctcggttgctgatcagtggatgaggaagcgcgtgttctcgccatctacaaaagaacagagtagaaattcaattagcattgagaaaccaaagcgtgcaacaggaaattgtgaagtttttcctaactctgtagctgctgggatacatacagacgtctccgtaccgatccctcagactctactaagcttgtccgtgagttgtgagacatatgtaacctagagctctgataccaacttgtcatgacccggatttcccaccctcgggagtcgcgatagagcctactgctgaaagctaggcaagccaaccattgagcaatttacctttttcccatttttaatcctttaataatgatgaaccaacagtttataaacaacggaatttaaacaagcggaagaaaaacaaataaaactatttaaatatttccaatacaatttcttaaacaaggactacccaaaactggtgtcacaacttcacaaacggtctaggaatactacaaacaaggtctgaaaaataaatacaaaattgtttctgaaatacgtaaatgaaacaggacgaaaggatagatggagatgtcagggcctgcggacgcccacaggactaccttggatctccgtatggactgaaggcagcaaccccaaagctaaggtccaaaagctactgcgtcgggatctgcatataatgcagagtgtagtatcagcacaaccgaccccatgtgctggtaagtgcctatcctaacctcggcgaagtagtgatgaggctaggaccagactaccaaataaacctgtgcagttaaatcatatacagtggaaaataacagcaggagtgtacagttaagaatgggaggggggaacatgttgcggggaaatatgaaatgatactagaaggatagcaagtaattacaaggaacaccataactcaattatcaacaagaatcagaaatcaaacaagtgcacggcatcaccctttgtgcttttactctcgtcctaaccataagagtcaatataatctgcacggcatcatccttcatgcttttactctcgtactcaccataaaatcaatataattggcacaaaattgtacatcgtacagcacgacatcacccttcgtgattttacactcttcctcacaataatcaaacacggcatcacccttcgtgctttaacactctctcaccaaaacaatgcacaacatcacccttcgtgttttaacactcttcctcacccaatcaaaaatcacaagaaataaggacaaggaaataaatgaaatcataataaaatcccggcaagggaacaatagtacaacaataatatccaggaagggaacaatatcaagaatatcaacatcacggcaagggagatagaattaaaagcaacaacattccggcaagggagatagcattaaaagcaacaacatcccggcaagggagacaaataataatcctcttctttttttcacgtttacttcacaactcactataaaacttgagccaatgctctataaggttcaatttctaattttacttccacaattcgtttgcgatgggttattcgcatttgcaatctcgcatttgcgagccaagtttcgcgaatgcaaagcctgcagacctgcaacataccagctaaaacctccaacttcccaagtccaaatgtcactctgtggcctatccgaaactcacccgagccctcggggctccaaaccaaacatgcacaccaacctaaaaatatcatacgggcttactcgtgtaatcaaatcatgaaaataacatgtaaaactatgaattaaacctcaaaactcatcattttcatcaaaaacacttaaagttcataactcttcaatcggaggtccaaatcacgtcaaataaactccatttttcatcaaatttcacagttaccatttaaatactttaacgagtttgtaccggactccagaaccaaaaaacaggcccgatactattgattttaaacattaattctttttttatttcataaataactcagcaaaataatttctttcaaaaattaatttctaaggcttgggacctcggggttcatttccgggcatatgcccaagtatcatattttactgcagaccttccgggatcgtcggaacacagatccgggtccgtttgctcaaaatattgaccaaagtcaaccataattaaattttaactctagaaatttctatttctcatattttcccataaaagctttctggatatacgtccagaccacgcacgcaaatttaggtgaagtagaaaagaagattttaaggccttggaatacaggatttatttctaaaataagtgatgacctttcggatcatcacaatttcgatccaaaaagaaattgtgtaattatttatgataacttggtgaaaaacaaaataaactcagtcgaagtatacatgattttaaataaaaagaaaagtgtatgtattttgtacaagaaatagtgactcactaataacaatgcataattaaatactctacggcaaaaatttatactaataagcactttgaactttgaaacagtagcaagtttcgagacgtttttcaactcaccatttttcatgaaaattgattcatttgagattattatgtataattgtccttctacagaataatctgacaaaaaaatataactccaatccttgattaaattagtaacttattcaagtattttattttctaaaaaaaatctgtaaataagttaagtggagttatgctcacaaagaaaaatatttaattttccattatttattgataaataattgaaggagctaggaaagcacaatagtagggatttctttcttacgagaaggggtgatgaagagaagccattttcacagccatcttcacacagaaaagagaaggacgaagaagaaatatttcagacagacacttagcttttcggacttctctatattgtgttgaagtgcccaagtgttttatcaattgtagctcagccttacccgtggaagaattatggagggtcatgatcttttattctcaaccatctgatcaatatttaaatagttgtacttaaggaagcttccaagaagccaaactcatgtgtttctcgcttgagcacatgggaaagaatattttttagttttctgttacatagtagacaaataagagtagtacaagtgtataggaatattctttattttttattttactgtaggataaatctatataattagggatttacattatcaatacaaggcagagaaatttcacaattctttcctattttctttcatggtatcagagcagtagtagatcgatccaaatttccttttttctcagaatatagtattcaactatggcaggagaagaagttcctccgactctttttactcccattatctctggttcaaccattcacaggatgtgaatcatccttatttcctttactcgtctaattctcctggtttgagtcttgttaccacactatttgatgatagaggctttgagggacggaggagattaatttttgtagcactttaatccaaaaacaagataggcttcataaatggtgtgtgggaaaccaaaacctgatgtacgagatcaccttcaatggagcagatgcaacttcatggtgacatcttggcttctgaactctttatccaaagagataggtggcagtatcatctattcataatctacaaaagatttgtggaatatccttgaacacagatttgggcaaactaatagagccaagctgtaccaactgcaaaagaaaatatcagtgttagttcaaggtaacaacagtattattggatactttaccatacttaagaaattatgggatgaacttgactccctcaactctcatctagtctactctagtaactgagtttgtgatggaaaaagaaaagtcacaaagtttttagaagaccaaaggatcattcagtttttaatgggactaaatgatgtctattcccaggcaagaggaaacatccttatgatgaatccattgtctagaatagatttttcttattcacttcttctacaagataaaaatcaaagggagatatatgcaagatcacagttcaatgctgatgcttcctcattcatggtaggagttcaaggtaaggctccacagaaaaacaacaatcagtcacaacaaaagtcatggactaattcacaaaaggttaataacacacagcagaaacctaagggaaggaaagcaaaatttaatcctaatatgaactatacatattgcatgagaattgggcatgtcagggtagattgttataggctaaatgggtttccagatgatttccaattcaccatatcaacacaggtcaaggctaatgctatagttaaaggacaagacaatgacaatggaagcactcaaagcaatgatggaacaccttaaactcagtttttcagtaaggaacatatgtctgagctgatgaacctaatcaagcaggcacaacttggaaatatagcaacattaggaactacaatcaatgcaaatgcagtggctgatacaatacttaaatatactaaaacttggttggcagctattaacacaaaaacctggatcattgatttaggggcttctgaacacatgtgttttgattcaaattgtttcttaactttagatccacttcctattcctgtatatattagcctacctaacttatttcaattatatgtcaaacacataggtagtgttcctattcagtctaatatgattcttgaaagggttctttatgttccttctttcaaatataatttactcccagtccataagttgtgtgtccagttttattgctcactcaatctaatttctagtggatgcatcatgcaggtccctttaatgaagagggacaagtttttgatgaattaagaggagaattgtacctgctggaacctagtacacctaaaatagattctggttttagtttaaataccaatatattttcaattccacaaggaagtgattccattctagttcctagtgaagtttcttgttctgtttctaattccaatatagaggtctccaatgtactccaatggcatttttagattggggcatctgccatttttagtaatgaaaaatcttcaattcatttattttccttccaatttcaattttgtgtgtgatatttgtccaaaagctagacaaactagattaccttttcccttgagtcaaatcagaactcatggaattttttatcttattcgtattgatgtatgaggaccattcaaaagtactacttacaatggatataaatatctcttgaatgtggttgataattttagtaggggaacttggactttccttttaagttccaaaagtaatgatttcactatcttacaatctttcttagttatggtagagagacaatttgcaaggaaagttaaaagaattagatctgataatgcaataaaatggggaagggatcttttcagtctgattttctttagtctcaaggcatcttacatgagacttcatgtgtagcaagtccccagcagaatatggtagttaaaagaaagcataggcaccttttggaagttgcaagaggattttattttcagtcacatgttcctatccaatactagggagagtgtattttgactgttacatatctaatcaataggtttccttctagagttctaaaaggaaaaacaccttttgagattttgtttaaaaggagtccacagaatgaacaactcaagtcctttggatgcttatcttgtgcctctactctaacacaaaacagaagcaaatttgatcccatggcacacgcttttatttttctgggatatgcacaacatcagaaaggatataaattgctagagttacattctaagaaggtctttacctcaagagatgttaagttccatgaagcaatttttcttttgtttctgctgctccaacctcattctctcctttcccccttatcttttcttccctcacccatctaccactactgaaactacttctcaagatttcctatctcccaactcaaccatcaatcattagtcacactcacatgtccctctatatccaaatacttctgagaatagcacccttatttctctcaataatcctggaaatcctgtatctattaccagctccccagattctccttttcataatccatctcatactgattactctatttcacagcctacaatcccaataccaccacctcctcttagaaaatctgagaggatttcccagaaacctacctatctcaataaatatgtctgcaatagcattgttttctctaatcttacctcctcctgtttttatcatatttctcaccctaattgtcacgaccctaaatgctcggtcgtgatggtgcctatcacaatactaggcaatccaacccaaaccatcaaccacaataatttcttttataaaaaccatttcctaacattgatttaaatctcaaattctcataagaaatgtataaaacagctaaaatgtgtggaatttagtaaaacattaaaccaacatagcctaaacatctggagtcacaagtctagagcctctaaatatataaatccgactatctaatacataacaagtctaaaatacagaaaaacaaggataggaaggaagaaagcagggctgcggattccatgcatctaccttgcagtctctggcaaactctgacaatgctgaggaccctcactctgccgctcgggcacctagatctgcacacaaggtgcagggagtaacgtcagtacgccaactcaataagtaactaaagtaaataaggtctgaaagcagtgacgagcagttataaaatcatatagaagagtaaacaacagaataacaaatcaaactcaacggttttagaccagtttcttcataaaacttcagtttcaattgaaatactttgaaatcatttaaaaaatttcagcagggcttattttaaaagaagagtgaaatcagcaaaagtatcataaatgggcccctcgggcaaagtatcactcaaaaatatagcctctcgggcaaacctcttggtcacccatgactcagctctcatcactcagtactcacactcagcactcaggctcaaatacacctcataatagtaataatcataataattgctgcgacgtgcagcccgatccatagtttatagacgactatgcttactgggggtgtacagactctggaggaactcctacagcccaagcgtcatatcgctgcggcgcgcagcccgatccaacatatatatattgttgcagcatgcagcccgatccataatatatacatataatattgttgcggtgtgtagcccgatccgtaatatttataatcctcaccattaggtcctcaacctctgtcagtcattaacctcacaaccactcgggcataacagtagaaatcagggaaactcagttcgaagagttctcacattttaagaagtagaatgataaaaccagttttaaataataaacaggtaaaacatgactgaggatatgctttcaaataaatagagtgaggaaaacagtaaaaatgcccctaagggtttcaacaggtcggcacaaggcccaaacatggcatacaacccataatacaatataaatgtctaaaatatgagattttataagatttcaaatcaagtacgcagcttaatagtcgctacggggcagaccaagtcacaatctctaccagtgcatgcccacacgctcgtcacctagcatgtgtgtcacctcatttatcaaaacatttcgaaataccggggtttgtaccctcagttccagatttacaatggttacttacctctaaccggatgaattactactccacaatgcctttgcctctcgcctcggcctcaactcgcactgaatctacccaaaatcagaatcataacattagaatatgctaagggattgaagcccaagcgagaataatcaaattataccaaaaattctgaaattgaccaaaacccgacccccgggcccacgtctcaaaatatgataaaatttgcatcaacagaatccttatcactccatgagttcatacatatcaaaagtcccaaaatccagtcacaaatgacccctcaaatcctcactcaaaggtcttcaataccaagccctaatacctcaattttcttccttaatttccactaacaccatgattaaacaatggaaaaatgatcataaactcaagtaatgaagcttagggaacttaccaaactgatattcctcaattttcccttgaaatccactgccttagcccatttcccgtcttcaaaaatggagaacttagcaaaacttcacgaaggaaacattatatactttctgacctaggggttctgcacctgcggtccatccaccgcatctgcggtactgcttttgtggtccaagacatcgcacctatagttttccacttaaatgtccaaagtcgcatctgcgatcaaataacaacacatgcgccatcgccggtgcgctcaacataccgcatatgcagctcccacccctcgcatccttgaacgcatctacggcatcgcacctgcggtccccaatccacaggtgcggaaacaacagaagcagaaaaattctgcaacttcaccaaaaaatcaaactcttcgtcaaccctccgaaatcaccctgaggcccccgggacctcaaccaaaagcaccaacaagccatataccaccactcaaacttgtaacaatcttcaaaacacctcaaacaacatcgaatcagccaaatcacattgaaatcaagcctaagattctaaaatatttcgagttttgcttttgatccaaaaatctatcaaaccacgtccgaatgacctaaacttttgcacatacatcccaaatgacacaacggacctactacaactctcagaattccattctgacccctacatcaaaatttcacctatcaaccggaaaacgccaaagtttcaatttcgcaaattcaagcctaaatctattccggacctccaaaacatattccgatcacactcctaagtctcaaatcaccccctcgaagctatccgaactatcagaattcatatacgagccctatttcacatacgtcaacattcagttgacttttccaacttaaactcactcaaaagagactaagtgcctcaaacctcgccaaaatttttttgaacccgagccaaccagcccgataatacatgagacgactagtcgggtcatcacactaatattttttcttttggagacctttctctcaacaatcagactattttcaaatctatctccacagtttttgagcctaccagctatacacaagcttcccaagatcttggatggagaaaaataatggaagctaaaattcaagctcttcaactcaacaacacctggaatgttgtttctttacccccaggcaagaaagaattgccttgtaaatgggtttacaaggttaagcacgaatcagatgggtcaattaaaaggttgaaagccaggttggttgtcggggggacatacaaagggaaggcattgattattctgagacttttagtccagtggtcgagatgaccactatcagatgcttattgactgtagctgtgaataaagggtgggaagactcacaactggatattaacaatgcatttctacatggagatctataggaagaggtgtatatgaaatttccagcttgtctcactccctctcatcctaatcaggtgtgtttattgaagaaatcactctatggactaaaacatgcctcaaggcaatggtatgctcgtttagcaggtccctagcagagtcgctagagctgtcacacctcctttttaccacccccaaaagggatataagggagattttttaaatttaaataacaatcgaaacggtattatttatttaagatcagagtcgccacttgggataattaatggtgtcccaagtcaccggtttagaattctgaatcgaggaaattgactctgttttatagtccgcaaacacaaaaatccgggtatagaattctgttctcctgggagaaggtgttaggcatttcccaattccgtggttctagcacggtcgctcaactattattattggcctatttatctgatcttttacacgttttaaaacctactgtgcatttttaactttttagcccttttaatattttaggaaatttcaaggttatttaaaacgcatcgtaatccctgctatatgaaatgcaattgtggttcacgacacgttctatttaaccttattggaaaggagaatcaggtcacatgaaatgtacacccggatttataacatatttattccattattattatcaaaattatggcagggtcacatgaaatgcacactcgagcccttttaatctagttggcgtagttcagttgatggatagcgactcaattctatactatgacaaaatcatgtttagatataaccaattcgagtaaacacgagcagataaccgagcaagaaaattcagaaccacaaaaaataattacggaaacaacggaatcgcatcaccaaccaaattattaacattaagcttgattaaaacgaatagagtataaaagaattggacctcaatatagccggggaattgtttgtttcaatgtttaacgctcaaaaatgtgacgaaccatggacaaaacccgaattagcaacaaaaactcaactaaacacggattcaaacccatgctttaatcattgttcacgccagaatcaagcaaccaaaataatagtctttcagccttttcagttctcacgttttgaaattagagttcatttcaatctcaaataccccataacacttacgaaatcttctgaaaaaacataaatggatagtgtttcgtttgttgataaataacagtaactatacgaccaaagttttaaaaaaacaaaacgggtggagctgttttggtacttgaagatgactggtttgagctactattttcgtatatttggagctggttctatggctagttgcaacgggggttggaggagaatctaaatctattttggtggctgaaaatgccactacctctgtcgaacaccgaaattctgcgactgtaacaatgctttttaagaagaggaagatgaggcgctgtagctttttttgtatgaagaagcctggccgctgctagctattagggatccaccatttttgggttcaagatggaggggtgtgggctattcatgctttagcacttaagaagatgaaaggcaaagtcgtttggggttgaacggtgctggtctttggcttggtgttgctgatggtgtatgttgatggatctagcggctggggtggaagggtttgaagaagaaacgtgggggggctcgtgggtgtcagcggcggatctgatgtgatttttgggatctaggtttttgttcctcatttcagattttccttaggtccttttttcatttttctgttgtcttttttggctcttagggtcctaggctctatatataaaatctcatcactttaggtcttttagggttatattaggttagggggtatgggcttgaaaattatgggctaggtccgaaaattaggcctaaaatgggtcgttatcccaaattttattctttccgcaaacgagactaaaaacacgatctcatttactaattgatcctacttaagtaaaaataactattaaaataagactaacaattaaaacaaacttattttttggtgttttcaaatatcatattaaaataataataaggtactatttttgtatttttcttaatttttacgaaaggtatataaactaaaagcaactaaaaacaagaaatattttttgtaatttttattttgtgataaaaataaagtaaaagggtcaaaactagttaaaataactatattagacctaaactaaatatttaaatacaaaaatgtgtaaaatcttggggagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctattctatttccctgaatgactattccttattctacaaacacacaaataagaggatatccatcatagtagtatatgttgacaatattctcatcacaggaaatgatgccacataaatacaacttatgactcaatttttgaattctgaattcaaagtcaagaacttgggacatacatactatttcttaggcatggaaatactcagagaacaacaagggtacatagtcagtcaacaaaaatttaccttggaactattggttgagtttgattgtaaagggcctaccgtctcatctcttcttgatccatactccaaattgcacgctgaattagaaccaccaatggaggatcccactctttatcgatgatcggtaggtgaacttaactatctcaccaatactcggccagatatttgttttcttttctttgccttagtcaatttatgcaaaggccttctctttcacatttttctactggtctcagagtgttctgatatctttgatcagacccaggccaaggtatccttctctcttctgctccctcttttgatcttgtcgctttttgtgatgctgactgggctgcttgtaaagattctcgtcactccgtcagtggtttttttattactcttggaggtgcccctatttcttggaaatcgaagaagcaaatctccatctccttgtcatccgctgaatttgagtatcgatccatgagatgggtgactgctaagatcacttggcttgttcgactccttgctgatttatctactcctccaactttgccggttcctttacactctgacagtctggcggcgattcatatcgcccgcaatcccatcttccacgaacgaactaaacatgtagagttggattgccatttcgttcgatagcaatttctcgctggattgatatccctttcattcgttccttaaaaatcccaaattgcagatctctttaccaaacccttatctagggtttctcacaccaacatcatgagcaagctggggtttttgtctctaccctccagcttgaggggggatgatgaagagaagccattttcacaaccatcttcacacagaaaagagaaggaagaagaagaaacatctcagacaaacacttagcttttcagacttctctatattgtgttgaagtgcctaagtcttttatcaattatagctcatccctacacgtggaagaatcatggagcgtactcataatcttttattctcaaccatctgattaatatttaaacagttgtacataagcttccaagaagtcaaactcatgtgcttctcgcatgagcatatgggaaagaatattttttagttttctgttgcacaacagacaaataggagtagtgcaagtgtataggaatattctttatttgttattttacaataggataaatctgtatatatatatgatgactcggccagtcgtctcatgcgttaccgctccatttccaccatttatgcttctttatgctttgtgtatctgtgttatgtggtatcaggttggttgaatcgaatccgaaatgattttggaaaggtttgagacacttagtctcttttgaggaagcttaagttggaaaagttaaccggatgttgacttatatgttagagggcttgtatgtgaatttcgatggtttagatagcttcgggaggtgatttgggacttaggaacgtgatcggaatgcgttttggaggtttggagtagatttaggcttgattggcgaagttgatattttggtgatttccggttagtaggcgagattttgatataggggtcggaatggaattccgagagttgcactatttttgttgtgtcatttgggatgtgtgtgaaaaatttcagttcatttgtacgtgttttggttgggttttttatcaaaagcgaaattcggaagattttagaaacttaggcttgaatccgatgtgtttttgttgatttgatgtgttttgaggtgttttgaagattggtacaattttgaataaggttttgtgatatgtttgtgcctttgattgaggtcccgggggcctcaggtgagtttcggatggtcaatcggaccatttcttgccttggagaggttgcagattttggttaagttgttgtagagcttttactcttcgcgatcgcgtagggagtctcgcgatcgcgtagagctattgtggggacagtacagtttactcagtgccttcgcgaagatggggatgtgatcgcatagggtaaaggcattgttgatcgcgaacgcggggagtgggtcgtgttcgcgtagagttaagtggaccaggggtcttgtcttgaagttgttcattgcgaatacggtagccagtccgcgatcgcatagtgttgggagcttgatcatcgcgttcgcatgggatattacgcattcgcatagggttaaatccgggagctgaggatttgtgcttcgcgatcgcgaaggatgtcctgcgatcgcgatgaaggaaattaggcctgggcagaaggtttaaaaggtcgtcttatccgtgaatgtggggtttatttcttccattgttggtcatttttggagctttttgaaggggattgaagagggattcaaggagaatcacttggaggtaagattcttggacttaaaactcgattctaatgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtaaatcatggaaattaagccaaaaataaagaactagggcttcactatttagacctttgattgaggatttgaaagaccatttgaggttggatttcagaacttttgatatgtatgaactcgtggggagataagaaatctattgatataaaaattattgaattccaagacgtgggcccgggggttgggttttggtaattacgggatttatgttgtaaattaattatattcgcttgggcttcattcctttagcatattttgacatcctcgttctgattttggagagttccgacgcgattagaggccgattcgaggggaaaaggcatcacgagctagagatttgaccggttcgaggtgagtaatgattgtaaatgatgttctgagggtttgaaaccccggatttgcacatcgtggttctatattgaggtgagacacacgtttgatgatgagcgtgaggtcgagcactaatggggattgtgacttggtccatcccgactgatgattttaccgcgtatttgactgaaatctatttgatatcataattatttgggctgaatgccaactatttgaacccttcagggatttttattgatatttcctcactgttttaactttatacttgaactcaatcatgttattttccattgttttcatactcagccatgttttactcagttttaatacttaaatgatactttaaatgatgtttgggctgagaaacactattttactattgcgcgagtggcttgtcaggatttttgactgagtaaggccgagggcctatgttttgaggaaacatttgatactgattatgaggcctagggcctgaggtatgtacgccgcgaggtggcttgattgatataaggccgaggatgtagtgatgatgccacgaggtggcttgatattgcgcttgggccgtaaggggcccctccaagagtctatacatccccagtgagaacgagtacccattgtgatacgagattgagcctgaggggctggtattgttctaagataatgcccgaggggcaggtactattctgagatgttgcccgaggggcggatttgttgatattgtgcctggggggcaaacctttatgtgtttatttttcataattgactgtcaattacctacttaattgttgaaaaaggcttttaaggaagtaaatttgagttaaaggattttcacctatctttcactggtttactgttttaaaaagtgttttcactgcttcattatagcatgcttttgtgccttgcatgatttcctgctttcagtctttatttatgattattactcactgagttggagtactcactttactccttgcaccctgtgtgcagaaacaagcgtatctggtcctgctccttagtgttgaccgttccggctcaggcggatctaaggagtctctaggtagctattggcgttcgcagcccggagctcttccctattttacttcttcattttcttagtttctatattaaactctgtagtttgatttgtagtattccgaattgtttagatgctcatgactactaacactccggtatcagtatgctattaattgttgtgtttgggctgtattccgcatattattctattaattgcttaaactttggtttatttcttcatgtttagatggtatcttaaatgcttaattattaataatcggataatgggaagtgtcggctggccttgtcttcatgagaggtgccatcacgactgggttcgggtttggagtcgtgacaagttggtatcagagcctaggttatataggtctcacgagttataagcaggtttagtagagtctcgtgtatcggtacggagatgtctgtatttatccttgagaggctgcagaacctttaggaaaaacttcacattcttgaattcttctcgtgcgtccttgattcagcttgaaaagtaactctttgaattctttccacacgttcgtatgtgcgcatgagcgctcggtatcagatgtgcattgatggcttgtgattcctcaatctaggggtgagatgtgatctctgtgcattgatgttgggccagtttggaggactcgaggccggatttttgcctatagcttgagccctgagctgttgatttcatgagcgcagtttctggatccatatgttctgttatgtccctattaagggaggtgatgactggatagttacgtgatgaatgtgatgtgactgcgagatgtattcatgtgatttggaagcaacgagaagggtttgctggaggatagaaggactattaggtgctcgatttttatcttgatttgaggtatagccccgagttatgggtgtgtgaagaatctttctatgtttcctagttgggagtggagtaaatttcatgttgtggtctgagttcagactcaagaagtttaagtaactgcgtaatgtttatgatggtggaaggtatacagaaatgtttgtttgaggcaaagcaggtagggttatctcctgcggattattctgaagtttgtgtaatcccttgtgtcatttgttaccagggaaatatatgttttacaatttgaatttgggttgctcaagagagtaggctttactactacgagagtgaatgcgagatttgcagaagatataaactacaagatggtctgtgttccacgagcttataaaggattgagtttaatctcaatatggtattatggcaccaataaagtatatgcgttatgagttattgtatatgttttggtctatggcttcgagccaagtgggggagtccactattaattagtcgattgcacggttatgtgctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatgcgggtgaatcagttatcggcttcagcaccagttacttcaccaccatccgcccagccagctaggggtcaccccagagagggaggttgatcaggtggcggtcaggcccgtttctatgcactttcgggcagacccgatgttattgcttcagatgcggttattacaggtattgtttcaatctgccacaaatattcctctgtattatttgatcctggttccaccatttcttatgtgtcatcatactttgctcgttatttgggtacatgtatctactccggtgggtgatactgttgttgtagactgtatgtaccaatcgtgtgtggtgactattgggggtctggaggcccgagtggatctattattgttaagtatggtggatttcaatgtcattttaggcatggattagctatctccgtgtcgtgctattctagactatcatgctaagacaatcacattggctataccgggtgtgccacggatcgagtggcgaggtgtgactaattttccagtagagttatctcattcttgaaagcccagcgtatggttggtaagggttgtctttcgtatctagcatttgtaaaggatgtcagtgctgagactcctagtgtttattctgttccagttgtgagggattttcttgatgtgtttcctgtagacctatcgggcatgccaccaaacagggatattgattttggtattgacctggtgccgagcactcagcccatttcagtttcaccgtatcgtatggcaccagcagagatgaaggaattaaaggagcagcttcaggaactccttgataaagggttcattcggcatagtgtgtcaccttggggtgcaccagttctatttgtaaagaagaaggatggcactatgaggatgtgcattgattataggcaattgaacaaggtaacaattaagaacaagtatcatttgcctcgcattgatgatttattcgaccagcttcagggagcgagagtgttctccaagattgatctccgttcaagttatcaccagttgaagatcaaggactcggttattcttaagacagctttaaggacccgatatggtcattatgagttcttggtgataacttttgggctgaccaatgccccagcagcgttcatgtatttgatgaacagcgtgttccagtcttatctcgactcgtttgtcatagtctttattgatgatattctggggaattcgcgtagtcaggaggagcatgcggaacatttgagagttgtgttgcagagattgagagaggagaagctttatgcagagttcttcaagtgtgagtttttgcttagtttagtggctttcttggggcacgtggtatctagcgaaggtattcaggttgatccgaagaagatagaggtggttcagagttggcccagaccgtcctcagctacagagattcgcagctttcttggtttggcaggctattatcgccagtttgttcagggattctcatctatcacatcgccttgacaaagttgactcggaagagtgcttcatttgtatggtcagacgagtgtgaggagagcttttagaagctcaagacagccttgaccacaactccagtattggttttgccatcagcttcaggttcatatccatgtattatgatgcttcgagagttgggattggttgtgtattgatgcaggagggcagagttattgcttatgcttctcgtcagttgaatccccatgagaagaactaccctgttcatgatttggagttggcttccatagtccacgcgttgaagatttggaggcattacttgtatggagtatcttgtgaggtgttcactgatcatcgcagtcttcagcacttgttcaagcaaaaagatcttaatttgaaagatggttggagttgcttaaggattatgatatcactatattgtaccatccgggaaaggccaatgtggtggctgatgctttgagccgaaagatagtgagtatggggagtttggcatatattccagttggggagagacctcttgcagttgatgttcaggccttggccaattggttcgtgaggttagatatttcggagcccagtcgggtattggcttgtgtggtttctcagtcttccttatatgatcgcatcagtgagagcttgtatgatgatccacatttggttgtcattaaggacagatttcagcatgatgatgccagagatgtgaccattggtgatgatgaggtgttgaggatgtagggccggatttgtgtgcccaatatggatgggcttcgagagttgattctggaggaggcccatagtcgcggtattccattcatctgggtgccgcaaagatgtatcaagatttgagatagcacaattggtggagaagaatgaagaaagacaatgtgagatttgtagctcggtgtctcaattgtcagcaggtgaagtatgagcatcagagatcgggtggcttgcttcagcagatggatattcttgagtggaagtgggagaggatcgctatggactttgttgttagacttccacggactttgagaaaatttgatgctatttgggtgattgtggatcgtctgaccaagtccgcgcactttattcatgtatgtactacatattcttctgagtagttggcagagatttatattcgggagattgttcgtttgtatggtgtccccgtttccatcatttatgatagggcactcagtttacatcgcagttttggaggtctgtgcagcaagagttgggtactcaggttgagttaagcacaacttttcaccctcagacagacgggcagtccgagcgcactatttagatattggaggacatgttgcatgattgtgtcattgattttggagggtcatgggattagtttccaccgcttgcagagtttgcttataacaacagctaccagtcgagtatttagatggctccatatgaggctttgtatgggaggcggtgtagatctctagttggttggttcgagcccggtgaggctaggctattggggatagatttggtgcaggttgctttgtagaaggtgaaggtgattcaagagaggcttcgtacagcacagtcgaggcaaaagagttatgctaacaggaaggttcgagatgtgtcctacatggttagtgagaaggttctgttaaaagtttcgcccatgaagggtgttatgagatttggaaagaaaggaaaattgagtctgcggttcattaggccttttgaggtgctttggaggattggggaagcggcctatgagcttgctttgccacccagcttgtcgagtgtgcattcggtattttatgtttctatgctccagaagtatattggggatctgtctcatgttttggatttcagcacggctcaattggatgatgatttgacctatgatgtagagatagtagctattttgggtcgtcaggttcgaaagttaaggtcgaaggatatagctttagtgaaagtgcagtggagaggtcggtctgtggaggaggctgcctgggagaccgagcgggagatgcagagcagatatccttacatgtttgaggcttcaggtatgtttctttactcgttcgaggatgaatgtttgtttaagttggggaggatgtgacgacccggccagtcatctcatgagttaccgctccatttcccctatttcttctactttatgctttgtgtatccgtgttatgtggtatcgggttagttggatcgaatccggaatgattttggtaaggtttgagacacttagtctcttttgaggaagcttaagttggaaaagtcaactggatattgacttatgtgttatacggatcgtatgtgaattcccatagttcggatagcttcgggaggtgatttgggacttaggagcgcgatcggaatgagttttggaggttcggagtagatttaggcttgaattggcgaagttgatattttggggatttccgattagtaggcgagattttgatataggggtcggaatggaattctgagagttgcaatagttctgttgtgtcgtttcggatgtgtgtgcaaaatttcaggtcattcggacgtggtttgcttgggtttttgaccaaaagcagaattcggaatattttagaaacttaggcttgaatccaaagtgatttggttgatttgatattgtttgacatgttttaaagattggtacaagtttgaataaggttttgggatatgttggtgcctttggttgaggtcccgagggccttgggtgagtttcggatgatcaatcggacaatttcatgccttggagatgttgcagattatggtttagccgttgcagagcttttactcttcgcgatcgtgtaaggagtctcgcgatcgcgtagagttgtagtgggagcagtccagtttactcagtgcgttcgcgaagatggggatgtgatcgcatagggtgaaggcatttttgatcgcgaacgcggggaatgggtcgcgttcgcgtagagttaagtggaccaagggttttggattgaagttgttcattgcgaatgtggtagccagtccgcgatcacatagtgttgggagcttgatcatcgcgttcttatgggatgttacgcattcgcatacagttaattctgggagctgaggatttgtacttcgcgatcgcgaaggatgtcccgcgatcgcgatgaaggaaattagtcctgggcagaaggtttaaaaggtcgtcttgtccgcgaatgtgggatttatttcttccattgttggtcgttttcagagctttttgaagggaattgaagagtgattcaagggaatcacttggaggtaagattattggaattaaaactcgattgatcataggctaaaaactcgtattttagtcgttgtaacaacactttaattattgcattttacaaaagtttgagcttaatccgacttaagaaataaatttgggatgaatttaattgatttggggctttgaagtctgagtaaaagctaaataaatcaagtcaggatcgagttcaggggtcgcaaagcaagcccggatagcaaaacaaatgaaaaaatgaagcatcacaaaattttgcactgtcgcaccgtgggaggcgccgtggcagtgcaagaatctgcactgcattgtatttctccgttaaaatgcattttgcctctgtccaatccatgtacacgctgcggggggcgctgcggacgtgaaaaaattgcagaattactctatttcggtctaaaaaggcataattgtcaaaaccccttcacacacgattaaaaagagaaaagcatccattattgatggaccagacctgttttgagagagaaagagacgaggagatccatcttggaggatcaaaatcaagaggagacaatactttggatcaaggattaaaagtgtttttctaaactttcttctagtatctatttatttgatgtttgtataattatgagtggctaaaaacccaaatattttagggttatgggtgttagatgattatgttgtttgaaacttagattgatgatcttgaaattatcgttaagggttgtttatttgattctgctgttaattattttactacgtagctaacaatgaaatactatttacgaatcttgagttaaacttgaaaaaggaaattgttgattgcatatagaatcaaatagagcaagatctggatcctgggcatcgggtgaaagattcgcaattaagatagaactatacttaattgccttgtttggttgagaaataggatttgtaaatgcatttgagttaatattaataccatagaaatataggtattgatttaacttgaataggcgcataagaaatcgatagattcttctgggtattattaaccctataatcaataacccggataattcaataaatcatttttaagctaaaaacgtagcatgatctctatcaagcccataaccccgggatatctcatttattaattgttaaaagaaaaactcataagtggcgtagtaactttgcgttgtattattgtttgtctactagttaaattgtaaattggttatttatgtattttgtgatgaattagcttgaatcgataattgtttaagtttgcatcagtcgttaagttaatcataagccctcatgggaacgatactctacttattactatattacttgaagatcgcgtacacttgcgtgagtgctttggtcgcaacaagtttctggcgccattgccggggacttggaaattagctacttgactaagttaagcttttatcagccattggtttaagtattaattttcagttcacattgtttgtgccacgcaggctcttctcttgaatgcggaggagtagaagaacaagcaatctcttccctcttgatcctgaaattgaaagatcacttcatagagagaggaaggagttggaagctagatacaaaacagaaagagagttgggcattttagttcaaccacagccaatagtgatggcaggtaatggagggcgttcggtgatagaagctcgaaggccaaatcttgctaatatgactcaggctattgttaagcctgatatcactgattactttgagcttaaacagtacacggtacagctaattcagtccactaggcaatatgtaggtctatctcatgaagacccgcagaggcacattcagaattttttggaaatcacggatacttacaactatccaaatgtttccaaggactatgtcaggctaaccttgtttcctttttcattgttgggggaagctaaagaatggttgcagaaggagcctgctaattcaatccatacttgggatgatttatcaaagaaatttttaatcaagtttttccccactaaaaagacaaagcctttgcggagccagattcttgggtttcaacaacgggatggtgagactcttcgccaagcttgggaaagatacaagaaactactccgagactgtccacatcattgtcaaactgatgaattattgggccatacttttgttgatggattagatgagacttcaaagatgaatcttgattcagcttgtggacgtagttgcatggcgagactatatagtgaaatacaacttttgctaaacaacttcactgttaatgatcataattggcaaggtgagggagaaccaaggagagcaatgaaacagaaagcagcaggggtacttgaacttgatgatttttcagccatgagagcagatatagcaaaattggcaaatcaaatgaatagaatgacaatgaactagacacaacaattgcaacatgttcaacaaatgtcgatttgttgtgaaatgtgtggtgacaatcatacaagtgacatgtggccaatgaatcctgaatctatttattatgtgagacaacaaagcagaggtccgatgaaccaacaggcacaatatgggaacacttacaatgcaaattggagaaatcatcctaatttctcttaggatggaaatcaattaaatcagaatcaatatagaccccaaggaaatttcaatcaacctcaaaggccacccaacaggtagaagaaagtacaaatgatttgttgaagaaattgttgcatgacaatcaacaactcaaaactgatttcagaaatcttgaaaggaaaatggtcgcaacatctattctaatgttaattccacctagtaaatcatggaaattaagccaaaaattgaaaaactagggcttggaaatttagacttttgattggggatttgaaggaccatttaaggttggatttcagaactttttatatgtatgaactcgtggggagataaggaatctattgatgtaaaaattatcgaattccaagatgtgggcacgggggtcaagttttggtaatttcgggatttatgttgtaaattgattattttcgctcgggcttcattcccttagcatattttgacgtcctcgttctgattttggatagattcgatgcgagtagaggccgattcgaggagcaaaggagtcgcgagctagagatttgactgattcgaggtgagtaatgattgtaaatgatgttctgaggggttgaaatcccggattcgcacatcgtggtgctatattgaggtgagacacacacctggtgacgaatgtggggtcgagcactgatcgaagacaaccatgcactactattgagtagcgagagaggtcgaagcagcttttacctgattaaggtcgggatgatttccataggaatctagaagttggagtcaggtgtctatctaaagtggagttgagtatttgctcttaactaaacttctaaacattttgggttttgttttacttctaattgtatagaactacaatgatcaattaaactaaaataatctaggattaagctattgtgagttgttcaaatgattaaaaggcactagggtagtgactttcgcctaggtggttaattgacgggtacttgagtataagatatgattgtcacatttggggagtatgatacaaccattgcaagattctactcactatacacctctcggtagttcgagtgattttgtccaaattgactttctcaagaccaattgggtatgtaaatttgtaaaagcaatcaaggttcaagttaggtattattatctctaggtttaaccctttaattggggctatcaatcttttgagtacgccccaattccttgttggaccaatttcagagactcggactctctttctcaagaaaagccaaagtcaactaaacacaaactagtgtttgcaaccactaattcagcaattaaacatgaaattagtccaaatatcaaacacccctagacaatcaagcatcaaaacacaagacccatcaattacccacactagggttaagccgcaaccctagcttatgggtctagctactcataattagagaagaaaacaaagaaatagatgaagaaaaactcatattaattaattgctaaattaaacttgaagattcaatgttgaaataaagctaaaattactcaaaatagctaaaaataacgaagtcacgagcgcagccagtgtacaaaattatccgatgacctaaaatgggaaaagaagctatttatactaagctgaatattttggacaaaaatacccctgcggggttagtgcggaccgcacaaaatcacatgcagccacactagggctttggactttaataaacggctctctgaagttgggcaatgcagaccgcacataatcgattgcggctgtggtggcttctagtacggtccgcatgaaatggagcgcggaccgtattaggcttcaaacttggaactgggaactctctgaaccttctctctgcggaccgcactaaatcaaatgcggccgcattaatcctagtgcggaccgcacaaaacctcgtacgtctgcattgccttttttgcctgaatagcagcctctctgaacctcacttgtgcagaccacacagaatggtgtgcggctgcactggccctattttgcctaagcttgttttgtcttggtacttgtgcaagtttcactcctttttgagctgatctttgacatcttgtcaccttgttgatcaaacctgcaatcaagcacaacttgtgagtcttttgggactatttgtacacatttctaatcaaaacttaagcatgaaggagtattaaatgtatcaaaatccctagttatcaactcccccaaacttaagcttttgcttgtcctcaagcgaacaaaataagactcaccccttaagagaaaatccaagagaattcagttatcctaaagtgaccttatctagcatcaattgggactaacaattgccctcaatacaaatgaatcattaacaacatttactcttttaaataccatggattaagtgcaacacaagagcatcaagagttgactcaacacatcaaagaactctttctattactttggtcattgtggaacccaaactcacacatcctcgcatctccctaagtaaacctcacctttagaatagtggtactcagaacgaggttaatggaaattcactcatctctctcaaggaaaagtcacaagtccggctctaagtaccatatgcttgccccttatatgagtcaccactaatgtaagtttcattcaactagagatcatatagggcttttgtggagacatagtgaaggcttttggttccaggtaggtaatgtttggtctatgtaggttccatcttcccttaagcactttttttgtttcattttggcacacattcacttgactttttgagtctcttcacttctttctaaggggttagagagacacactgtcactctttcttatacatttcaaatcttttcttctttctcaactttcaacaccttcattctttacttttcttgaatccctttttattcaattctacattgaacattctttttgtctttttgcatttatttctttttcattgcctttctttttcttcattttatacctttttaccactttgttgccatcctcgtctctccccccaaacttatacttttgccatgtgctaaggaaagattaggtgccaagagaggatatcttttagagcgggtaaaggcttgtagcatggttcttaaaggaaaaaggtccaaggctcaaaagggttgactagggattttattattggtaggctatggaagtgtttaatctatcatttggatcaaggagagcctataatcatgtctcaagtcaaaattcacttaggatttcttctcaacaaaaattcagggcaagttctagaccaatggctcgggacttggacttgcaatgcaatttctcaccacacaagctatgggatcgctaaagacacagagtcgggacccaaaacgaccttagataagattcgagcacacaatagtcccgaaacaccacttgatgattatcggtcaacacaagagtctcaaggtcacgactttcaccaccctaaacacaacaatttgtttttgaccatgaggtcaaatgcgctaggcccaagtgacgctttgcttgaggcacccttaccactaactactaaaagcaaaacgaaaaacggactcaaacccttaagaaggttgtcacgccatccataaatgggaagagctactcggttcacacaaactccacctttggaaagaatcgtggcattaagaaaaccaaaggcttattgcaaacattcaaaacaagaagctacgaacataaataagaagctacagaaaagaaaaatgcagaaagtaaaataaatatttacatgagggaatttaatcgaatatacaatagaggggatgaatatatacaatgtaacataaactttatatacagacccaaagtaaaaagtacgaaaaaatgaaaaaatgtaatgaagtactaaaattatatacataccaaagataaaaagaaagaaatcttaaaatctgtcgaatatatacattcatccaaatcaataaaagtagagactaccccctcaaatgaaagttggcattgtcctcaatgccaactaaacaaaataagcaccaagaataaaagggaaaaggatatagagactctctatggcccgtctgtctgcatgggatcctgagtggtccctggatccttaatatgctcgggaacctcagactggttccctatggcctactgctctactgctgggacctaggcctagacctagacaggctcctgggctgcatcctacgactgactagaggaggtctccggtaggtctgccaactggatgactgcatcatctgctcggggaatcatcctcttcctcttgggaggcctctgggactgctctagctgagggtgagatgttggcacagggtcttgtagcaataaatccaaagcgtctttctgccttcatcctatcaaccttaaccctcaactccttcacggactccttggaagcccgcgtctttctcatcttcttggcctccctagcaagctctttgagagcttttccatatgactccacagcgtccgtaagaaatttttgagtgtcaagaatttttttctagttgtccagaatatccttgagggcatcctcatagactgtaggacctgtagaggtggaggtgtcgactgagatgctactgcagtagtgagggcaaacaacttagaggaagctgtctgcatccaactgttgatgctaagaagggtctggcttagacattgtgcagtcactggatgagccgaggtagagggtatctctagagctgctaaaatggatggaccagggtggatgtccattgaggtggaggcaagatgagtaggagccactaccacaactggctcttcagacttgccagttggatcagtggatgttcccttgtagttcttgcctttcgggttgtcatcaccctgtatgttataccatgagaacggggcctttgcttttaccttgatatcaaatggccgcttttcaactttgcggtccctaaagtacatggtcaagaagctagggaagggttagttctatcaccttcactaactacctgtgtaatcacccgagacatcaccttcccgacgttaattgggtaccctaccatgattgatgctaccaatactgcccggtgaagagggagtgagttttcatgagtagtggggtccaatctgctacacacaaatgtttcccaccccttggcctcgaaattcaaacttcttatcaaaattttcactcccgcattcaaccaatcgggggtgatacctgggtttgccagatactgtgccaaccaaggacagacctcctcacctaattccatcttttccaaatacagcgactcatccttctcatcgaagtccaagtagtcatttattgttttcctatcaaacaacactttcaaattgcacaccttggtcactttggtgcccttcttgatgtgggcaacattggtgtagaattccttgactaggtgctcgtttgcatcctcacaattgtttaagaaatactcccagcccactctatctctaaattgccttctcacattggggttgtgaggcaaaaggtttctatctacaaaaattctctccgaaattaatttcctcacaggccaccattctttgaatttatggtaggccacctcactcacaaagtggtcttgccacacctccggatttctagttcgttctaccctaccaacctggggctgacccccttctcctactacctcttcttcccctactacaccctcttcggataatgaagttgtgggagaggtggagtattcatccccactaccttcagctgagccctcagacgaaccagaagatacatttactgacgcttggacagtggggaaaggtggaagagtgtctcttagtctgtttctctccggccagtcagggatgtactctgggattgagtctgaagatatatctcgggagggctcgtattcactcccagactggtcaatggacctatcagcagctttagtgagcttccttgtgtttttaatgttttgtcgggcttggggagtcaatcttagcatcttctgtttccctccccgggaggactctcccctgcctggttgtttagaacccttgcctcttgtttcaccattgtctgcaaacaacatccattagacttgttagtatcagtagaagaaattaagttcacaattgtagaaaataaaaagatgcagacagtagcagatgttgcacagtgcggaccgcacaaaatataaagcggtcgcatagaggccaatgcggaccgcacaaaaatgctaatactgtctgcatagaggtggtgttcagactacccactctctgaacaattgcaccacggaccgcacaaaatggtaatgtggtccgcattgaggcaccgtggaccgcacaaaatacaaggcggccgcggtggcaaacttcagagagctagtattttcatcctttatcaatgcggtctgcactgattttgtgccccccacactgagttatttgcggccgcacacaatgtagtgtggtccgcattgaaaacttcagagacttgaataatttttccaccatatgccgcactgcataaacacaaacatgtaacatctcacaaccggtcaacctaaaaataaatcctatattacaatgaaaatcaaagaaaaacaagaagaaaaacacatgggttgcctcccaaaaagcgtctgatttaacgtcgcagcacgacgcaagttaccatcaaatcatttgagatgaagaagtgccaccatgtggctatcatcagttttgccgaagtagtgcttgaccctatgcccattcactctgaaaacttccccatttttgttctttaaatcaagtgcaccaaacgggatcacacataccacttcaaaaggtccactccatttcgacttaagcttttccggaaacagacgtaaccaagagttgaacaagagaaccaaatcacccactttgaaatccttactacgagcatatttatcatgaaggtacttcatcttgtccttgtacaaggaagaactggagtaggcatggaatcgaaattcatcgagttcattaagctgctccacacagagattggctgcaatatcccattcaagatttagcttccataaggcccacatggccttgtgctctaactcaaccggtagatggcaagctttcccaaacaccaaccgatatggaaacataccaatcggagtcttgtaagaatcttataagcccatagagcatcatccaacttctttgaccaatcgatcctataagcattgaccgtcgttgacaatatctttttgatttccatgttgtagacttcaacttgaccacttgcttgaggatgatagggagtagaaactttgtgattgacaccatactttgcaagaaaaatgtcaaaagctctattgcaaaaatgagaccccccatcacttatgattgcacgaagagtaccaaaccttgtaaaactgctcttcttgagaaatgcaacaacactctgcgcctcatagttgggaaaagccacggcttcaacccactttgaaacatagtccaccgccacaaaaatgtatgtgttcccacatgagctaacaaacggacccataaaatcaatgcctcatacatcaaaaatatccacctcaaggatggtattgagaggcatctcatctttcttcgaaattccgccccctctttgacattcgtcacacctctttacgagttcacttgcatctttgtacaaagttggccaataaaatccacaactaagaactgtggaagtcgtcctcgccccgccattatggccaccatagggagaggaatgacaaacctccaagatactcaatttctcttcctctgggacacaccttcggatcacaccatccgtgcaaatcttgaacaagtatgtctcataccaatagaaatccaaactatctcgcttgagcttcttcttttggttagaagagagctcacacgggattataccagtcacaaggaaattagcaacatctgcaaactatagcattccattcatcgacaccgaaaggagttgttcgtcgggaaatgaataattgctttctaggccatcacgaggcctcccctcctcctcaaagcttgaagtaacaagacccatcgcatcagtctagctttggaatccttcttcgtcatcaagtatcggagtgcggcatgatcggtatgaataataaccttagcacccatgagatacggccgaaatttttccattgcgaacacaatagacaaaagctcttgcttagtcaccgtgtagttcacttgagcatcatgcattgtcttgctcgtatagtacaccggatgaaacattttgttcactcgttgacccaaaaccgctccaaccacaacgtcgctcgcatcacacatgagctcaaagggcaagctctaattaggtgcggtaatgataggagtggtggtcaacttatgcttgagaagttcaaaggcttgcatacatttttcatcaaacacgaacttggcatctttttctaacaacttgcacaaacgattcactaccttcaaaaagtctttgataaatctccggtagaacccctcatatccaagaaaacttctaactccattgatagatgtagggggagggagacctgaaatcatatcaatttttgctttgtctacctcaataccatgctttgaaattttatgcccaagaactataccctcttccaccataaagtggtatttctcccaattgagaacaagattggtttcttcacaacgggccaaaactctatcaagattcttcaagcattcatcaaatgaatcacccacaacactaaagtagtccatgaacacctccaaaatgccttccaccatatcggtgaaaatggccatcatacaccgttaaaatgtagccggtgcattacacaatccgaaaggcatcctagaaaaaaaaatgtgctatatggacaagtgaatgtggtcttctcttgatcttctggagcaatcaagatttggttgtacctagaatatccattcaagaaacagtagaaggcatgcccagcaggtcggtctaacatctggtcaagaaaagtcaaaggaaagtgatccttgcgggtcactttattcaacttgtggtagtccatgcataccctccaaccagtgatggttatggtaggaattaactcattttgttaatttgcaaccagggtcatgccacccttcttcggtatacattgcaccggtgaagtccaagagctatcagaggtggggtacataacccctgatcacctcctttttcacaacttcttgcattgcctggttcaacttcctttgatgctccaaggagggctttacatcatcttccagaataatcttgtgcatacaaaatgtggggcttatcccccgaatatcagctaaagtccatccaattgcctttttccacttttgaagcaccgctaattggcatcaacatgcatgttagtaagacaagaggaaagaataactggcaaagtagagtttgagcctaagaactcatacctaaggtgtgaaggaagtggtttcaaatccaacaccggaggctcctcaattgaaggctttgttggtggagtcttcctattctcgagatccagagatagtttcctaggttcataagagtaagagcccatcccatgtaaagcattcacgcactccactcggccctcatcatcattgacatcaagattcaacaatacggcctccaatgagtcctccacattgatcattacactggtgtcatcaattatcactattgtgacgaggtccataaaagagcacactttggtactgttgggctgtttcattgacttgtaaacatgaaagaccactttttcatcacccacccgaaaggtgaggtcccctacttccacatgaactaaggccttcccggtagcaaggaaagatctccccaatatgataggaacttcataatccacctcacagtccaagatcacaaaatcagctggcaagataaatttgtccacccggataaggacatcatcgataatatccaatgatctcttcatcgttctatccgccatttgtaatctcatggaagtcggcctaggttgcccaatacacaaaattttgaaaaccgagtaggaatcaaattgatactagcccccaagtcacatagagccttggcaaaatccgcactcccaatggtgcaaggaatggtgaaagcaccgggatcttcaagattcgggaccattgattgcactattgtactaacttggttagtcatttttatagtttcacaatccatagaccacttctttgtcaccaagtccttcatgaattttgcatagcccggcatttgctcaagagcctccaccaaaggcacattaatggataagctcttcatcatgtcaatgaactttttaaactgattctcaattttctacttatcaagactttgaggataaggcggaggtgatcttggaaaaggtaccttggctttaggcaccaccagctccgacatatctattacgtgttccctagacgggttcacgtcattttgagtttccacctcggcatcttgaatatcaatcatcacttcttcattcatattgtcatctatcacattttctacaaccaaaggaacttcatcttcttgcaactcaatatcatcactcaaaacttgcttttgtttagaggcattcacatcaccgcctcgtccactccttgtagttactgccataacatgattgttctcaccctttgggtttactactatatcacttggtagagcacccttagggcgtgtattcaaggactgagagatttggcctatctgaacctccaaatttctgattgaggtattgtggaaagccaactgtgcatcagaatctgcatttttcttcatcatctgttcgaacatcatttcaattctacccatatcattgctagaagaactaggaccttgggatggaaatgggggcggattgttcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctggtacattaggggcctttgaaagccttacccccggtttccttggtttctattgttccatccaccttgattgttattaccaccccatttattgttatcaccattccaatttccttgatggttttgattgttgttctgatcgccccagttgttgttttgattgtttctcccccaattaccattgtcgtgttgttgttgattgccccaattgccttgggatctccattattgttgattgaaagaattgcccctctggccttgataattaattattcatatacggcacctcctcattttgttcatcataaccatcattttggaatccaccacaactattgtcaaatttctccgaattcccttagttttgttgccctctttgtctttttttgttgacaagcatgttgacaccctctatagcattcacttggcgaggattttgaacttgctgcaactgtgcctttgctaattggttcattatagttgtgaactcagctatagtctgcccatgatcatgtaactccttgtgcaaatgagtaatcgtggggtcaccctggggcacattagctctactttgccaaagtgtcagccatcttgtcaagaatgtcacaagcctcatcataagagagcttcatgaagttgcctccagcaagttggttcactatgcattggtttgtggtgttaataccccggtagaaagtctgttggatcatcaccttggtcatatcattgttggggcagtccttcaccattgttctataacgctcccaaatctcatgcaaaggttctgtgggatcttgcttgaataccaagatctcatctctcaatgcatccatatgccccggtgagaaaaattttgcaatgaacttatcagccaactcatcccaagtagtgatggaatggttgggaagtcgctcaagctaatcaagtgctttccctctaagtgaaaatgggaagagtctcaaccaaagtgcatcctcggacacatttgtttgcttgctcccccaacaggtatccacgaaccccttgagatatttgtaagcattttgatttgcagcgcctgtgaaatacgcacactgctccagcaatgtcagtatcacattggttatttgaaaatttcccgcccggattcggggtggaacaatagcacttgcatagccttggttcggaagcactctaggagccactcttggaggtggcggaggagggtctggaatattatcatttacattagcattggcctggcggcctctacgttgtccttgaggtacaagaggcacctcatcatccccgatatcatctacctcctcccccacaatcacatttccaagagggccattggcgttgtttgcttccatttggtacctgaagttgtgacacacacaaattagtaacaaagaaggaaagaagaacaatacacaaaactatttagatagatagccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccaaaaaggtgatcgaagctaaccctacactactattgagtagcgagaaaggtcgaagcagcttttacccgattaaggtcgggatcgatttccacatggagctagaagttggagtcgggtgtctatctaaagtggagttatgtatttgctcttaattgcacttctaaacattttgagttttgttttacttctaattgtatagaactacaatgatcaattaaactaaaataagctaggattaaactattgcgagttgttcaaatgattaaaaggcactaaggtagtgactttcgcctaggtggtcaattgacgggtacttgagtataagatatgattgtcacatttggggagtatgatataaccattgcacgattctactcactctacacctctcagtagttcgagtgattttttccgaattgactttctcatgaccaattgggtatgcaaatttgtacaagcaatcaaggttcaagttgggtattactatctctatgtttaaccctttaattggggctatcaatctcttgagtacgccccaattccttgttggaccaatttcagagacttaggctctctttctcaagaagagtcaaagtcaactaaacacaaactagtgtttgcaaccactaattcagcaattaaacatgaaattagtccaaatatcaaacacccatagacaatcaagcatcaaaataaaagatccgtcaattatccacactagggttgagccacaatcctagcttatgggtctagctactcataattagagaaggacaaagaaatagatgaagaaaaattcacattcattaattgctaaattaaacttgaagattcaatgttgaaataaagctaaaattactcaaaacagctaaaaataacgaagtcacgagcgcagccagtgtataaaactatctgatgacctaaaaatggaaaaagaagctatttatgctaagctaaaaaatttggacaaaaatacccctacggggttagtgcagaccgcacaaaatcacatgcggccgcactagggctctggacttgaataaacggctctctgaacttgggcaatgcggaccgcacagaatcgagtgtggttgcgatggcttctggtgcggtccgcatgaaatgaagcgcggaccgcattaggcttcaaacttggaattggcaactctctgaaccttctctctgctgaccgcactaaatcgagtgcggccgcattgatcccagtgcggaccgcacaaaaccttgtgcgtctgcattgccttttttgcctgaatagcagcctttctgaacctcacttgtgcggaccgcacagaatgttgtgcggccgcattggccttgttttgcctgagcttgtcttgtcttggtacttgtgcaagtttcactcctttttgagctgatctttgacatctttttaccttgttgatcaaacctgcaatcaagcgcaacttgtgagccttttgggactatttgtacacatttctaatcaaaacttaagcatgaaggagtataaaatgtatcaaaatccctagttatcaagcactattggggattgtgacttggtccgtcctgattgatgattttaccgcctatttgactgaaatctattttctatcatcactatttgggctgaatgccatatttgggcttcgtgctaactatttgaacccttcggtgatttttattgatatttcctcactgttttgactttatgcttgaactcagtcatgttattttccattgttttcatactcagccatgttttactcagtttttatacttaaatgatattttaaatgatgtttggactgagaaacactgttttactattgctcgagtggcttgtgaggatttttgactgagtaaggtcgagggcctatgttgtgaggaaacatttgatactgattatgaggccgagggcttgagatatgtacgccacgaggtgggttgattgatatgaggccgagggcctagtgatgatgccacgaggtggcttgatattgcgtttgggccgtaaggggcccctccaggagtctgtacacccccagtgagcgcgggtacccattgtgnnnnnnnnnnnnnnnnnnnnnnnnnnnnnnnnnnnnnnnnnnnnnnnnnnnnnnnnnnnnnnnnnnnnnnnnnnnnnnacgagattgagcacgaggggctagtattgttctcagatactgtcatcttcttagatgttgcccgagggacggatttgttgatactgtgcccgaggggttaacctttatgtgtttattttcataattgactatcaattacctgcttaattgttgaaaaaggcttttcaggaagtaaatttgagttacatgatttttacctatctttcactggtttactgttttaaaaaggattttcactgcttcattatagcatgcttttgtgccttacgtgatttcctgctttcagtctttatttatgattattactcactgagttggagtactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcaggcttatctggtcccgctcccgagtgttgatcattctggctcaggcggatccgaggagtctctaggtagctattggcgttcgcagcccggagcttccctatcatacttctttatgttcttagtttctgtattaaactctgtagtttgatttgtagtattctgaattgtttagatgctcattactagtgacaccccggtatcgggctgtgtttgggctgtatttcacatattatactatcaattgcttaaactttggtttatttcttcatgtttagacggtatcttaaatgcttaattgttaataatcggataatggaaagtgtcggctggccttgtcttcacgagaggcgccattacgaccgggtctgggttttgggtcgtgatacattatcaatacaaggaaaagaaaattttcacaattctttcatgttttctttcaggggtaggtttgagggaaagaaaaaaacctccatattttatgtttactatttcaaaaaaaaaggagaaaaataattcaaaatgaattagtgaaatagagaaactaaggagaaaattttttcgtgtagctgtaactaactgccttgccaatggcaccttgtacacttctattaatgcaggtgtcactgaactatttaggaatttgcaattaggttctgatccgtcacaaatccgtcgaggatgctatttttatggttttgcgtcggattggtccgtcgcatattctaaaaatttggtggtgaaaaaacactttgatcgaaaactatcgatttatatttgtctatttatatctatattattataaagtatgaatacaatgtcggtttacaaaaaaaaaattataatattaaatataataactcacaataaaagaacattactgaaattcttgacattaatattgtaatcctattaattttaggacataagactacacttaggaatcctaaataaaccaaacgaagaaagacaaaactccaaattggaaggaactattatacattcaaagtcataaaactacggtaggtttatggcttcatatatagcaagagagttcttctggtgtgatcttttaagcaactaaaagtaaaaaataacaaatagaaaaaaagatgtaatatgtcatatatctatgcataaagagtataaaatttatttaaaagttaaaacacaaaagacagatgttgtccttttcattttttatattttttgctttttaagtaatatcttaatttggtctattctaaattttaagttgcaacaggtaagtcattgttatgtttactactttagtaaatcagtataatatttgaaaatatgtaggtattctttattttgtttagcgacgtgattatttagttaaaaaaaactaaatggaaggtttagagataggtcgttgaattctctttcctttatattcagtaaacaaaaattacttttatatcgtaaaaactgtgaacagactcatgaagattaggtgcaaagatcaaatgaaagcaactaccatatagttttgtgcttacgagttaggaaaattatgcaattgataatactgctaaaacttatgttgcagaaagcaaattcttgtggtgctaaaatactgagttttcatctgcaacattgtactcttttattttatcttgcagattttaaggtgagtttaacgttttaattataatttgtaaatatgacatacttttattttctattttacatgtaaacatagttactctataaggcgggaagaaattaaaagtgttaaacatacgatctagagtttagaaagaacgaatgagtcatgctcattaaaatagaatctaagattttctcttgtgtttatttatttactatacttttatgtaatatctatttataataccgtcaaaatgacttgtctcttcatgttttagtttcgattaagatcaaattctttaatttttctggattttatagtatttgttttaattaaattagaatgttaacctttttgtttttttccatcgtaccttttaagtaaaaattaaacagtataagcaaattatatagtataattatccataaaaaagaaagtgaatcaatatggatatcttacaaaataagagaagaggataagaaagaacagaaataaccatcttaaagttgattgattatcttttgcaggtaaatataaatttatgttgaaagaatatttgaaattcttcctaatgcgtatgaaaaagactaccatgatgagaaaaaaacttatggaaatggaaggaatatattttttaaatatcatagcttattctttgtgatcactataacaattaaattaatttctaataatattattactgtagacatttagaaataaaaaaagttagccactaatgctatcatcattataatagaattagttagtctgtccgcgcttcgtgcggtcataaaaaggtgaacttatgatgtgatcttgttgtaaatttaggtgagatagagtcaacaaaatatttcaaagctcctcatattacaaatttcacgactaatttttattacatatgaaaaatagacaaatgattattctctaacatatgattatgaacatcactaatcccaagagataatatttaaaattgaaaattttcaattaacagaaagcctccccacgtaaaaatatcaaattcttgaactttgctataaagcattgaccacatcgttctctacacctgtatttatcacacaaatgtttggaatggtcaaagcttctatatatgcacatacttatacttgcgattacgtatcttgttagttgatcatcaccaaagtgtcatccatatgcagttatgttaatctccacctccaatggtgtacgtaaaattcaaagaccaccaaaatcaaaagaccaaagacattaagatcacccacgtttagtttagactatagagctatctattacgttaaagtcttgtcaaagaaggttttatttatgtcaagaatttagtaaatctggtaaattatataaatttaactgaattaaagtataaatttataataactaacagaggaagtcctctccttaaagcatcaaccgtggtttctccagttcttggtatatatagtgatgaacttcgttggagatattacttttgaattgcaatatgaaaaagaacacttcaaagttcaatagcaatagttgaacaacagccatgactgcagaaccaatgatgaatagagaggaaaaccattgttattccatgagcaatgattgttgaacaatcctgcagtttgtgaacaaattaatgagttttgacaacaaatattttacaataaacgaaaaaggacagagttcttagtgtaagagtttccaactgttagtcgtgataaacataccaagaataattgccattaatataagattatcatgagaaagaatggatattgatttggctatacttgtagatatttcaatgttccacctgaaacgattgaaaactatatgttgaaagagaaaaagtgaaagagcaaaacaaatggcttacttacaagaaaattaatctgaatggctaaaaatgtccggtgaaaaagaagtacaaaaacccaaaaataatacagtcatttcaagaattcattttcatgttatggattttcagatctgtaagaaacgcttaagatcacacaggaacgttgaccactatccaattcctctccattttcttaatatgctctttgcttcttcataaccatttcttggcaattttaaagaaggggaaaactgtagcaaatgggtactaaataccggcaggtgggaggaattaagaagaggctaattaagtgaattaaagatgtgaccgttttcttgtaacggaaaagaagcgtgttcagtttttcttagtagaacattttaaaaaatggaaaaatttaaggaaaatgctaaaaaaaataacaaaaaagataaatagtaatgctggtcaatggagggtgccacatcacttattctatccccaactttatatatatactagggaatttgccgcgcgtttcgcgcgatttcagaaatagcagcccatttcgaaaggattttatttataaatttattaagaattaaagatagaatttttcagctgtttaactaaaaaactaattttatatattgatgaaaaaaatcacaagataaatgttcttgtaaaattagagcttagaaaactacattttttattatcaaatattcttaaaaatgaaaaaaaaacttttaagggaaaaatcatatatttttttgtggagagagattaatacatgattctcttagtcttatatatttcataatacatgatctaaggacttgatgtttttaaattttattagatattagaacttttgtttgatgaacttgtcttctattcaaataaataaaagaaaataaaacgaaaagcaacgaaactaagtacccgtttggacataaaatttgatggaagatttcttcaaaaaaaaatcacttttttttcgaaatcagcgtttgttcataaaaattttaattttcacttgaagatgcatttaggaaattttcgaaaatttgaaaaattgcaaaaggttgtttttcaaaattttcactcaaatcactcataaaacttcaaaaacaacccaaattgaaatttatatccaaacacaattctaaatttcaaatactattttcactttaaaaaaaaattcaccatttttttgaattttataatttttatgtccaaatgcctactaaaaagtccggaaaaaaaacatattacggacaatgcctgcttgtacacatttaatttccttcacaatcttcccagaagcaactaattagtagtaaatccaagaatttttctcacatcacttttcagtcacttccaatttaaccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttcagttgaaattaaaaaattattttttttagattttttatttgtaaaagataaatctcttatgtgtaaaacatagatctctaatgtgtaaaaacaaatctcccataagttaaaaaaaaaaaaaagaccgaatcataaacctaaaaataactttgtaatggcccacaaaatcatttgactgcagttataatatagttatatatattccaaaatagagggaatgggaagtattaattattacataaaaagaaatagaaaataattgatataaaaatttataataaataaaaacgtgctatcacttcaagaaaatttataccattagaaatcaaattagaaattcacttctaagatcccaaagaagaatgaaacaataaagaacaacatcaattaaaaatcataattacctgtcaaacnnnnnnnnnnnnnnnnnnnnnnnnnnnnnnnnnnnnnnnnnnnnnnnnnnnnnnnnnnnnnnnnnnnnnnacaacgcatcaatgaattaccaaaaagcaaaaacatgataaataaaatggcatccaccatataagagaaataaatagaacaaacaacacttgggaacatttattgtcaggcaaaaataaaacatcaatgaattaccaaaaaataaaaaattatgataaatggatttacatccaaggtagtattgttctaagcctacaattacaaacagataaagaacctgcaagaaaagaagattccaaaagaacgaaaaaaagaatgaaaaaataagttggtggtgagcaactgattaaatttgtgttactttcatctaaagactatttagtttgtatgatactaaataatgttccaaatttattcacggtaaaaaattaaatatctgtatcttatatatatgaaattttcaagaaagatacctggaactattccgagagcattcacagtttgaaagtttgtttggtataataacatctgcagttgcaaaatttcccgtattggcgaaaatatgaaatttagaattaccttatggaacatgatgagttttgactaagcttgttgggaagctgacagaaccttgtgtctacagcctctagcattttgttgggttgttactaccttcaaacgttataattattaggaagaaactaaagaggtggggaaaagaaaaggaagagatagatgcgcaataaagagaatttagagtgaagcagtaattattgagtcatttaatgttatcaaataaggcacataaaaatagaagaagaagaagaagaagaagaagaaaaataagaggaaaaaaaaaaagataaatgtgtttcttggccacagaggtatgccaaatcatcttgcctatgcccacttatatatatatatatatatatatatatatatatatatatatatatatatatatatatatatatatatatatatannnnnnnnnnnnnnnnnnnnnnnnnnnnnnnnnnnntgttttaggaggagcataattttcatcatattctatttttattgtgaatagaaatattataaagtcttaccctttgataaataaaacttcttatttcctataattgttgtagaactttgattgaataacgtgcaaccaaacgtgttcgcacaagaatttaacttcctacactaaaaatgactaatattttttaatacttttacaacaaatgctcacggctcaatccctaatattgaattatttgtcttaccatgattttccatttgggaagtaacaaaattggaaatgtatacttagaacatcatttttaaattaaaaattattaagaggatatgattctaatattttgttcctcataaaataaatataataaaataaaaataacactaactaaccttaaaaatttatacgattgacgggaatatcgtgcaacgcatgtttgctcggagttctacagatatattggatatcaatgaactgtttggtgaaaaaataatcaatcatattaaatatgtttaaactataatatataattatctaactaacataactaaattgatcatttgtgtaagttctgatgatgtctttttattttgaatttatgtattatgctaatgtaataatatttttcactatttagatgattgttgtattattatacataaaatttatgttacaccctgtaactttaacaaacttgataccgttatatatgtatttgatatggtattttgagtaaaatatttttgtgatgaaaaaaatagtttgaaaaatatgactttatatagttattaatattactactttcgaatatgttttaaattatacacctaatatgagaaaagtttatgggattcctttttttgtaaagatatgaattattttcttacaagaaaagaaggttattttttttttaccattttaagaattaaggatacgaaaatttgtactctttatgtgagattaaaaaaattagaagttgagaaaatttatgcattttttacacgtatgttttaataaaataataagtgtatgtatttattttgtatggcaccacatgaccatgataataaagtatattatatgttattgtatgatatataaagtgtattaaaagtgaatagtactttaagtaatttgggataattcttaattgtgtgaataattgggtaattaattcaatattttggataagcttgctcatccttaacgcggcagcaagccaaccatatatgattatgactccgacgaatgcggcaggccgaaaatgacattgcaaacatcagtcgtgactccgacgaggaccgacaaacggcagccatcgaaactgccaatattcatggcaaatttgaggacctccaacaggagcgtgccgacgatttagcccatcagcaacatgaggcagacagactgactgccatgcagcaaaccataaacgacttgactgacaagctcaacgttgtcaatgctgccttacagagcctacttcgagaaggcgatcatcacatcaggggtgcaacaaacctcacccccattccacaaaagcttaagttggtcattaattaataatagatgtggcaagtttagaaatgtaaggatttggcaaatcttataaagtgagtcatttatccacttttaagaaagagttaaatattcattcctaacatattcattcttaagtaagcaaataagttctctttgttatgaaataaaagcaatttagtaaaacgtgaacaagaaatagagatagagagaaggaagagattttcttcttcaattgtgtgtattttcctatctattacaaggcctttatataggcataaatagtgaagaaaatatgtcagggaatatgtcattgaacatacaaattatgtcattgaatatgtcattaagcatttgagatgaagatcatggaggaagagtagacatccaccataatatgatatttatcataacactcccccttggatgttcatagataatgtgcctcgttaaaaccttactaggaaaaaaccctatagaaaaaaaattatagtgaaggaaaaagagtacacaggtttagaaatacgcattttggttgccccgttaaaaaccttgcaaggaaaacccagtgggccaaaaccttgtaaggaaaaaagagtacaacgcatatcaactccccctgatgagagcaccaattcacatccttgatcattcacatcccaatcttgaacactagtttcttgaaggcgtgacaaaactttttcagttaatgtcttagcgagataaagctctactcctacaaggaactctagagggtgtgtactctatggagtgacctcacaatcatcagggtactctatggatgtgctttatccacatagaatcactttaaaatcttttcagtgtatgctgattgatggacaaaaatttcatctttcatatactcaatctgtaggccaagacaaaattttattttttgtctttaaaaaatcattcatttcaaattctttctttaaacagtctactgcttcaggaagctccttgggagttctaatgatatttgaatcatcaacatacacgacgattataacaaattcaaatccagatccttttataaagacacaaggacaaattgaattattcttgtaccattctttcaacaagtactctcttgggcgattataccatatgcgcgctgattgtttcaatgcgtataaggattattgaagctttatttaataaacttggaaaccataatatgcttcagaacaatttaaatccttcaataatttccattatacgcatatcaagtttttcatatattgccagattaaaacctgaaatgccaggatatttataaatcttcttgtgacacaagtcgtctttatgtctatcgacttgtctttcttcttacaagaacacatttataccttcactggctttatactttcaggtgtttggactatccgtccaacttcacatttttcaggtgaaatcaatcttgattgcgtattttttatttggccaatcatttatctatccaaatttcatgacagatttgagctgaagatcctcgtcaatattaataatattgagtgcttcattatattaacaatatcgtcgacgatcactttacgtcggttccattattacctaataaagacataacttattgagatctctttatctcattgttttcaggtaactgagcctctcacatgaggtcttacgaagtgttatatcgtggtgctcttctagatcacttgcctccttattatgaccatctcgaacattttcccctctccttcttcaaggagttttatctttggaactgattggtctgttacgcttcatgcgtgccatagactatgtccctcatggacgttattctatttggagtattagcagctgaaatatgacatttagctttggtcagcaaatgcgtctggcaataatttataaattaattatcacttgaacttcaagttcatattttcttgtacgaggatctatatgtattcataataattcatttcacatatcactttctcagctatccattttctccccctaattttgggatcaccaacatatttcccaaccttctttgggaacccatctttgtgcattgtggtggcataattaaatcatatagcacattcatatttctatatagaaattatttggttcctgaccctgaatcgattgtgaaagagagaaattttcataacatggctagatgcgtacaagttctggtgtatattacataatacatctcatatcaaatttcatttttgggagttttgttctcataaccaataatttagctataattggaggcattccgctaaaccaacatggatttaaaccagtattatcaagataaatcatcataatttacattctggagctgtgctctaataatttgagcaagcaatcttgcaaaagccaaactgcaagttgataacaaatgcacatgtcaccatagaatagatgcacctattaaaatcatataatagaaaacgatccacatggcaggtgactgggcccatatatttatcaccttttattcgttctagaaatcaagggattcaatcccaacttttaactggtatatcatgagaataagcagcgtaagggaattcttgaagaatcttctattacttcaatatatgccaatgtaattttcaattaattttccgcatcataattgaaccgggatggtcaactggtcatgccaactaatatttgttttagtaaacctctagcttgtggcatatgattccagcatcatgcttatatttgtgtagtacaaatagaaagaaaatcgagtaacctttcatatttacctggtataattatagaaatatgaagatattcaatcttcctttcatttatagtctcaatatgccaactactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttgagactttacaatatcaatgtcatgaataattttattcatctagatagtaaaaaattactttccggagctcttaacaatttttgtactacaagatcttttgccacaccattcatatgataaatgattccttcatgaacaaaattatatcataataaattgtcattgtcaaaatcatcataagcaacgtcattttttgctttaattttgctcttaataacttttataaggaataccaaaatattttggggtatcacatgtacgagaccaatgacatattcatgtaaccacacaatactatttattctctttatttctctcaaacctccctcaaaggtgagttgtgtggtactcatccaatcatgtcttgcatgtctttattcattacttttatcatatattactacattcacctttaggaatgggtctacattctcaatgtttatcactagtcacattctcttcaaggaatggatcataatcagtgacgtgcttcataccaatttgatggtaaacattgccttcacattttgaaggattattttgagaacccttgttgttctccttttataatcattgcgatgattattattatttggaacactcgcgttcattgttcaaccacttgtcttcatttagacttattatgcactgctaccacattcacttcaagaatggagctattcaagtgggacaatcttcatgccttttcatgaaaaatattttttttctttagtcatcattatatcatcaatatggtacattgggactcaaacccaatgtcttaccaatataaagacatgttacgccataataaattgggactcaaatccaactcttatcattatggagcatcaggacttgatcccgatgtcttaccctcaatcaatggcataataggctaaacaatattgagattcattcccaatccttaatttcaatcacatgccaagaaagttgtacagagttaatttgcaacttagcaaatcaaatttgctttcttaaataagtgtacaaatctcaaatcagtgtaaaagctttatcaattatttgtagcatctatatgaaatacaaccgtttgtaatcagaatatttcttctatattgtattagagtttaaatggatcataaaataattatcataatatttattaagtctctctcaaaaatattgttgttttcgggatatatcctacctattggatttggtttaacgccatgactttccttcactcaattcaaccaagcaattagtgaataaatttatcaaaagtacaacatatatgtaacaacagatatatagtactaatacataaattcaatatttatattacctgaaaagtgacattataggtaacaacttaccagttgtagcttatggatcattcatataaaatacttgaaaatggtaagtcagtagcaagcatcaagtagatcatgaatactcaaaaatatctctgctagtagtcatactaatcattgtttgctttcaaatgatacgaccataaattatgaagtatactttctcaatagctggtttgttttccaaatttcaaagaagtaattaatcaacctagataaagatgtgaagtatttcttgttttcttcaagatgatttatgcttctaatcagtatgaccaattttattttatttttaattttttttattcctttttttggtaccatatgcaagtgtaaaaagtttggtactatatgcaagtggaaaaaggatatagcatagatattctgatgcacaggataatcaagatgtggttcctttattactttttacctttccccataaattagctgaactaaatccaaagaaggataattgcatagatattgtatatatttttgaattctcgtttgctaaatgcttgaaatgatttttggccacgatcttctctccatgttgtatgatttgcgtgccaaatttttgtgtcgtctgtactgatggttttttgcactggtattgctttgaagtttgaagatactttaaattaatttcccacacctgcaataaaaaaaggaggaaataaatcatgggatttagtcaagaggggaggatgtgacgacccggccggtcgttttaagaatttaggcttgaaatgccgaaagttgaatttttgaagtttccggttcgataatgagattttgatccgagggtcggaatgaaattccaaaagttggagtagctccgtagtgtttaatgtgacgtgtgtgcaaaatttcaggtcattcggacgaggtttgatagaccttttgatcgaaagcgtatttttagagtttttggaatttttaggcttgaatccgatgaaaaataggtgttttgatgttgttttgaccgttctgaaggttggaacaagttttaatgatgttttaggattggttggcatgtttggttgaggtcccgggggcctcgggtgtctttcggatgctcaacgggtcatttttgaacttagagaattgcagaaaaatgttgcagcagtcagttctggtttccttcttcgcgtttgcaagtggggtctcacattcgtgaagaggagctggggatgttgaggaattaacgcttcgcattcgcgaaggagcttacgcgttcgcgaggctgagggactttgtgcctatgcattcgcgaaggcagtctcgcattcgcgtaggggaagagaaatgatcatcgggttcgcggctcaggcatcgcgtttgcgaagagggagactggtgtgtggaactttagtgcatttcactctcgaccgtagcctcgcgttcgcgaagaagaacgcgcctgggcagaatgtttaagttcaaaatcgagggtttagccatttttatcaaaacttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttgagggattttcagagatatcgattgggtaacgattcttaactccttttttcttgtaactcattaatacaaacgtgaattcatcatttaatttcggattggagatgaaaattaggaaaaagttagaagaaagttcttagacctagaattcgacttttgattgggaatttgaccttagatttggataattttggtatgcatgaactcgggagagtgtgaggattctgaaaatataaattttacccgatttcgagacgtgggcccaaggggtgttttagttattttacctaatttcgcgtattagcttagaatttctttgtagaatcagttacttgaagtgttatttacgttatgaaattgaattgaatagatttgggtcatttggagtcgagtactcgtggcaagagcgtggtttcagattgattattgagccagttcgaggtaaatggcatgtctaaccttgtgggggggaccttccccttaggattggtatatttggtaattgaaatgtcttgtacgtgaggtgacgagtgcgtacttgtgctaattattggaaatccggttttcattaagtaatcactagtatgttcctttcctgtttttattacttgcattattatgcctgttgttagcttaggaaagcatgtctaagtgacttaattgttttatttgctcaacctaccttacttgaattatgtgcagcatactaggctagaatcatttgttgccttaatatgaaattttgtcatttctgtatattttgctgttgctgctgcatatttatttgggactacggatgtgggattccggtagctcccccttgtatgtttattttgggactacggatgtgggattctaatagttcccccttgtctttttattttgggactaccgatgtgggatgccggtatatccccctgcacaattatatggaactacaggaatgcacccggtagattccccccgtattgggtatttacatttgggactacggaacaggattccggtagatccccgcgcactatgagttggactatcctggaagatccatcggatatgtatatatggggctacaggatggtatcctggtagatccctggttgttattttggtgctaagtcgcatttctttccgtgttttgccttgtgtctgtaatagttgttgttgtccctttttatatcctgtgttacttttactgttgtatttatttatattgttctgttctacactgtcaaaatttatactttatttaacctcagtagggccctgaccttcctcgttactacccgatcgaggttaggcttggcacctactgagtaccgctgtggtgtactcatgttgcttctacgcatgtttttcatgtgcagatccaaatactgcaactcagtcctaccacctgtaaggcgaggtgactgctctagagacttcggggtacatctgccacgtccatagaccgaggagtccctttctatactagcttttaacatttgcccttctgtattttttttccttgttagatattctggagttagacattgtagatatccaaaggcttgtggttccgtgagttttcggttcttgggatagtgtacttgattctgagaatgttgtgttgtatatgccgagcggcattttaactattgttttcattcagttattttggcttttgattatttcttccgcaagtttcgtttatgttcagcatttgttaggcttagctagtcgtagaggactaggtgctgtctcgatggttcacggagggtgaaccggggtcatgacaagttgttatcagagctataggttcataggagtcatggatcacaagccggtctattaaagtttcgctgatcggtacgaaaacatctgtaattatctacgagaggctatgtaactgttaggaaaattccactttatttgatttccttgtcgtgcgatattttgacatcacaattctaaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttttattctctcatagatggtgaggacacatgctacccgagattatcaggcacccgtgccccctattgcaaccgtcagagaccggggctggggtagaggccgaggacgcgcacgtggtgcagccagagcacttatgcgagctgccgccgaggtaccaccaacagttccagccggagtccaggcacctgacacgcctactgctacaactactccagctcttcaggagactctagcacaattcataagcatgtacaccactatggctcaggcagggttgcttccccttgctgcagctacatctcaggccgggggaggagcacagactcccgccgctcgtacccctgagcagtgagtgcatgttgagcaggtccctgagattattcttgtaccgcttgcagtgccagttcagcccgagggcagggcagcggcttccgaggaggagcaactaaggcttgagaggttcaagaggtacaagcctcttatattcaacggtctagcatcggaggatgctctaggatttctagatgagagttaccgcattctctgtaccatgggtatatccggatcgagcgaggttttcttcactatcttccagcttcaaggagccacttatgagtggtggcgcatttatgagttacacagtctggatgaggctgcttcactgacttagactcagttttcagatctgttcttgagagtgtatgttcctcagagcctcagggacgcatggcgcgcagagtttgagcatttacgccagggtactatgactatctcatattatgcagtctgttacactagtttggctagtcatgcaccagccttggtttctactgttcgcgagagggtttaccggtttattgagggctttattcccatcatcaggttagcatggctcgtgagttggagatggatatttcttatcagcaggtgcgggcattgctaggaggattgagggtatgcatgccagggagagagagagagagaggagagggaggccaagaggtctcgaaagtcgggccatttctctagtgcccgtgccccagctccaggtcgtcattgtaggggttatatgagtcgccctgttctttcagctcttccagtagccagtagtattccagctcctcctagacctcaagagccttattatgcaccatcggtatctagcacgccttctgtgcggggtgctttccggggttagtccaagacctggcccgagctagtcacagccaccacgtcctcccagagcttgttttgagtgtggtgacacacgtcatatggtgagggatttccccagacttgggaggggtgcacctccacagacttcttagccacagtgtgccccacagagttctcaggatatggttacagctccagttaccccacctgctcagccagctagaagtggaggtcggggaggtagaggtcgccctaggggggaggccaggccagatactattcccttcctaccagtaccgaggttgttgcctctgattctgtcatcacaagtattatactggtttgtcatagagatgcatcggttctattcaatctagtctctacttactcttatgtgtcttcttatttgatccgcatttgggtgtatctcgggattctttgagttctcctgtttatgtttctactcctatgggagattctcttattgtggaccacgtttatcggtcgtgtttggtttcttttagtagttttgagaccaaagcctatttattgttactcagcatggttgactttgatattttcttgggcatggactggttgtcgccccattatgctattcttgattgtcacgccaaaaccgtgatgctagctatgccaggcgtaccgcgtgttgagtggaggggtactttagatcacactcccagtagagttatttcttttcttaaagcacagcgtatggttgagaagggtgtgacgcatatttagcttatgtgagagatatcagtattgatacccctttagttgattcagttccagtagaactggattttcccgatgtgtttccagctgacctttcgggcatgctgcctgatagagatattgattttggcattgatctattgccaagcactcagaccatttctattcctccatattgtatggctccttctaagttgaaggagttgaaggatcagttacaggaatttcttgataagggttttattcggcccagtgtatcaccttggggtgctcctatcttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaataaggttacagtgaagaactgttatcctttgcctcgtattgatgatctatttgaccagcttcagggctctaagattgatttgcgctcaggttaccatcagttgaagattcgggagccatatatcccgaagactgctttcaggactcggtatggtcattatgagttccttgttatgtcatttgggctgaccaattccccaacagcctttatgcatttgatgcacagtgtgttccggccgtatcttgacttattcatcattgtctttattgatgatattctggtatattcccggagtcgggaagatcatgagcagcacctgagggttgtgcttcagactctaagagagaagaagttatatgctaagttctagaaatgtgagttttggttggattcagttgcattcttaggccatgtggtatcgagtgagggtattcaaatggatccgaagaagatagaggccgtgcagagttgcccagaccatccttagctaccgagatcttcagtttccttggcctggcgggttactaacgttgttttgtggaggcattttcatcaattgcagccctatgaccaggttgacccagaagggtgctccgttccagtggacagaggagtgtgaggcgagctttcaaaagctcaagacagctttgactacagccccattttttatattgcctacaggttcagggtcttatacagtctattgtgatgccttgaggattggcctcagagcggtgttgatataggacggtagggtgattgcctacacgtccagacagttgaagatacatgagaagaactaccctgttcacgaccttgagttagcggccattgttcacaccctgaagatctggcgccattctttatacggtgtgccttgtgagatttatactgatcatcagagcttgcagcacttgttcgagcaaaaggatctaaattcgcaccaaatgaggtggttagagttgctgaaagactatgacatcactattttgtatcacccgggcaaggacaatgtggtggccgatgcttttagtcaccgggcagagagtttggggagtttggcttatttaccagcatcggagaggcctatggcgatggatgttcaagtcttagccagccagtttgtgagattggatctttcggatcccagtcaggttctagcttgcgtagtttctcggtcttccttatttgatcgtatcagggagcagcagtatgatgaccctcatttgcttgtcctcaaggataaggtccagaacagtgatgccagagatatgactattggtgattatagggtattgaggatgcagggtcggatttgtgtacccaatgttgatgggcttcgagagttgcttctagaggaggcccatagctcgcagtatttcattcatccgactgccacgaagatgtatcaggatttgaggcagcattactggtggagatggatgaagaaagatatagttggatttgtagctcggtgcctcaactgttagtaggtgaagtgtgatctccaaagacctggtgggttacttcagcagatagagatttcggagtggaagtgagagcggatcaccatggactttgtagttgggctcccacggactttgagaaagttcgatgctatttgggtgatttatggatcggctgatcaagtccgctcactttattcctatgtgtactacttattcctcagagcggttggcagagatctatattcgggagattgttcgtctacatggtattctagtgttcatcattttagatagaggtactcagttcacattacggttctggagggccgttcagcatgagttgggtactcgggtagagttgattacaacatttcaacctcagacggatggacagtccgagcacactattcagattcttgcggatatgctctgtgcgtgtgtgattgagtttggagggtcttgggattaattcttgccattggcggagttttcttacaacaacagctattagtccagcatttcagatagcactgtatgatgttttatatggtagacggtgtagatccccggtgggttggcttgagccaggtgaggccaaattattgggcacagacttggttcaggatgctttggagaagttcaaggtgattcaagatagactacgtacagcctagtctagacagaagagttacacggacgaaaggttcgtgatgtttcttatatggttagagagcgagttctgcttcgagtttcgcctatgaagggcattatgagatttgggaagaaaggaaagttgagtccaaggtttattggcccttttgagatattgaggcatgttggggaggttgcttatgagcttgctatacctcccagctttgcaggaattcatctggtatttcatgtttcgatactctagaggtatcacggtaatctgtcgcatgtgttgaattttagttcagtccagttggacaaggatctatcctatgttgaggagccaatggcaatattggataggaaggttagaaaggtgaggtcaaagaatattgcatccgtgaacgttcagtggcggggtcagccggtcgaggaggcgacctgggagaccaggcaggatatgcgcagccgttaccctcaccttttcactacttcaaatatgtctctatgctcgttcgaggacgaacgaatgttttagtgtagaaggatgtgacaacccggtcggtcgttttaagaatttatgccccgatgccccgatcccccatagaacagctgaaacctgcaatttttccaagtctaattctactctatggcctatccaaatctcacccgagtcctcgggactccaatccaaacatgtccaccaacctaaaaacatcatacggacttgctagtgcattcaaattactcaaataacaacaacaactatgaatttagcatcaaaatcatgaaatttcttaagaacaacaaattttccaatttcctcaaataaggtccgattcatatcatttcaagtctgtttcttaccaaattttacagactcgacttaaaccacatataagacatgtaccgggctccagaaccataacacgggcccgatagcatcaaattttaaacacatttcatttccaaaacctataaataatttcagaaaacaattttctttaaaaattcatttcttaggcttgggacctcggaattcgattccaggcatacacccaagtaaatatttttctacggaccctctggaaccgtcaaatcacgggccagggtccgttcacccaaaatgttgaccgaagtcaacttaaattcattttaaagtcaaaattcattatttttcacatattttaacatattggctttctcgccacgcgtccgaactgcgcacgcaaattgaggtgatgcagaaagatgtttttaaggccttggaatacaaaatttacttttaaaacaagtgatgatcttttgggtcatcacatagcataatagtagctacacacgaactctcgtcacctagtgcgtatgtagcccccgcatttagtggcaaattatttgataatatcacctatggggacaattccctcttacaaggttagataggagactcgcctcgctccaagcgtacttccaatatcaagaacgagctcaaactctcaatttggagccgaacgatccaaaactagataaacgaggtaggaactagtcaatacaagcttacaagatcgcattctaacgatttaagcaatttcacaaccttaaacacaagtttcctaaaatctgaccccgggtccacgtgcccggattccgaaatttttcgaagaaagttgttctttataacctaaggaccaataatatatgatttctaatgcatttcataacaaacttcatggttaaatctaacttttatcaaaatcctaggttttgctctaactccatgattttaccttaatctttgtgtgttaatctacccaagactcaagtattaagctagaaataagtagggtaaacttacctcaagatgctaggtgaaggtcctctctcaagagctccaaaatcgcccaatgggtgagtgaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacttcagtgatttctgcatctgcggtcctgctactatgagaggatcgccggatctgtggaattggccaagtgggctaggaccgctcctatggacttgaagccaattctacgcagctgcttctgcaattttgggcctggcctgccttggccgcatctgtgagagaatgaccgcttctgcggtctcgcacctgcggctgaccaatcgcaggtgcggttatgacagcaacctgaagcttcaactcttcttaaattttccaacttcactcgagcctcgtccgattgacgctcggggatcccgggccctgcccaaacataccgacaaatttgaaatcatgaaacggacccgctcgaatctccggaacgcccgtaacaacgctaaatctaagaatcaccccttaaaaccaattggatcaaacttatgaacttcaagttcttcaattcacttctaacgtgccgaaacgtacttatactactcggattgacaccaaattttgcgggcaagtcttaaatgttatattggacctatactaggctctggaaccaacatacgagcctgataccaatgtgatcaatcattatttagtttttttaaatccttagaattttagtttaataatttctaataaaaattcattactcgggctagggaccttagaatttgattccgagcatacgcccatgtcccatattttcctatggaccgtccaggaccgccaaaatacgaatctgggtccgtttactaaaaatgttgaccaaggtcaaacttagccttttaagaaaatattaaggaatcaaatgagcatattccaacccaaactcttccaagtcccgaaccaaccatccccacaagtcgtaaattagttaaagcaagtacgagaagtttcatttaggggaacggggttctaaaaagcaaaacgaccagttgggtcgttacattctccacctcttaaacaaacgttcgtcctcgaacggacatagaaaagtacctgaggtgctgaataaatgtggatatctgctctacacgtccttctcggactcccaggttgcctcctcgactgttggcccttccactggaccttcaccgctgaaatcctcttggatcttaactggctatcctgcctatcagtaatggcaactggctcctcctcataactcatactctcatctagctgaatagtactgaagtctaacacatgggacaagtcggcatgatacctccgaagcatagacaagtgaaaaactgaatgaactcccaataagctgggggtaaagcaagctcgtaagcaacctccccaactcacatcaacacctcaaatgggccaataaaccttgggctcagcttgaccttcttcccgaacctcataacacccttcattggcgatactttcaagaggaccttctcacaaaccatgaatgatacatcacgcgccttctgatccacgtaactcttctgtttggactgagctgtgcgaagcctctcctgaatcaactttaccttgtccaaggcatcttgcaccaaatctttaccgtatatttagcctcaccaggctcaaaccacccaataggagaacgacaccgccgaccatataaagcctcaaatagagccatctcgatgctggactggtggctgttgttgtaagcaaactctgccaaaggcaagaactgatcccactatcctccaaagtcaatcacacatgctctaagcatgtactccaaaatttgaactgttcgctccgattgatcgtcggtctgaggatggaatgttgtgctaagctctatatgggtccccaactcactctgaatggctctccaaaaatgggaagtgaactgagggccaatatctaatacgatggaaacaggcactccgtgcaacctgactatctcccgaatgtaaatctgaggcaatctctctgaagtgtaagtagtcataaccggaataaagtgcaccgatttggtcaacctgtcaacaatgacccatactacatcaaacttccgcaaagtctggggcaacccaactacgaagtccatagtaatgtgctcccacttccattgtggtataggcatctgctgaagtaggccacccggcctctagtgctcatacttaacctgctggcaattcaaacacttagccacatactccattgtgtccttcttcatcctccgccaccaataatgttgtctcaagtcatgatacatcttcgtctcactcggatgaatggaataccatgaactgtgtgcctcctctagtatcctctccatcagaccatcaacattaggaacacataagtgaccctggagtcgcaaaacaccatcctcaccaatagaaaactctttggcactaccctgaagcattgtctctctgagaaccgccaaatgaggatcatcgaactgtcgggccttgatctgccccaataatgaagactgaccaacaacacacgcaagaactcggttgggctctgaaatatccaacctcacaagtctattagccaaggactgaatgtccaaagctagtggcctctcctctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttaaggcaaacgcgaccacattttccttgcccggatgataaagaatggtgatgtcataatccttcagtaactcaagccatctatgctgcctcaaattgagatccctctgctagaataaatgctgtaagccgcgatgatcagtataaacctcatatgacaccccatatagataatgcctctatatcttaagagcatgaacaatcgcggccaacttcaaatcgtgcacaagataattcttctcatggatctttagcttacgtgaagatatgcaataacttgcccttcctgcatcaatacacatcccaatccaacacctgaagagtcgcaatatgccgtatacatccctgaaccggaaggcaacacaagaactggtgtcgtagtcaaagctgtcttgagctcctgaaagctcgcctcataatcatcataccaacggaaaggagcaccctcctgggtcaatctagtcagaggtgatggaatagatgaaaagccatgcacaaatcatctgtaatatcctgttaaccataggaaactcctgatctcggtcactgaagtaggatgtggccaactctaaactgcctcaatatttttgggatccaccttaataccctctcctgacacaacatgcccaaagaatgccactgactctagccaaaaactcacacttggagaacttagcatatagcttttgctctcgcaaggtctggagcactactctcaaatgttactcgtgctcctccaagctacgtgagtatatcaagatgtcgtcaatgaagacgatgacaaaggaatcaatataaggtttgaacaccctgttcatcaagtccataaatgttgttggggcattagtcaagccaaaggacatcaccagaaactcataatagttatatctagtccgaaatgcagtcttcagaatatccgagtcccagatcttcaactgatggtacctgacctcaagtcgatcttagagaacacctaagcaccctgaaactgttcaaacaaatcgtcgatacgaggcaatggatatttgttcttgatagtgactttgttcaactggcggtaatcaatgcgcatccgcatagtctcatccttcatcttcacaaataacactggtgcacccaaggtgatacactaggtcaaacaaaccccttaactaacgactcctcaagcttctctttcaactccttcggaaccatacggtatggtgggatggatataggttgggtgcctggagccaaatcaatacaaaaatcaatatcacgatctggtggcatgccaggaagattagaaggaaacacatcggcaatatcccgaactactgggactaaatcaatcgttggagactctgcggtggtatcccgaacataatccaaataagccaaacaccccttctcgaccatatgacaagccttcaggaaagagataacccgactagacatatcaactgtggaacccttccactccaaccttggcaaccctagcattgataatgtaacagttttggcatggcaatctaggacggcgtgatatggagataaccaatccatgcccaggatgatcgatcatataaagcaacaggagatccgctctagtctcaaaaccacagaatgtgactacacaagaccgatagatccgattcacaaccatagaactacccacaggagtggacacatgaacgggagtgctcaaaggcgcaggaggaataactaggaaatgagcaaacagagatgatacatatgaataggtggaccctggatcaaataataccgaagcatctctaccgcagacgaaaataatacctgtgttgacagtatctgaggctaatacatctggcctagccggaagggcatagaatctggctggagcgccgactggctagcctccacctgactgagcagtagctggctgacctcactctgcctggcccccacctctaggatggcctctacccgtctgtcccccgcctctgggaggctgagcaaccggtgctgaaattataggctgctgaccctactgtactaccttgccccaaagtttggggcaggtcctcttcatgtgactcggatctccacactcgtagtaacccctcggcaccatagcctgttgccttgaagtctgagcctactgagccgaatatccactagaagaactctgaatggctggtgggcgatatgaactctctggcatggcattgaagtaagcactggaagaaccctgatgactagaatacccggtggaggaaccctgaatagctggtggacggtaaggactctccggtatcgcactaaaataaggtctcactagagaacctcggggaggtggtggtggtgctgaatacgggggtatgctgggctgacccctcccggagtgccccctacccctagctggggaacctctaaactctctagaaaatcggtccctcttctcctactgaaactgctctctacccctctggcgataaccctcaatcctacgagcaatctctaccactagctgatactcagtacccatctccacctctcgggccatgctagctcgaataccgaggtgcaaccccgcaacaaacctccgcactctctctgaatctgtgggaagtatcatgagagcatggcgagacaactcagaatatctcgcctcatagtcggtcacggacatctgactctgttcaagatgctcaaactgataccgcagctcttccctctcaaagggtgaaatatccctatccaaaaataactgtgtgaactgaccctaagtgaggggaggagaacctgctggcctgccaagaacataagactgccaccatctgcgggccctgccctccagctgaaaagtagtgaagtctaccccatacgactccaatatcctcatgttgtgcagtttgtccctacacctatcaatgaaatcctaggaaacctcatgacgctcacccccgaagacaggatggtgaagtctagtccatctatccaataacttctgcgggtcaccatccgcagctagtctgggctcgggcactactacagcaactggctgagcctcatccgcaggtagtgcacccgaagtctgatacattgcagctgtgtggctaggagcctgagtagtagggcatgttctccccctcctgcctatgatataggtggatctactggaaataaactagcctgagtcatggtgtccatgaacagcagcatacggccaatgatctcttggaaacccggtgctatcataaagtccaccggggtaggctctgctgcgggcacctcgccctgctcctcaatgataggatctcctgtaggatctgctagtggtgctaccgagacagctttggtacgccctcgtcccctaccttgagccggtgctctcccccggcctctgccttgacctctagcaacggagggagcagctcctcccgggtctaaaaaattagtcgtacgtgtcctcaccatctgtgagagaatagaagagggaaatttagtataccaaccactgcacgataggaaataggtaaagagtagttttcctaacaccctatagactctcgaagatgaatacatacgtctttgtaccgatccgcaagactctattaggttttcccatgacttgtgagacctacatgaacctagtgctctgataccatgttgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacccaattctactatagttcatgatggctcccaacacccttgtcaggcaagccaacgcggaagtgttaacaagtcctcattttctctttactaaaacaagtacagaagttttctaaatttgcagttaaaaagcatgtgataattaacaatgtacaataatagttatacaattcccaaaagaatagtctactaatgtgtgtgccaaaacctggtgtcacaagtttacgggcaactagtagaatatacaaaagaataaatctatcctactgtctgaaatagaatagacaaccaaaataannnnnnnnnnnnnnnnnnnnnnnnnnnnnnnnnnnnnnnnnnnnnnnnnnnnnnnnnnnnnnnnnnnnggagactccatcatgctgctgaatggcacaggaagggagcagctcactatgaaaatctcggacacggatcaagaatgcgcaccggactggtaaccagatgtacctacctcagatcctgtacaattaagtacaaaagtgtagtatgagtacataaacaatatgaacccagtaagtatcctgtctaatatcgaagaagtagagacgagaggtcgacttgacacttactaaggtcaaataatatgagaaatgaattatactgagcatggatataataaataattagcagtttatagcaagaaataacaggtcctctcctagataatatcaaagttgtccactttcattccagggcaaataataaagctcaattcatagaaaaatactgagtaaagcatgcgcaagtagtgtcgaggacgtacggcccgatccaacgtaaaagtaaattgtgcactgccgagggtcgaatggcgcaaaccatagatgtatctattaccccgctcgcgaatcaaacatgcgacgcggtcaaatgtaattaaaaacaacaacaagcagataggaatatataaccgaggagcaattactcatagaaatatcaacttctctttaaaaaggccaagaaagataatgttcctcttactagtctcatttaccataatcaccatgatttaaacaatccaaattaaacataaagtttcaagaataacacataaagcatatttttgggtcctagattactcagacttagcataatagtagctacacacggactttcgtcacctagtgcgtacgtagcccccgcatttaatggcaaattatttgattatatcacctacggggacaattccctcttacaaggttagataggagactcaactcgctccaagcgtacttccaatatcaagaacgagctcaaaccctcaatttggagccgaacgatccaaaactagataaatgaggtaggaactagtcaatacaagctcaaaagattgcattctaactatttaagcaattttccaaccttaaacacaagtttcctaaaattcaaccccgggcccacgttcccggatttcaaaatttttcgaagaaagttgttctttataacctaacgattaataatatatgatttcaaacgcatttcataacaaaattcgttgttaaatctaatttttatcaaaaccctaggttttgctctaaccccataattttaccttaatctttgtgtgttaatctacctaagactcaagtattaaactagaaataagtagtgtaaacttacctgaagatgctaggtgaaggtcctctctcaagagctcaaaaatagcccaatgggtgagtaaaaatggccaaaatgacttagagcccgtaataaatgaagctcactgcttcagtgattttcacatctgcggtcccgcttctgcgagaggaaggccgcatctacggaattggccaagtgggctgggaccgctcctgcggtcttgaagccgcttctgcgattttgggcctggcctgccttggtcgcatttgcgagagaacgaccgcttctgcggtctcgcacctgcggctaaccaaccgcaggtacggttatgacagcaacatgaagctttagctcttctcaaattttccaacttcactcgagcctcgtccgattgacgctcggggctcccgggccctgcccgaacataccgacaagtttgaaatcatgaaacagacccgcgtgaacctccttaacacccgaaaaaacactaaatctaagaatcaccccttaaaaccaattggatcaaacttatgaacttcaagttcttcaattcacttctaacgtgccgaaacgtacttannnnnnnnnnnnnnnnnnnnnnnnnnnnnnnnnnnnnnnnnnnnnnnnnnnnnnnnnnnnnnnnntactattcggattgacaccaaattttgcaggcaagtcttaaatgtattggacttgtactgggctctggaaccaatatacgatcccgataccaatgtgatcaatcattatttagtttctttaaatccttagaatttcagtttaacaatttctaataaaaattcattactcaggctagggannnnnnnnnnnnnnnnnnnnnnnnnnnnnnnnnnnnnnnnnnnnnnnnnnnnnnnnnnnnnnnnnnnnnnnnnnnnnnnatcgaaattcgattccgggcatacgcccaggtcccatattttcctccggaccctccggggccgccaaaacacgtattcgggttcgtttgctaaaaatgttgatcaaggtcaaacttagccttttaagaaaatcttaaggaatcaaatgagcctattccaacccaaactcttctaaatcacgaaccaaccattcccacaggtcgtaaattagttaaagcaagcgcaagaagtttcatttaggggaacgtgattttaaaaagcaaaacaactagtcgggtcgttataattacatgatcattggcatgacacattggtatctttttgaactcccgtaagttttactattctatcatctgtgtatgagttttaaaaatacgtaagttggttaaagttgcatttaactaggggcgtcactgctctatcgaaaacaaggggtgtcactgttgtttcgagaagatgctgannnnnnnnnnnnnnnnnnnnnnnnnnnnnnnnnnnnnnnnnnnnnnnnnnnnnnnnnnnnnnnnnnnctttttggtttatatattgcatataactaatattagatttttcctgaaccatcccaattttcttggttttatggcattatctgttagattcagttaacttgaagtacttaagttttaaaaaagacgcataagaatatttactaagatgcctcattgtcatgtaaaataaaaaaaaattaacttaacaagaaaaattataaaactctcactacattttgcattgccgattaaaaaaaagtcttctctattaaaccaagaaaactagtactaagtgattacttattaaaaaataaaaaagaactagtaagtgatattgctcaaaagtttgaaatgattctattcttataagtattaaggttgcctatatttctaattcccaatatgtcctactaccatattatttatatatgagtctcacataaaggtgtctaacgggccggatcagcccgattccggaccgtctcagaccggtgaaaaccggaaccggcccggaccggtagaagggggccgggtgaggctgggttataggagtaaggcagtttgtaccgttcacttttgaaccaccggttaaccggaccggtcaaacccggtcaatgaacaatactgttcatctggttaaccggcccggcccagaccgacccagaccgatttaacggtaacaatttcttttttaagcttgggcctcagattctgaccgttggcaatggtccatttcacaatatggtcgttgcccaatggctaaaattgacatttagcccaatttttgggtttttttaaaaaaaaattaaccccctttgaaaaactataaatacaccccatcttcctcatttctttactcatctctcaattctcaatctcaagttaaatcatgcctcgtacttctagagtgcgctcatatgttttgaaacactttgaggtggtagaagaaaatgaagaagttcagaaagtaaagtgcaagaattgtggtcaagtcttaaatcttcgttcaaaatctggcacagacagtttaaggaggcatataaagaattgtcttgagcgtcctccgaaaattcgtatttaagttgatttgagacaatttgtgttattttaaaattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatattctttatatttttactttatattaatatagcttacaataattatacaaaaattcaaaatacaaaaaaaaagtaaaaataacaataacccggtccggcccggccccatgaacctgtaacccttacggttcaatttttacctggatgaaccccaacccattaaatccggtatgccccaacccataaccgatctgaaccataacccgtacgggtactaaattcccctacccagcccggcccggcccacccattaaacacctatagtctcataacattacaagagatcgtattgacttacttcactatgcatgtgcatttacccatgactcatatgacgttatatatgcaccaccacctgatcagctggtatacgttgatgattctgcccacaatggcactagatggcgttatatacgtatatatatatcatatcatcttggccactgtgggcaaatcatcaacgtataccaactgatatatatatataggatatgggaaaaggttatgacgttatatacgcaccaccacctgatcagctggtatacgttgatgatttgcccatagtgaccgagatgatatgatgggatgccctcagaggcttgatgattttatgtacgtacagacctatgcattatatgacatttatatgcatgccattataaatattttatgatttacaaagctatccagacttacaagtatagataatcggtttggcgagccctcatagtagacgagattggcattcagcgaaggattggtaagacttcacctcattcagagtgcaggcgagtctataagtcatcgtgtcagagtttttgtacagacttatgggtaggtcggtaccctgtcccattttatgtcaaataatcttagaggctttgtagacagaggttcagttggtacagtatgtcagaggccttgacgggcccatatgtattcatgttttaataaatatgattcagtgatacagtgttgcccacttatagttatgcattacgagttgtagctatgttggcccatgatagttataaaaggaatgaaaaagttacagagtgattcgctcgggccaatgcgacaccaggtgccagccacgcctcccaaggttggggcgtgacaatttctttcattaattaaattttgttgttccttcatataaataaatgtttaaaccatcacatataattattaacgtgcaacgcagttcatagatactagtaataaataaatgtagatagtcgtttatgtttttttttgttgctcaacctcgatatatttgatatattcattttttctgcttgggactaattcatcgatatggagtatcatataaaacacaaaacttcaagactaatgtggaatcaaaagagctcacatgcactaagcgaaataataatataattatagacttgcatggtcgatattgtcaaccagcttaattaagacagagatgcaattattgcttttattttatggtgatttttggaactccaagaatcaaaagaagacttattaaagaatgacagtctctcttttgtgctaaaattttacattgtttgcaacaacaaaaaaaaaaggaaaaaaagaagatggctgatgtagcagtgaattttctggtagagaatttgatgcagttgttgagggacaatacagagctaatatttggagtgaaaggtgaggcagagaatctgcttcaagatttgagtgagttcaatgcgtttctgaagcaagcagacaagtcccgcagcgataacgaagttctaaaagaattggtgaagagtatcagaaaagtgacgaatgattctgaagacgctattgataagtttgtaattgaggcaaagcttcacaaggacaaaggggtaggcaggtttgtggacattgcgcattataaaagagtgaaagatgtagcccttgagattaaaggtatcagagatagggtgaaagaaatccgtctgaacaatgcacatggccttcaagctcttcaagatgatgatccatccaacagaggcgtggaagacagaaaggtacctatattatatatgccttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaatcgaatctcgctcattttcaggtaagatttacttagctcgctccttgctcgcgaagcggcataccaataaaaagaaaagcgttatcggatttccatcgtcgttgtccgtcgataggaaggagatactgagaatgagagacacaaagataagacttaagagaagcgaactaacaagtgaggcttgctcagttgataaaagcacctctacccacgaccgttaggtcctgggttcgagtcatgctggaggagaagggtggaaacactatagatcctcctaaattgggagggatattaaaaaaaaaaaaaaaaaaaagagaagcgaaaagagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagacttcgatataaactaagaaaaaataagtctaaagagagtggatgggttcggattctcggatatccgatccaaatgcacagccctaaacccagcattgcatttatatatatatatatatatatatatatatatatatatatatatttaacaggtttagactccttaataagaatgaaggtgagtaagattagatgacaatatgctgcttaaatataaccaattcagatgtctccattgagcctccagcagaatataatggtacaatcaacggaactgtattgcacttaaatatactttgcacaggaagatactcctgcgcaaagttcatagaatgattatcaattttatatgagaagccgacataatcaacaaaatgagtatcgtaaaaatgtgaaagtaagaaggatgtgtggcatttcttggacaatatctatattgttgtaatgttagtgttctatatatgtcttgggaaaatccacctttgcttctatttactactgagtatcaatttttccaatacaaaacaaagctaatcacctatcttttaattaagctgcacaaatgcgtacgtaatacaatatgttttggttgaatataatgtttcttttcttgccaatgaacgttaacttcatatatatgtctaatcttcatctttgatattaatttaaaagcctcccgtggttgaggaagatgatgtggtgggctttgatgaggaggcacagaaggtaatcgaccgtcttcttgacagatcagatgaattagaggttattccagttgtaggaatgcctggtcttggcaaaaccacactagcaactaagattttcaagcatcggaaggttgaatacgagttctttactcgagtttgggtttatgtctcgcaatcatacaagacaagagaattatatctcaacatcattagcaaattcaccggaaaaacaaaacaataccaatatatgtgtgggaacgtatcaagattgctttcccgaacaacaaaaagtgcaatagagtattgttgaccactcgagatcacaaggtggctcatcattgcaacaatactccacatgatttaaaatttcttagcgatgaggaaagttggatgttgctagagaagaaagtttttcacaaggctaaatgtcctccggaattggaaagacctggacagagcatagccaggaagtgtaagggacttccccttgcaattgtggtgattgcaggagctctaatagggaaacgcaagacaacaagggagtgggagcaagtggatcagagtgttggtgaacacctcattaatagaaaccagccaaagaattgtaataaaattggtgcaaatgagttatgatcgtttgccttacgacttgaaagcatgctttttgtattgtggtgcatttcccagaggctttgagatccctgcttggaatttgatccgtttatggatcgccgaaggcttcatccaatacaaagggcccttatcccttgaacgtaaagcagaggattacttgaatgatctcgtcaacagaaacttagtgatgataattcaaaggacgtctgatggacaaatcaaaacatgtcgtgttcatgacatgttgcatgagttttgctggcaagaggccacaacagaagaaaatcttttccaagaggtaaaattaggtgttgggcaatttgctcgtgagatacagcaactatccacctaccgccgcttgtgcattcattcctcagttctggaattcatttctatgaagccctctggtgagcatgttaggtcattcctatgtttttcttcagaaaaaattgacatgcccccggttgacatcccaaacataccaaaagactttccattgctaagggtgttggatgctgaatccatcaaattcagttgcttttgcagggagtttttccaattgtattttctgaggtatattgctttctcatctgactttatcaagatccttcctaaacatattggggaactatggaacgtacaaaccctcattgttaacacacaacagagcaatcttgatattcaagcagacatatggaacatgccacggctgaggcatctgcacactaacacgtccgctaaattgcctacgcctgttgccccaaaaagtagcaaggttacctcggtaaatcaatgcctacaaactctctccacaattgcaccagaaagctgcacagaagaagttttttcaagggctccaaacttgaaaaaactgggcattcgtggtaaaatctttatgcttctggaaccaaataagtccgaattgttcaacaatgttaagaagctacaatgtcttgagaacttgaagctgataaatgttggtcaaagtgggaaacaattacgccttcctccaacatatatatttccgacaaatttgaggaagctaacattattagatacctggttggagtgggatgatatgtctgtattgggccagttagagtaccttgaagtcttgaagctgaaagacaatgcatttaagggagaatactgggaaccaaaagttggaggttttcgttccctactagtgttatggatcgaaaggtcagatttagcttcttggaatgcttcaagtgatcactttccaagacttaagcgtcttgttctcgtatcatgtgataaacttgaggaggtccccattggcttggctgatatacgcggcctccaagttatggagttgcgaaattcaaccaagcaaacagcaaaatctgcccgggatatacaggccaaaaaagacaagcaaactcaagaaggggctaaaacccaaaggttcaagctttctatattccctccttatctctgatcaacgcggcgtacagcttctttgaaaggttagttaaatcttccctcactactgtttgatttgtgtttcataatccaaaggaaatgtttaacttgggtgcaattctctgctatctccccttttccaaggaggggtataacttgctaaaatactcgccagtaacatgcagataagaatatttagtaactatgaatttaaacaattcaatcagccagtttctttatctcaaaatcctgtccgttatcatttaacaaacattgaccagaaatatagatgctacaaagttatctccttgcattttgtgctggaaacctaacttctgcaatccttttctgttttcttttttatttcaatggttctctgacttccatatactaataggagtgacagatcacaattttgaacatcatttggaatagtaatcgactaatcgtcagtgtcaaatagttggatgcagtttaattacactctaagtcatgtggcaataatcttatgcatattttctctattggctactcgttttcccttgggatttttggttgcatttagtgattaaccttatgctttgataaaaattcagtaggtaacattctccttggtagggttttattttttttccattctggcctacaatagcaatataggtttttattaaaggaaaaaactaaccagtgagcgttgctattggtacaggtctgaaataattgcatgatgttggctgctggctttttcttccttcagctttatttggctcactgctctcacagtgaagcctattgcattgtcataagtggaacgactgaaccacagttttatgattcttgggtttctttctgtatttcatttgtttgatgtgttttctgttttattttggggttgaaactgtatgttgttcttttcattgtggtgttaacccataaggatagtgtactttaaactacaataagagttgattgattgttggagtcgttggcttcaaagcacaaaatatggatgtacctcaactgcttcatattccagatatatatagtcaggtaaagttataattaactgcatcacactttaatttatcatgcttaaaaataaaggtttgcagattaattacacaaatatgcaagtgattcagtgagataattgcttctacgaatctaaaggtatctcaagaaagctgaatctgatgttaagcgatggcggtacttgaaaataggcctaggaatggaaaccaatactcttaattctgcagtttttccagctgctccaagaggttgcttgaaaatgtacaaggagccggaggacaaagaagaagtattcaaaaatcacaaaaaatccatctgtttatatatattattctttaaagttacaatagatgatatgacatctcttagactagaaaataatatatttgtttttttctcattgcagcccaaaatttctaaataaatgactaataatattactctctctctcatctgtttagttaatttaaacagatgagaatgtgagaggtttttatacactctttttctctatccaaaagtctctaattacaattactaatgacaattaggagtaattactatttataacggagtaggtcaaaccgaaaaaaaaaagttacaaggtggtagtcatttttatttttgttttcatgctttgcgtaaaactgaaaagacagagagaacttatactgttatgttgccgttgaccactctgtcctcggaggtacagatcattaggagctcgattaatattcctaatcacattcaaaaacttttcttttccagcttcactcacgctcaaatcgcgcaacagatcatgcataccgcatcttttgactgaccattgagcttcctccttgtgaccattactaaatttcgacaagccagatcttccaaacaatcctctgctacttcttccaggcttcttaacttattactctttagaatcccctctgcaacccacaattggatcaatctcatgatcctcggggaatgttcctaaatggaggaaacaaggtttcaagtgaataggcaggtgatagtaactcatagcaagtaccgcaaccatatggaactgggtaagtgttctatatcccaaagtaattatacttcatgattctatggttatattcatcatttatttcggatttaaatggacgaaatcaagatttttgcaaaacttttcaagaacgaaaatttaagatttggaggtccacaatacttgaacaaaatggtgtggtggaatgtaaaaataaaaatgttgttgaaattgcattagctcttcttgatacatcaaatgttccaaaaatattaggcaatcatcttccgtcattaaacaaaattgcccctattttaatttattcctttttaaaaattgcccgaactactctcatcttaaagtatttggttgtatatattttgttcttcttcaagatcatgaacgtcataaattatcctctaaagctggtaagtgtatttttgtggggtacaatgacattcaaaaaggatatttgtgttatgatccaatacgccattcattgagaatttctcgacacgttatcttctttgaaaattcttttacttatgctagtaaagactcacaatcttctactaagtcctttttgcaaaaaaaattcactcatgattttgttggccataacaacctagccactggtccattgtagaacttgctcgctactacaactggtactactgatgactctgatccttttttgataatgattctaccttggtaaacgctaatcctttacctcaataacatgagacacatattattccgttaaatcttaataaccaaccttctcctcctcgtcaaaatgccattagacacttacttcgtcacgttctccctccagatcgatatgaatactcaccaggtgaatatggcagaccatacgccttgctaactatattaaattctatggttgtgccaagttcttatatgcaggcaagtggtcagaaatgctgggaggatgcaatgcatgaagaattggttgtccttgagaaaaatgatacacggggatatggtggagagaccgaaaaatgcaataattattgtaagtagatgggtgtactcaatcaagatgaaagctgatggatccctatatcgatacaaggcaagattggtggctcaagggtacaaatagaaatatggaattggctatgataaaatatttgctccggtagctaagatgacgacaatatgtatattgcttgctttcgcgtcaataaaaagttgaaagttacatcaactggacgtcaagaatgttttcatgcacggagacttgcaagaagtggtctatatgaatccactaccaggttataaacattctagcgcaaattaggtgtgtcgtcttaaaaaaatctttgtatggattaaagcagactcctcgctcttggtttgaaaaatttcggacaaaaatcctaggtgctggttttactcagagcatctcagattattcattattcctacgtcggtccagctcagatattactattctccttatttacatagatgatgtgattatcacagaaaatgatgaagttggaatctctcatctgaaaaaactattagactccttgttcaagatgaaggacctaggaaagctaaagttaactattagaagtcatacgattgagtccgcaaaagtatgcagaagatcttcagttaactaatctcacagatgataagaaggttcatactccaatggaagtgaatacgaaatacaaaaaagaggaaggagaacattttggagatcaaactttgtatagacgtttggttgggtcacttatatatcttaccatgagtcgtcatgatatctcttatgcagtacacgtgttaagttaattcatcactaagacttttaagatccactactcagctttgctcagggttattagatacataaggggtattgtgaatcgaagtctcttatttccatcatattcatcgctggacatggtgggatatgctgatgcagattgggctggatgccctgattcaagatgatctactacatgctggtacatgatgcttgtctcgtgcatgatctcatggaagtgtaagaaacaatcctgaacatcgaagtcatccacagaggcagaatatagaagtatgtttgttgcatgctttgaaatcatttggctacgaaggctattatcagaacttgacatcaagatcgaaggatcaaccatattgtatgtagacaataccaatgcaattcgaatagcaaccaacctcgttcatcatgaaaatacaaagcacatagacgtagacggcaactacatcagagaactggttgaagatcggagcattaacctaaggtatatatcatctaattaaagatcaactagcagatttgttcacaaaggctatgccaagaagtcgacacaattatcttctatccaaactcatgctttgtgatacatagcattagtttgcgggagggtgttgactataccttatttaagagcccaatctcagggatctcccattatgcctaacagtcaaattgtagagcaaattagctgcccaatttcagggatatttgtctagcaattagtaggctagtaatcaggagataattgagactcctttgcttgtataaatagcttttaaatcctacaattctgaacattgaaatatattagtattctttcattttctgtatctctctctttttcaataaaggcttcaacgacctattttaaattgaaagtgaatttcttctcatccttttttcttcttttagactagtaatttcccttaaaacggaagaaagtttgtagttcccaatctaaatgatatttaaaaattgggtttccaatgtgaaagatataaaagagagttccaaatatttcatttctcccaaattctgtaatgaccagaagatcacattaccaccaaatatatgtgatgatgacagacgagtaaaaaaacaacttcgacatagttgtgaatgagaataagagggggttacgttgtcaatactttaaattcggaagaaattcaaaaatagctagatttacaagtggtcatttaaaaatagtcacagtttcaaaagtaattaaaatttagccatttttcatgtaaagataaatctaaatgaaaacattgttcaaaatccggaaaaatactgcagcataatatactggagttccagtatattatactggtccagcataatatactggagtttggagcaccggtgctccagtctccagtatattatactggagccaacaaagtataccggtccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagttcatatacaggtgcaccgaactccagtatattatgctgaatcgatctctgttgcagcaaaatagtggctattttttaatgacttgacaaacgctgactatttttgaatgaccagtccgaaaactggctagaccttactattttaactgaatacttttcaaaatcattgttaagaaataatttgaatatttttagtaaaactaataaatgttagaaaagggtaaaaagttaccatattattataggaaatattttaattttaccattcattatactttgggactattcatacggttattttagaaaatcgtctcatttttacccttgacctagtggagttcaaacctaaagcataatggtatatatttttaaaatcataatcaaaagtaaaatgtataaagaccctctttttaacaatgttttgatatgtggaatatacccgtcaatattggggctctattaaaatcaaaagctgatacgaaatgaactgataaatctacctcaatttaaaattcatttaatgtataaataaataatcttagaaatttgttagaatataaaatttacctcaatttttaataattattttttgtattacctgtattaagtttatctttacaaagtttttactttcttatattctcaattgtgtaaatagattttgagtatttattgttattaattaaataactgatatgtgcaattttttaattttaaagttcttattctgctcatttatttcattatcaaacgtcattattccatatgcttaattattacttctcactttttttgttctaaaataatatctatttttcaataggtaaaaagtatatcatgttattaaagaagaaaaaaaattaataatttagagggtaaaatggggaatcaattgagatatgagcagaaaaatgcctattgatcaaagctagagacgtctaataatacgtaagtcagcaatcctaaaatacggtttataattttgcatcttaaaatcgatttataaatcgcatttgacacagctccctaatctccctgctcttttggctgatcaacctttcatctttctcgttgaatgattgtgcctttttttctaaatttgtttgttcttcaaaagagtacattagcaaatgattattgccgactttaatttgttccaaatgagtaactgactattaattttgtatgcaaaagcaggtgacttggataccgcacacattattatatttgacaagttgcaattcaaatgcctgatataatagaatgctatgattgtaggatacgatgcacaagggtattggagaaaataggcctgagtaccatagattgaacagagagttgtacatccagatcagtatacatttgcatagatcagtctttagatagcagtcctggagcagggtaaagaaagcacgtgctctattgattaatagccaaagtaatggaaatattataatagtatccttatggacggacatgcatgtatttcaagagtagatgatggctatctcgtgtttagtaagtccttggaaaggaatagggtgacagatgaaataatatttcgaggccccaaaaagtgttaatagtgaaatacataataatatttcgcttagataatatgaagttggtaggaaattaaaataaaacatctttataagaaagaaagaaatactagttaaactttctattagtggataaagttttttacgacaagatccaatgtagtatatttacaaacacattattaaggaaaaggcataagtatcctccttgaaccaaggccggatttttaattacacgtcttatctttgcggggtcttattatatatatatccctgaactattaaagcatcatgctttcatacaggatctgggaaggggtcgcaccccaactagatgtgatcgatataggtaatctattctgatataagcatcagtgacaaataattatgtattatatatacgaaaataataaaatgcatacatatgataaggcatactcattttgaaaatgagaggacaaaacttctaaaaatcactccatgagcttagatttatataagaaggtttttgtcacgatccggatttctcatcctcgggagtcgtgatggtgcctactaatatgagatagacaagctagtcctttaaactaattacttcactatccatttatttctttttacaaacataaagcgataacagaaaaacagcaaaaatttaaattaagcggaagaaaacaataaaatatctgaaatttgtatccattacactgcttaagccttaatcacccaaaacatggtgtcatagtaccacagacggtctaaaatttactatatacaaagtctgaataacatgagcgatacactgtttctgaagcaaaagatgaaacaggaaaataaagataaaggggacgccagggcctgcggacgcttgcaggtctaccttggatctccgcgtggactgaaggtagcctctaactacggtccaagagatgcttcgggatctgcacatagtgcagagtgtagtatcagcacaatcgaccccatgtgctggtaagtgtctagcctaacttcggcgaagtagtgactaggctaggaccagactaccaaataaacctgtgcaattcaaatacatatacatcgaaaaagaaatacagaaataaccagtcaagtatgggagagggagcatgctatggggaagatgttaattccgaacagaaagacaactgtaaatggaagaagcaataaatctcagatatcaataaaaaaaaaagcaataaatgcacggcatcacccttcatgcttttactcttatcctcaccaaagcagccatataatgaaaacatgcacggctgtcacacctcctttttgcgcgccctgccccgaggggttaggtgcgcgggtggagttttttccaatttaagtgacaatattcgaaatgggattattcataacacaggggttgggtctgtctagggctagcaacctgaaatgaaaaagaccatcttgatgcatcctatgtgctacatgttgcattccttcaggggtaaaagggtcatttggcggaccaatgataattgagagtgaatgaaaagg

SEQ ID NO: 2 - DNA, 1142417 bp, Nicotiana tabacum
  modified_base (15699)..(16721): a, c, t, g, unknown or other
  modified_base (18653)..(19126): a, c, t, g, unknown or other
  modified_base (20216)..(20303): a, c, t, g, unknown or other
  modified_base (21426)..(21500): a, c, t, g, unknown or other
  modified_base (22281)..(22367): a, c, t, g, unknown or other
  modified_base (23021)..(23832): a, c, t, g, unknown or other
  modified_base (26490)..(26919): a, c, t, g, unknown or other
  modified_base (29220)..(29287): a, c, t, g, unknown or other
  modified_base (29801)..(29895): a, c, t, g, unknown or other
  modified_base (34245)..(34279): a, c, t, g, unknown or other
  modified_base (34375)..(34486): a, c, t, g, unknown or other
  modified_base (34756)..(34920): a, c, t, g, unknown or other
  modified_base (35876)..(35920): a, c, t, g, unknown or other
  modified_base (36016)..(36410): a, c, t, g, unknown or other
  modified_base (80036)..(80140): a, c, t, g, unknown or other
  modified_base (82170)..(82248): a, c, t, g, unknown or other
  modified_base (82396)..(84734): a, c, t, g, unknown or other
  modified_base (84884)..(85976): a, c, t, g, unknown or other
  modified_base (86174)..(86841): a, c, t, g, unknown or other
  modified_base (87131)..(87452): a, c, t, g, unknown or other
  modified_base (88022)..(88827): a, c, t, g, unknown or other
  modified_base (96622)..(97793): a, c, t, g, unknown or other
  modified_base (115612)..(116395): a, c, t, g, unknown or other
  modified_base (116530)..(116669): a, c, t, g, unknown or other
  modified_base (118244)..(118425): a, c, t, g, unknown or other
  modified_base (119940)..(120159): a, c, t, g, unknown or other
  modified_base (120358)..(121153): a, c, t, g, unknown or other
  modified_base (136656)..(136679): a, c, t, g, unknown or other
  modified_base (153444)..(153530): a, c, t, g, unknown or other
  modified_base (154048)..(154113): a, c, t, g, unknown or other
  modified_base (159531)..(159600): a, c, t, g, unknown or other
  modified_base (174358)..(175182): a, c, t, g, unknown or other
  modified_base (180271)..(181026): a, c, t, g, unknown or other
  modified_base (183331)..(184242): a, c, t, g, unknown or other
  modified_base (200934)..(201936): a, c, t, g, unknown or other
  modified_base (207040)..(207168): a, c, t, g, unknown or other
  modified_base (208121)..(209053): a, c, t, g, unknown or other
  modified_base (209748)..(209827): a, c, t, g, unknown or other
  modified_base (224894)..(225025): a, c, t, g, unknown or other
  modified_base (225127)..(225176): a, c, t, g, unknown or other
  modified_base (237231)..(238318): a, c, t, g, unknown or other
  modified_base (239684)..(240379): a, c, t, g, unknown or other
  modified_base (242311)..(242517): a, c, t, g, unknown or other
  modified_base (243188)..(243277): a, c, t, g, unknown or other
  modified_base (243422)..(243497): a, c, t, g, unknown or other
  modified_base (245953)..(246022): a, c, t, g, unknown or other
  modified_base (253401)..(253458): a, c, t, g, unknown or other
  modified_base (255427)..(255501): a, c, t, g, unknown or other
  modified_base (257119)..(257245): a, c, t, g, unknown or other
  modified_base (258258)..(258689): a, c, t, g, unknown or other
  modified_base (262541)..(262594): a, c, t, g, unknown or other
  modified_base (271906)..(272008): a, c, t, g, unknown or other
  modified_base (272366)..(273087): a, c, t, g, unknown or other
  modified_base (279815)..(280878): a, c, t, g, unknown or other
  modified_base (308143)..(309196): a, c, t, g, unknown or other
  modified_base (311632)..(312626): a, c, t, g, unknown or other
  modified_base (324876)..(325543): a, c, t, g, unknown or other
  modified_base (326402)..(327425): a, c, t, g, unknown or other
  modified_base (332878)..(334163): a, c, t, g, unknown or other
  modified_base (345118)..(346005): a, c, t, g, unknown or other
  modified_base (347275)..(347823): a, c, t, g, unknown or other
  modified_base (365848)..(366627): a, c, t, g, unknown or other
  modified_base (368326)..(369275): a, c, t, g, unknown or other
  modified_base (376763)..(377128): a, c, t, g, unknown or other
  modified_base (378019)..(378819): a, c, t, g, unknown or other
  modified_base (382070)..(382744): a, c, t, g, unknown or other
  modified_base (383158)..(383288): a, c, t, g, unknown or other
  modified_base (383389)..(383829): a, c, t, g, unknown or other
  modified_base (394625)..(395767): a, c, t, g, unknown or other
  modified_base (397762)..(398711): a, c, t, g, unknown or other
  modified_base (402949)..(403023): a, c, t, g, unknown or other
  modified_base (403387)..(404028): a, c, t, g, unknown or other
  modified_base (406705)..(407813): a, c, t, g, unknown or other
  modified_base (409155)..(409262): a, c, t, g, unknown or other
  modified_base (409851)..(409927): a, c, t, g, unknown or other
  modified_base (411131)..(411266): a, c, t, g, unknown or other
  modified_base (411928)..(412005): a, c, t, g, unknown or other
  modified_base (413869)..(413939): a, c, t, g, unknown or other
  modified_base (414653)..(415024): a, c, t, g, unknown or other
  modified_base (419711)..(420669): a, c, t, g, unknown or other
  modified_base (422222)..(423093): a, c, t, g, unknown or other
  modified_base (427832)..(428882): a, c, t, g, unknown or other
  modified_base (431265)..(431565): a, c, t, g, unknown or other
  modified_base (434609)..(435797): a, c, t, g, unknown or other
  modified_base (445200)..(446364): a, c, t, g, unknown or other
  modified_base (452199)..(453295): a, c, t, g, unknown or other
  modified_base (455059)..(456161): a, c, t, g, unknown or other
  modified_base (462831)..(463554): a, c, t, g, unknown or other
  modified_base (466430)..(467108): a, c, t, g, unknown or other
  modified_base (471961)..(472871): a, c, t, g, unknown or other
  modified_base (476337)..(477382): a, c, t, g, unknown or other
  modified_base (478442)..(479806): a, c, t, g, unknown or other
  modified_base (488982)..(490100): a, c, t, g, unknown or other
  modified_base (492759)..(493831): a, c, t, g, unknown or other
  modified_base (503110)..(504320): a, c, t, g, unknown or other
  modified_base (512392)..(513585): a, c, t, g, unknown or other
  modified_base (523187)..(524004): a, c, t, g, unknown or other
  modified_base (524612)..(524690): a, c, t, g, unknown or other
  modified_base (525580)..(525737): a, c, t, g, unknown or other
  modified_base (529224)..(529299): a, c, t, g, unknown or other
  modified_base (533557)..(534644): a, c, t, g, unknown or other
  modified_base (539609)..(540192): a, c, t, g, unknown or other
  modified_base (541207)..(541440): a, c, t, g, unknown or other
  modified_base (541749)..(541862): a, c, t, g, unknown or other
  modified_base (545505)..(545633): a, c, t, g, unknown or other
  modified_base (555306)..(555367): a, c, t, g, unknown or other
  modified_base (557395)..(558257): a, c, t, g, unknown or other
  modified_base (560912)..(562114): a, c, t, g, unknown or other
  modified_base (562519)..(563212): a, c, t, g, unknown or other
  modified_base (564130)..(564333): a, c, t, g, unknown or other
  modified_base (564429)..(568888): a, c, t, g, unknown or other
  modified_base (568984)..(573409): a, c, t, g, unknown or other
  modified_base (574944)..(575363): a, c, t, g, unknown or other
  modified_base (575459)..(576486): a, c, t, g, unknown or other
  modified_base (576646)..(576657): a, c, t, g, unknown or other
  modified_base (576755)..(576807): a, c, t, g, unknown or other
  modified_base (577810)..(578317): a, c, t, g, unknown or other
  modified_base (580670)..(581750): a, c, t, g, unknown or other
  modified_base (584415)..(585428): a, c, t, g, unknown or other
  modified_base (589179)..(590231): a, c, t, g, unknown or other
  modified_base (595071)..(596191): a, c, t, g, unknown or other
  modified_base (605118)..(605119): a, c, t, g, unknown or other
  modified_base (607761)..(607837): a, c, t, g, unknown or other
  modified_base (610215)..(610301): a, c, t, g, unknown or other
  modified_base (613163)..(614053): a, c, t, g, unknown or other
  modified_base (624866)..(625700): a, c, t, g, unknown or other
  modified_base (626509)..(628360): a, c, t, g, unknown or other
  modified_base (646482)..(646843): a, c, t, g, unknown or other
  modified_base (648166)..(648494): a, c, t, g, unknown or other
  modified_base (648845)..(650052): a, c, t, g, unknown or other
  modified_base (659552)..(659768): a, c, t, g, unknown or other
  modified_base (660006)..(660115): a, c, t, g, unknown or other
  modified_base (661469)..(662532): a, c, t, g, unknown or other
  modified_base (691177)..(692223): a, c, t, g, unknown or other
  modified_base (693957)..(695648): a, c, t, g, unknown or other
  modified_base (703163)..(704541): a, c, t, g, unknown or other
  modified_base (706258)..(706332): a, c, t, g, unknown or other
  modified_base (710754)..(710813): a, c, t, g, unknown or other
  modified_base (711128)..(711348): a, c, t, g, unknown or other
  modified_base (712636)..(713802): a, c, t, g, unknown or other
  modified_base (718069)..(719115): a, c, t, g, unknown or other
  modified_base (723756)..(723902): a, c, t, g, unknown or other
  modified_base (732237)..(732416): a, c, t, g, unknown or other
  modified_base (734237)..(735145): a, c, t, g, unknown or other
  modified_base (738208)..(739415): a, c, t, g, unknown or other
  modified_base (742409)..(743098): a, c, t, g, unknown or other
  modified_base (751770)..(752469): a, c, t, g, unknown or other
  modified_base (752860)..(754010): a, c, t, g, unknown or other
  modified_base (759306)..(760477): a, c, t, g, unknown or other
  modified_base (767400)..(767995): a, c, t, g, unknown or other
  modified_base (778242)..(779473): a, c, t, g, unknown or other
  modified_base (790911)..(791801): a, c, t, g, unknown or other
  modified_base (798279)..(799394): a, c, t, g, unknown or other
  modified_base (800566)..(800748): a, c, t, g, unknown or other
  modified_base (803607)..(804602): a, c, t, g, unknown or other
  modified_base (807010)..(808195): a, c, t, g, unknown or other
  modified_base (810998)..(811871): a, c, t, g, unknown or other
  modified_base (813857)..(813930): a, c, t, g, unknown or other
  modified_base (815301)..(815638): a, c, t, g, unknown or other
  modified_base (817168)..(817270): a, c, t, g, unknown or other
  modified_base (817509)..(817736): a, c, t, g, unknown or other
  modified_base (817958)..(820437): a, c, t, g, unknown or other
  modified_base (821238)..(822427): a, c, t, g, unknown or other
  modified_base (822853)..(823225): a, c, t, g, unknown or other
  modified_base (823455)..(823768): a, c, t, g, unknown or other
  modified_base (824491)..(825833): a, c, t, g, unknown or other
  modified_base (825939)..(826224): a, c, t, g, unknown or other
  modified_base (826454)..(826732): a, c, t, g, unknown or other
  modified_base (827844)..(828737): a, c, t, g, unknown or other
  modified_base (828967)..(829060): a, c, t, g, unknown or other
  modified_base (829247)..(829304): a, c, t, g, unknown or other
  modified_base (829544)..(829596): a, c, t, g, unknown or other
  modified_base (832211)..(832372): a, c, t, g, unknown or other
  modified_base (832572)..(833077): a, c, t, g, unknown or other
  modified_base (837445)..(838529): a, c, t, g, unknown or other
  modified_base (839295)..(839923): a, c, t, g, unknown or other
  modified_base (842325)..(843198): a, c, t, g, unknown or other
  modified_base (843986)..(844064): a, c, t, g, unknown or other
  modified_base (845422)..(846114): a, c, t, g, unknown or other
  modified_base (861212)..(862089): a, c, t, g, unknown or other
  modified_base (862971)..(863032): a, c, t, g, unknown or other
  modified_base (863141)..(863272): a, c, t, g, unknown or other
  modified_base (869808)..(870273): a, c, t, g, unknown or other
  modified_base (870884)..(871216): a, c, t, g, unknown or other
  modified_base (871581)..(871680): a, c, t, g, unknown or other
  modified_base (872189)..(872266): a, c, t, g, unknown or other
  modified_base (872464)..(872547): a, c, t, g, unknown or other
  modified_base (873115)..(873203): a, c, t, g, unknown or other
  modified_base (873475)..(874101): a, c, t, g, unknown or other
  modified_base (876065)..(878672): a, c, t, g, unknown or other
  modified_base (880120)..(880120): a, c, t, g, unknown or other
  modified_base (881059)..(884115): a, c, t, g, unknown or other
  modified_base (887566)..(888620): a, c, t, g, unknown or other
  modified_base (892052)..(892406): a, c, t, g, unknown or other
  modified_base (894065)..(895251): a, c, t, g, unknown or other
  modified_base (897572)..(898685): a, c, t, g, unknown or other
  modified_base (904873)..(905594): a, c, t, g, unknown or other
  modified_base (906005)..(906741): a, c, t, g, unknown or other
  modified_base (909458)..(910618): a, c, t, g, unknown or other
  modified_base (915055)..(916250): a, c, t, g, unknown or other
  modified_base (919646)..(920709): a, c, t, g, unknown or other
  modified_base (925217)..(926418): a, c, t, g, unknown or other
  modified_base (929276)..(929903): a, c, t, g, unknown or other
  modified_base (931651)..(932767): a, c, t, g, unknown or other
  modified_base (935855)..(935994): a, c, t, g, unknown or other
  modified_base (938984)..(939036): a, c, t, g, unknown or other
  modified_base (944511)..(944576): a, c, t, g, unknown or other
  modified_base (945150)..(945735): a, c, t, g, unknown or other
  modified_base (949104)..(949193): a, c, t, g, unknown or other
  modified_base (949659)..(949727): a, c, t, g, unknown or other
  modified_base (950734)..(950835): a, c, t, g, unknown or other
  modified_base (950955)..(951150): a, c, t, g, unknown or other
  modified_base (953724)..(954617): a, c, t, g, unknown or other
  modified_base (958666)..(959049): a, c, t, g, unknown or other
  modified_base (963107)..(963717): a, c, t, g, unknown or other
  modified_base (967607)..(967848): a, c, t, g, unknown or other
  modified_base (968058)..(968380): a, c, t, g, unknown or other
  modified_base (974177)..(975275): a, c, t, g, unknown or other
  modified_base (976674)..(976747): a, c, t, g, unknown or other
  modified_base (977219)..(977302): a, c, t, g, unknown or other
  modified_base (979128)..(979523): a, c, t, g, unknown or other
  modified_base (979926)..(980203): a, c, t, g, unknown or other
  modified_base (982509)..(983662): a, c, t, g, unknown or other
  modified_base (987092)..(987848): a, c, t, g, unknown or other
  modified_base (995347)..(996024): a, c, t, g, unknown or other
  modified_base (998513)..(998577): a, c, t, g, unknown or other
  modified_base (1000853)..(1001000): a, c, t, g, unknown or other
  modified_base (1001973)..(1002062): a, c, t, g, unknown or other
  modified_base (1002429)..(1002519): a, c, t, g, unknown or other
  modified_base (1004854)..(1005697): a, c, t, g, unknown or other
  modified_base (1010410)..(1010464): a, c, t, g, unknown or other
  modified_base (1013310)..(1013433): a, c, t, g, unknown or other
  modified_base (1014282)..(1014439): a, c, t, g, unknown or other
  modified_base (1014626)..(1017452): a, c, t, g, unknown or other
  modified_base (1017718)..(1018270): a, c, t, g, unknown or other
  modified_base (1023795)..(1024783): a, c, t, g, unknown or other
  modified_base (1032994)..(1034211): a, c, t, g, unknown or other
  modified_base (1039209)..(1039973): a, c, t, g, unknown or other
  modified_base (1041566)..(1042620): a, c, t, g, unknown or other
  modified_base (1045232)..(1046546): a, c, t, g, unknown or other
  modified_base (1051229)..(1052066): a, c, t, g, unknown or other
  modified_base (1052336)..(1052766): a, c, t, g, unknown or other
  modified_base (1056960)..(1057877): a, c, t, g, unknown or other
  modified_base (1059380)..(1060434): a, c, t, g, unknown or other
  modified_base (1065877)..(1066761): a, c, t, g, unknown or other
  modified_base (1068413)..(1069246): a, c, t, g, unknown or other
  modified_base (1071174)..(1071550): a, c, t, g, unknown or other
  modified_base (1072592)..(1073457): a, c, t, g, unknown or other
  modified_base (1076054)..(1076893): a, c, t, g, unknown or other
  modified_base (1087528)..(1087590): a, c, t, g, unknown or other
  modified_base (1088392)..(1088643): a, c, t, g, unknown or other
  modified_base (1090704)..(1090777): a, c, t, g, unknown or other
  modified_base (1090882)..(1090980): a, c, t, g, unknown or other
  modified_base (1092815)..(1093147): a, c, t, g, unknown or other
  modified_base (1095831)..(1096832): a, c, t, g, unknown or other
  modified_base (1097781)..(1098739): a, c, t, g, unknown or other
  modified_base (1104197)..(1105180): a, c, t, g, unknown or other
  modified_base (1113669)..(1114694): a, c, t, g, unknown or other
  modified_base (1117305)..(1118381): a, c, t, g, unknown or other
  modified_base (1122838)..(1124017): a, c, t, g, unknown or other
  modified_base (1133186)..(1133539): a, c, t, g, unknown or other
  modified_base (1134687)..(1134775): a, c, t, g, unknown or other
  modified_base (1134874)..(1135076): a, c, t, g, unknown or other
  modified_base (1136492)..(1136570): a, c, t, g, unknown or other
  modified_base (1136863)..(1137001): a, c, t, g, unknown or other
  modified_base (1139042)..(1140210): a, c, t, g, unknown or other
  modified_base (1140304)..(1140706): a, c, t, g, unknown or other
  See specification as filed for detailed description of substitutions and preferred embodiments
ggccaattcttcactgcatcgatcttctgagtgtcgacactaatacccgcatcagatatcacatggccaaggaatgctactgagttcagcatgaattcacatttagagagcttagcatataacttatgatcctgaagggtctgtaatactatccgcaaacgagaatacaccagaatgtcatcaatgaatacgatcacgaacacatcaagatagggcctgaatacactattcatgagatccataaaagctgctggggcatttgttagcccgaacgacatcaccaagaactcaaaatgcccatatcttgtccggaaggccgtctttggaatatccttctccttaaccctcacctgatgataccctgaacgcaagtcaatcttggagaaatacttggcaccctggagttggtcaaacaggtcatcaattcttggaagtggatacttgttctttattgtaaacttattcaactgtcgataatcgatacacatccttaacgacccatctttcttccgcacgaacaagactggcgcaccccaaggtgaagtgctaggcctaatgaaacccttatccagcaagtccttcaactgtgccttcaactctcgcaactctgccggggccatcctgtatggagggatagagatcggttgagtgtcaggcaatgcatcaatgctaaactcaatctccctttcaggaggaaggcctgggagttcatctgggaaaacatctggaaattcattgaccacggggattaattgtagagtaggcggcttcgcctccgcatccctaacgcgaacaagatgataaatgtaaccttttgagatcatcttccttgccttaagataggaaataaacctacctttcggcgtagcaatgttccccttccattcaatggcgggttcaccaggaaactgaaacctaaccatcttcgtacgacagtcaacatttgcatagcatgaggccaaccagtccattcccattatcacatcgaaatcaaccatttctaactcaaataaatttgccgaggtttgacgactacaaatcatcacagtgcaacctttatatacccttctagcaatcacagaatctcctatcggagtggataccgcaagtggtttacttatcaattcaggttcaatgccaaacttattagccacaaagggtgtaacatatgataaggtagatcctggatcaattagcgcatatacatcataagaaaacacagacaatatacctgtaacaacatccggagatgactcgagatcttgtcgacctactagagcataggttcgattttgagcaccactcgaactcggcactgaacctctacctctaccacgacctgtcgactgttgaaaaccttgtgctggaggtcgaactgatgaggaagaaccagacacagatccagtcggttgagccataccaccacctcctctgttaggacaatcccgcatcatatggccaggctgtccgcaagaatagcacgcatcggaacctcgacggcacagtccaaagtgggccttgccgcactgatcacaacgaggtgttgggggtctcgtctgactagtatcctatgaattgtgagcctgatgccctcgaactctgacctgaaccagaataggtaaatcgatcataccgaggcctctgaaactgtggaggagcactagctacaggtggcgccgaactcctcgaagactggggcctgatactgcctctgaagtcatcagaataccctgcaaatctcgccctcttatgctggcccctatcctgctccctatctgccctttgctggcgcttacgatcctctagggtctgggcataagcctgaatacgggaaatatccatgccctctaccaaggaggctgttgtgcactcatttatcagatgtggtcccaacccgttcacgaacagatgcaccctatcactcatctcggccaccatatggggagcataccttgctaaagaatcaaactgtatactatactctcgtacactcatattaccctgtcgaaggttcaagaacttatcagctctagctcgtcgtatctcaactggcaagtagtgacgaagaaaggcctcagaaaattccttccacacggctggaggagcgttcggacccctagatctctcccaactatcataccagaaaaccgctaaatcccgtaaccgataagaagccaactctactgcctccgtatcactagcatgcataacccgcaatgtacgatgaacctgatcaataaatgtttgtgggtcctccttggggtctgatccggtaaacactggagggtctagattaataaaatcacgaactctcgcactaaccggtttatcagcagcaccggtattctgcctctgagcctgagcagctaccaagctagtcaacaactgcaccgcactgcgcatatcatggtctgtagtgccagacggaggaactggatgtactgggtgcctcctaatatcctcgggaggagacagagaggtatgagacggcatctcagtctgaggctcactttggcctgctatggctggaggcacctgaatgttaccctctcccacagctgtatcaagccgtttactaatcgcttgcttcctagtcgaaggcatcgctaaaagaaaacaaggtgaatattagatatgaacacttacgactcaactctacgcacgatctagattcaggaagaaggtaacaaccctaggtgtcacatagcctactgattataaatgtggcgcgctacacatccataatctaaactctactagacacggctcatagacaacccctaggacagacttgctctgataccaagtttgtcacgacccaactggagggtcatgactagcacccgggccatacttgccgagcaccaacgtacattttatctaaccttccttattatctttaagggccgacaagatcaatataaatagtagacatggatcatgaacatccaacaatgaaagataatgtcatgaacatacataacatgggacgacaagactgtcaagaaactatatataaggtacgagctatcatgatgccatgaaagactatacaacaaaaatcagccgaaaaggcattctaaaccatacataagtcgatacctgtctatgagcctctaaaagaacataagtgctacaacattgccggaacagggccccgacatacccataaggtctataacaaaaatgcataccaagaccacggcaagtccggagaagggatctcgccaataaccgctgaactggacagcctactgtggtaagggagctacgtctacctgtctatcaggacctgcagcacgacatgcagcgtccacaaataaaaaggacgtcagtacgaataaagtactgagtatgtgaggcaagaaagcataagtaagaacagtaatgtaaacatggatagagaatattcaacctgtgacatctgggtacctctgagggctactgacatgaaatacatgatacatacatatatatacataaacttttaaaacatacgcctttgtgggcatcaccatcatcatatcgtacccggccataataggctcggtaaaacgtactcggccatcatagggctcggtagaatcgtacccggccacgtggagctcggtaaaacccaactgatcagtggttgcacaataggtgccatacccggccaactatagcgcggctcggtagagtaaaatagatacatatagatgatgcatgctggactcattggaatcacattttgaacctttcggagtgacgtaaggtcggtatccttcgtacacgttattaggattaactcttcatcaagaaacttataagaatcaggaactaccaacaacatttataatataagaataagagaagtaacatcaataccaatcgtttcataagaagggcagcaatgtaagtactgctagcttctaagagtagagtatctttgggagctcgttcattacattatgtacaatcggagtcgtacaaaagaatgaaggggatagactcacatcccttctatatactgcccaacctcaagctatgcaaatatcatgactccttagtctacaataagacaaatgacactatcattatcgtttaagcgtcgtaactattatgtatcgaccacaacctattttacgatgaaacggactgcacctcccctatttatatgacttcccacaagtcaatacaatcaccaaacagcccaaacaacatcattaataatcgtattgagcctccaaaacagtccaccaaccaacaacattactaccaagcttttcgatatatatttcacaagttctagcttcaacgacttagctgcaacttggataatcttaaatatatatatagagtaagaggttccttacctttaaaaagaaagaacaactccaatttgaccttaattttccacgaaatatcccttcaattctgccacaagaacaaggaagcgaaactagcaattaattcgggtttttcggcactagaattactttagaagacttgaaatcacctagggttgatattaaaaacttgaaggtgtatttacaggacataaaacacttaaaacaacctcccacacgagctggaacaacacaaaaatcagcaacaacaagacgaacaagaaacttactagcgccacgggattcccgacatttgatttgtgttgtttgccctttgtttgggtcttggatcatgagagaaccttgagagactgtttttagggttataaggtctgaatatactgaaaaataatgacttaaaacggggttgaggtatcttatatatgtccatatgtcttaaaccgcctttgtgggccccatagagagcagcttggtgcactctcgcgaaaacacgaatatctctctattccgagatcgtatcaacaaacggtttaatgcgttggaaactagcctcatagatcttcaatttgataggtagatcaccccataattctaagcacattgggagaaaaattcagtaacatttgacctaaagtttaagtaaaattataaacctaagttgcgacaacttttatcaacttttgtttcataactcgcttgacttcaagacttatgatgcggatattatatgattcaaatacattaaaacaagacctcttgggacagttaatcacctctagtgttacacgaaaatacgggttacaacatccttgattcgtttaacttctaatatttgttaaccactcttatacacccttgtatcgtttaagaccaataggattaacttcttatcatctcaaagataatctcttcttggatttacatcgactaacttacgacatgatctatggtatgcgaatttgggttgtaacaaaaataacttcaactaaggagtagagaccatatgttataaaagagactagggattggagaccctatgtctaaaataacttcaactaggaagtggagaccctatgttggaaaagagactagggagtggagaccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactaggggggggagaccctatattggacaagagactagggagtggagcccctatgtctaaaataacttcaactagggagtggagaccgtatgcctataataaaataaactagggtgtggagaccctatattggaaaagtgactagggagtggagaccctatgcctataataaaataaactagggagtggagaccctatgttgaaaaaaaggactagggaatggagaccccgtgtctaaaaaataaaacacaactagggaatggagaccctatattggacaagagactagggagtagagaccgtatgtctaaaataacttcaactagggaatggagaccctatgtttgaaaatatactagagagtggagaccctatgtctaaaataacatcaactagggagtggagacccaatgttggaaaagagactagggagtagagaccatatgtctaaaaataaaatcaactagggtgtggagaccctatgttggaaaattgactagggagtggagaccctatgcctaaaataaagtaaactagggagtagagaccctatgttgaaaaaaaagactagggaatggagaccatgtgtctaaaaaataaaaatcaactagggaatggagaccctatattggacaagagactagggagtggaaaccgtatgtctaaaataacttcaactagggaatggagaccttatgtttgaaaagagactagagagtggagaccctatgtctaaaataacatcaactagggagtggagaccctgtgttgaaaaagagattagggagtggagaccttatgtctaaaataacttcaactagggattggagacccaatgttggaaacgagactagggagtggagtccctacgtcaaaaataacttcaactaaggactagagaccctatgttataaaagagactagggattggagaccctatgtctaaaataacttcaactagggaatggagaccctatgtttaaaaagagactaaagaatggagaccctatgtctaaaataacatcaactagggagttgagaccctatgttggaaaagagactagagagtagagaccatatgtctaaaaataaaatcacatagggtgtggagaccctatgttggaaaagtgactgggaagtggagaccttatgcctaaaataaagtaaactaggtagtggagaccttatgttgaaaaaagagactagggaatggagaccctatgtctaaaaaataaaaatcaactagggaatggagaccctatattggacaagagactagggagtggagaccgtatgtctaaaataacttcaactagggaatgtagaccctatgtttgaaaagagactagagagtggatatcctatgtctaaaataacatcaactagggagtggagaccctgtgttggaaaaaagattaggaagtggagaccttttgtctaaaaataaaaatcaataagggagtggagacccaatgttggaaaagagactagggagtggagaccctatgtgtaaaaataaaaaccaactagggagtagagaaccctatattggaaaagagactagggagtggagaccgtatgtctaaaataacttcaactagggaatggagaccctatgtttgaaaagatactagagagtggagaccctatgtctaaaataacatcaactagggagtggagaccctgtgttggaaaagagattagggagtggagaccttttgtctaaaaataaaaatcaacaagggattggagaccctatgttggaaaagagactagggagtggagaccctatgtgtaaaaaataaaaatcaactagggtgtggagaaccctatattggaaaatggactagggagtggagaccttatgtctaaaaataaaatcaacttgggagtggagatcttatgttggaaaagagaatagggagtggagaccctatgtataaaataacatcaactagggagtggagaccctgtgttggaaaagagattatggaatggcgaccttatgtttaaaataacttcaactaggtattggaaatccaatgttagaaaagagactagggagtggagaccctacgtctaaaataacttcaactaaggagtagagaccctatgtcggaaaagagactagggactggagaccctgtgtctaaaataacttcaactagggaggggaggccctatgtttgcaaagagactagggagtggagaccctatgtctaaaataacttcaactacgtggtggagaccctatgatggaaaagagactagggagtggagatcttatgtcaaaagtgacatcaactagggagtggagaccctatgttggaaaagagactaaggagtggagaccatatgttggaaaagagacttgggactagagaccctatgtctaaaataactttaactagggagtagagaccctatgttagaaaagagactagggagtatagaccctatgtctaaaataactttaactagggagtgaagaccctatgttggaaaagagactagggagtaaagaccatatgtctaaaaataaaatcaactagggagtggagaccttattttggaaaagagactagggagtagtgaccctatgcctaaaataaaataaactagggagtggagaccctatgttggaaaaagagattaggatagagaccctgtgtctaaaaaataaaaatcaactagggagtggagaccatgtgttggaaaagaaactagggagtggagaccctatgcctacaataaaatcaactagggagtgcagaccctttgttggacaacgagactagggagtggagaccatgtgtcaaaaataacttcaactagggagtggagaccctatgtcttaaatgacttcaactagggagtggagaccagatgtctaaaataacctcaactagggagtggagaccctatgttggaaaagagactagggagtgcacaccctatgtctaaaaataaaattcaactagggagtggagaccttatgttagaaaatagactagggagtggagaccctatgcctaaaataacttcaactaaggagtggagaccctatggtggaaaggagactagggagtgcagaccctatgtctaaaataacttcaactagggagtagagactctatgtttgaaaagagactagggagtgaaggccctatttctaaaataatttcaactagggagtggcgaccctatgttggaaaagaaactacggagtggagaccctatgtctaaaaataaaaatcaactagagagcggagaccctatgtttgaaaagagactagggagtggagaccctatgtctaaaaataaaaatcaactagggagtggagaccctatgttggaaaagtgattagggagtggagcccctatgtctaaaataaaatcaactagggagtggagatcatatgttggaaaagagactagggagtggagaccctatgtctaaaataacgtcatctagggactggagaccctatattggaaaaggagtctaggtagtagagaccctatgtctaaaataaaaccaactaggtattggagaccctatgttgttaaagagactaggtagtggagatcctatgtctaaaatatcatcaactagggagtggagaccctatgttggataaaaggactagggggtggagaccctatgtccaaaatcaaatcaactagcgagtgaagatcctatgttggaaaatgcagctagggattggagaccttatactaccatgatttttaattttctttcttttcattttcatttttttaagagaataagtaaaatgcgggaaaatatttggagaagacttcccttttgaagtgattgttgttgcagagctattttagtctccgcgtggtttctttttggttgcacctgcttcttgcaaggttgctttggattgcacttgtttcctggttttttaaacaaagaataaatttttagtttgaaatggtggttggttttgcggccttgggtgtttcagtcacttgatcttggttggcttctttgatgataatttcacctgcaactagttgtttcctgaataccacttgcatttctggccctggagaacctttggcttttccaacctttaccatgacggctagtcccgtgggacttaaccttttcaactttattttgtatttgtggaatttcactttcgactttattcttctaaagctttcaatttcagatcattggggaacctttggattttcacattttcccattacacttggtcgcgtgggacttaaccctttcaacttcattttgcccttataggcactcccttttgatttccttctttcaaagttttcaattttaaagcatcggccaatcatggccagtcggggtcgattcaatatccttgccgaggctgggcgccttttgaatatatcagcttgcttcaaacaggaaccctgtaaatcggttttgtcgtcctttctttgccttattttggagcaaagttagaccgaaagggattcgaagaaaaataagcaacggagtagaaaaaatgagtttaaaacaagaggtgtccctttcaaggaatagaaggacggacttatctgggagtacatgcggacgtcaatgaacatgacatgccttttgggctggatgcctgatctgtgtaaactgtccgactcttagaaacgcatcacaacttttgccttgaaaaccgagaagccttgcccagaactgtgtcgatgccaatggatgtaaggatcctcttttcgatcaatggcgccttttgcgggttttcaccaattgacctttctcacttctcttctcaccatcgccttatagttctctttgcgagttttcactaataagactctctcattttagttctttactcaccatcaccttaaagtgcccgtgagggttttcaccaataagactctctcattttagtttctttcattttgacgtctccaggaccaaatatctgtgacctctgattcttgatcattcttgcctattggtcggaaggacttgaaagggatttgggtaaacgaattttggattgaattaaaactttggaacctttcgggtgaaatcatcgctaaaacattataattgttgccccagtttcaacttttgggggaatgtggatttttattttggtgtgactgaaccccagagagaggctgcctacgtatccttttggaatcaagtcgaacgtagttcaattaacatgaactgttttttattttcttttgtctttttgtctattttgttttctctctttccttttccttttttttctttttcctttttttctctttcttgtttttttttcttttcaataactccttcaggatccaaagagggtaatcaaaaaaaggtaactggctcaaagggttggcaaaagggttaatggtgtttgggtagcgagaatgaaagccttcttcatcccaaccggaaaacattaatgctatatagagtatcaaacatagtaccttttgactgcacatgcgttgacagttgttttaggaacatttcctttaatgtttcccaagtacaacgctctcttttggaagtactctcgttacaatgtatggacctttccaatctgtagccaatttttctttaattgttctaattctttattttatttccttaaacttatcttcattgcattctaattcttgattcattatttcgaagtctgacagcattttagtatctgggcataaaatccgcaaacatgtcatattattgaaatcttcatttaacagaactgaaaaaagaataagagaagtgacagagtcaagaaaagagacatggacgatgaaatattgattcaattatttgaattttaaagatagaagggtttacaatggaaagtaagacaataaaagtaaaacatccggattacaccctgaaataattcggacgcagaaagaatagtaagaccggctactgcgactcccatttgacagggaactttcaggtttggcgactattttttggcttttctcctgtctcggcaatggttgcaatggccttcagtgccagatcaaattccccatcatcacagatcattccaactactggcccattggtgtgagtaggcagaggattgttcgtcatattaggagtctcttcttccttgagaactattgacttgacctcaatgaggtcctccactgctcttttaagagtccaacaatcttcagtatcatgtctcactgcttcagagtgatattcacatctagcataagctcggtgcgagggggactcggggttcggccagttcgaggccactggctgcaacacacctagcatgattagcttttgaaacaaacttaaatacaattcaccaataggggtgaattgattccttctgaggggctctcttgggcaaggattttattagggaacatttggttggggattatatagagcttggtaggaacgggcatttatgggaggtagagctcgattttgtgtataatgatgtggccgcgtgtaaggttgcgcattcatcaccgcatagtgaggcggttccacggcgtatgcagcatcatgatgagggtaataatgttgcggggttctagacgacatatatgattggttgaatgatctgcgggactcctcgagctcgaagccatcatggctccctcttctctcatgtttctattcatcaaactccccaaaacattctgaacggcctatgatgtggccttaaaggcagcttgactcaagattcagcctgttttcaaaccattttcgaccatctctccaattttgatagcctcggcaaacggattacccatagcggacatcatgttctggaagtagtccgcctcttgggcctgtaggaagacaatagccatttctgcttcgtccattggaggctttaccctggcggcttgctcgcgccatttgacagcatattcacgaaaactttccgcgattttctttttcaaattggacaaagagttctctttttttggattttttcactcttgctttctttctttctttcttttgttttttgctctttatttttctttgttatttttgtcactcctttatttctttttctttcttctttttttcactcgatttatttaatggctatgatcgaatctgatggggattgcctacgtatcatgacgccgcatgaatacgatcattacatagttcaggattaccgggaacaaagtacataagctagctcttttttgatttctttctttttgatttgctctttgggaattttttaaaagaagacttcttaaagaataaagaaaatattcttggatttcgacttgttctttggggaattttgacataaaggacttctaaagaaaaaagaaaatatttttgaattttgacatttttgcctttgaatttccaaaagaacgacttctaaagaagaaagaaaatattttagattttgatttaaattttttttttgaatttttgggagaaagacttctgaataaggaaaaaaaatatttttggatgttgatttgatttgtttatttttttttctcgaatgaaaaacttctaaaaagaaagaaaaatatttttgggtttaaatttttttttattttggattttctaagaaaagacttctaaggaaggaagtaaatgaaaatattttttggatttataaaaattggggctagaaccgatgaggtttgcctacgtatctcacatccggtgagaattagacctgcgtagttcggtcaattttgacacaacaggaaaaatacgactttttgaaaatattggctcattttgaaatgacttttcttttcttttttttttttcaaaatttcgatagagttttaaggttttcaaatacctggatttttcagaaccgggtaaattctctctctcctacctcactcttttttttcttgattttctttccctattctagaagctggtcaacatgcaatccgaaacaatcatatgcacaagtagcacgtaaaatgcatcatgatggtcttttatattgggtacacctgtcctagacggacccaatccctgtgttgagtcctcaaagtcaaatgcacgtgatgtaaacaaacgttcctactagggatctggcatgatgctatgttattctagttttaaatcctggggtatgttgttctagacttggcttacccaagcggacaactagagccgaggggggaagcgtatcgggaatatagaagcttcatcggctttgcatcttgtccgatcctcgttctaaaatcagggatatgactctaacagaaaagaaaccacgcgaagcgcacgcttcccagaagatttagaagacttagagagaagaagggtggcgtaacagttttatatacagttcacagaatatcaaagcggtaaatgagaagcaattagtacattaggcccaaacatgtaatatgagacaatcacatgaaatccaagcataacaattattctaagctcgaattctgaaccctaaaccagaagttttgggttccattccccagcagagtcgccagaggtatcacacctcatttttcctgagggataggaaaatttttccaattaaagtgatattattcaaaataggataatttacttaattcagagtcgccacttgggataattattatggtgtcccaagtcaccgatttattttagaatcccaaatcgaggaaattgactctatttatggtctgcgaacatagaagaccgggtagggaattctgttaacccgggagaaggtgtgacgcactcctgagttctgtggttttagcacggtcgcttaacaattaatacttggcctaattatctaaaaaattaagacttatgtgaattaacttttctataccgcatttaattatatatttaaccatttttaatatttataaaatttatttgaacaagtcgcgatgtcgcgcacttgttgttttttgtacatattgtgaatcgctccaggtgaaacgcacctgcgatttataatatgcttatttttattattatttgaagctatggtcaagtcgcgtgaaacacgcacttgaattggggttacgtatcatgactatgccacgggaaccgtacctataaccacgggaactgtttatgagttgcttattttcctaaggtttgagattgttgtgaggccatgaattatggaagattattttgggagaaggataagagagtatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgttataaatttattaggggggaaatggactaactaacatgacatagtacctaaacccaaattcatgtagctttttaaatgaccccactgtcccactagataaggaacaaactcaaacaagtgaaactagaatatcaactaattgtctaaacggatcagatggccaagaaattcaaaattccacatcaattaagtcaacaactcggctcaaaactttgtctaattaatttatgactaaagtcacttaatggaattacatgtcttaaacctctttttaattaagtccaaatccttcttagtctagtaccgataaatcttactgtctcatccaatataaacatatatcaacaaaattgcttttgtatttaaagcaacaaacattttccatatatgtttagttataattagatctactgattcaaaggcattaagttgacaaaagacaagaaaacaaacaatcatcacatttaaaaaatagaatattcacatggctaaaagacgaagaaataaacagcatattaaaaattggtgagggaagtaaaaatataccttgtattgattggatccaaactttaaaattgctgctgcgcaacaatcaaaccaagagcagcgactacaactgagaacctccaacggcacaaccttgtcggaagcacgaaattgactgaaaagtggagaagtttcagggttgtttcttagctgatgtttatggggttgaaaggttatggaggaaactggtttgttgggtggagatgggggattgtttcagctgggtttttcaactggttttggtagcattttttgagctgatttttgtggaatgaagctggttttagagcttggtttcaggtgtgttttggtgttgattttgggtggaaaaagggcagcattttggactgttttacagctgattttcgctgctcttcctagctgttttcacagcttgttttgctgctctttagtgtggattttgaggtgtttcatggtgtattttggggtggagatgaaatgattttttgggggtgattttagtgatgttttatgggtgtttttaatggctaaaaattgctcccgttttttgaacttttcttggatgctttggaggagttttggtcgaggaatgaggctaggagaagaagaggtaggcgctaggattttcctccgttggtctctgtttttcatcccctttgtgcagtgtgtgtgcgctctataactgatgtgaggaagtggggatgatttatgagggagacgtgagggagagtggaagtgagtgtgtgctagtgtaaagtgatgtgagggagttggggggaaaagggataaagtgagtgtgtgctagtgtaaaatgacgtgagggagttagggaaaagggggtaaagtagtgctagtgtaaagtgacgtgagggagttggggaaaagggataaagtgaggtattggtgagataatgggatataattttcttaagtaacacttataaaaggtgaaataagagctaaaatatgtagattaaacttaaaatatacttacctactaaaaagtgggagaaaattcaaatattgtaaaaaattaggtgctcacaattattacaataataaaaatcaaaaagcagaacatacacgtgcttaaaattgcagcttcgcgaaaattccaaaaagaaaataaaggtactgcagagtctagagctacaatttgaagggcaagcgtataaatagacgtaagcaataagccctagtaagaacaagttcaagaaactattcattcaaaacctaattagggcaacaaaaagaaatgaatccagctgataatgcaaccttctctttctctgatcttgattttctggactctattgaccaccatcttctgattaattccgatttttcgaacagtttttcgccgatgagttcgagcaacgtcgcaactcctaatagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagttcaagttttggcagctgccttttggatgaaaacattgaagaaacaacaactcccgaatctcaatccaagcccgaggagcaaacgcagggcggaaaggcggcgcgtgagagaaacacgaatcaagattggaggcggtacataggagtgagacagcggccgtggggaaagtttgcggcggaaataagggaccccgacaggagaggtgccagactgtggctaggaacttatgagaccccagagtaacgcttacgatcaagccgctttcaaaaggtatatgttctctaagaagctgaaaatattaactctaattctttactttataaagctatcaataatttcaactcattgcaagtaaatctccattctgtaaacgtttaaccatgtcaatgaaggagtataaagtattcaatgtttaatgatttgcaaactgatattcggcaatcaattccggtttgtaatgatccacattagtttctcatttcaataatatccggtcttctttagcaataaagaaaaataacaacaacaacaacccagtataatcccactagtagggtctggggagggtagtgtgtacgtaaaccttacccctaccctgggatagagaggctgtttccaatagaccctcggcatccttccctccaagaactacccacctttattcttggggtgactcgaactcacaacctcttggttggaagtggaggatgcttaccatcatagcaatccagggtgaccagtgtaggcttcctcttcacttctgcaattttgagaaacaaaaaaaaccataatcatatggaatcttctctaatattgcacatgcatgtctgacaaatttcaattattgaatactttttaattcccgtatgatgctgtacttgaaattatataataatcaaggttccttttgtactctttttaaattatcggatgtgtttttctaacaatcataaagccacggaggtactaattgctaagaagttgccgaacaagttttaggatattcgcaaaaagtgtcaaagctcccccatataaaattaaagtcgatgcagctcgtctttaattaacagatatttaagtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttatatatgatgctccaccaactggaaacgaaaatgagaaatcaaataggccttgaaatataatcatgaatttgctgatattctaaaggtcgtcccagtaaacaaattataaagagaagaatccatagtaaaaatttatttaagcattaaatacatcttcaacgaaagatgagccgtaaaagacataagtagccacacctctttaattttgatttctatttcctgtgtaatatcgtgtgctagtattatatcctcacgagttcacatttcgaaaatgtactggacatttctttcttgaaatggaaaattaaatgcttctaaaatttgacagctcatgttatcagaaaaccaaagaggtttttgagaaaaagctatacatatactaggttttttctacaaataaatatatatctctgttttaaaaactaaaacagagagaataaaatgttaggataataaaaactaaaaagcataacatacatgtgcttaaaatggcacctgtatagaaattccagaaaaaaaataatgatggtaggggaccagagctacagttataggccaagcgtataaatagacgtacagtatcaactgttccattcatccagaattaataaaccctagtaattagagaaagtgcaagaaacatttatttcaaaactctagagaaaagaaaatgaatccagcagatataaccttctctttctctgattttaatctccttgaatccataaagcaacatcttctaaatgattcagatttttctgaaattctttcgccaatgagttcaagtaacgcattgcctaacagtcctagctcaagttttggcagctccccttcagcagaaaatagcttcgaaacctccttttgggatgaaaaatttgaggaaacaataccaaatctcgaagaaaagtgcgagtccgaggaggaaacgaaggggaatgtggtggcgcgtgagaagaacgcgccgcaagattggaggcggtacatagtagtgaaacggcggccatgggggacgttttcaccggagatgagagaccccgataggagaggggcaagactgtggttaggaacttatgagactcctgaggatgcagcattggctccgctttcaaaatccgcgnnnnnnnnnnnnnnnnnnnnnnnnnnnnnnnnnnnnnnnnnnnnnnnnnnnnnnnnnnnnnnnnnnnnnnnnnnncgctcaattttcctcacttaattggctcaaacatgcctaagctggctagagttacagcgaggcgtagtcgtacacgctcacccgagccatcgtcttcttcgtccacctcatcatcagtaaatgtaacaagaaaaaggaaaatagatgtgataaattccatagccaaagctaaatatggttggaacctccagatgttaatataactatatttggaagggtatatatttagtgttttagtattagaataacgtttttaaattttttgacactacaacattttagttttattgggtggccaaaacaagcgtaatctttgacctaagggcacgttttttaactattgccttacaagccacgcttaaaagcgtggcttatttgataacaaagacaacgcttactacaccccatatgtaatatttttataccttacagctaagctgtccaacgggacgggaggatatttagccgggacagtggcaagacgggcctaaacgggacgaaacggtaggcccatcccatcccgctaccgaacgagaagggacgggacggtttcgcggaccttaagtgggctgatttttaaaaatatatatttatttaaccattaagtttggcaacgtctagtttttttacttatttaataaacttaaaacttaataaattataagaaaattaggaaactaagtaaaaaattataaaatattaaaaaaagacttgtaatgaaatattttagtaattataatagagttgtaatttatttaatataatttcaagccattaagtnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaaagcttagagccttttattttattaatagaagtttcaaatttcacatacaaatataattcttttgaaaagcacataatctacgcagccaccttctaggaagggttctatttgatctaggcctcttagtagccaattataaattatcatactaatatttgtaagctcatatatagtttcgttgtaacttatctataatttctctcggacattgtctgttgttgtaaaaagttagaacccccgccggatccactaggagcgccagtaccggtgctaggatctgtaatttttccggcttctatttgagcttgcatccataaagaattgtgctccttaagtaagtgcctggctaacccccccgtcccaccactagtcttgtgtacaaatcgttgcttacatttttcacgtatagcacgttgattgactttatcatgtttaaaaaattttcatacaagtgatgtttttggcacgttcacccttaggcttgccccttacaggtggtaccgggggtaaagctccagaccgagattgactctgagttagaccttgtgttgcaggactagtgggtgtttcatctaattcttcttcctcattttcttcatcctcaataaaaatatcattgccaaattgtctttgtaaagtttcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaataaagttttatcaacataagtcatttcatctatatattttctaattcttggagaaggattaggattaggattaggattactactactatcacctttactactttttttaaataggccaaatacatttttaggtgccataatttaaatatgaaatcaaattaaaaaagttaacacaaaaattaaacacacaaatgaaatacgaaattaaatttaaaaagttaacacaaaaattaaacacacaaataaaatacgaaaatagaacaagtaaagtaaacacaaaaattaagcactaaatttgcaatggaggtcgttgcccaatggctatattacaataaaaacaatttaaaaaacacgtgggacaggcgggacgggacggaaacgggataaacaggacgggataaacgggacgaaatgggaatcccatcccatcccttgtaccgtttaacgtgggcccatcccgtttagatttaagtggtccgtcccgtcccgttggacaaccttacttacagctaggagtggcaaacgggcgggtcggatcggatatgaatcgggtcaaaaacgggtaatgaaaaaatggataaattatccgacccgacccatatttaatacggataaaaaacggattaaccggcggataatatgggcaaccatattatccatcacttcttgaatatgatcacttttgggagaattcctagtctcccaaacttgaggaaccctcattgttctctttacttgtacgctgcaaagtatattagaagaaataaataacaaacatcaatacaacaacaacaacaacaacaacggcgatcgagtaaaattccactagtggggtttggggagggtagtgtatacgcagaccttacccctaccccgaggagtagagaggttgttctctttattaggagtataccttacccctaacaaacatcaatgtattctaaaaaagtatgtaaagaaatgaaagtcatattttttacaaaatatcgaataaatattactgatgccacacacactcttgcaaaattaataggtctcatcagatgcctccaattttattttttcttgttttcataatttaatttgcacatggcctagcaccaaatttctagaaaatgatcaagactcatcgccgataagacctacttcctcttcatttttttgcaaatttctccttctccttgtcttcttccaatcatatgtgaagtgttaagaacttccttcaaagacaactagatcatggatttgtgcataggtaatttaccatttccttgttgttgaaaagactccttagattgagttaacctttatctactctttccttctcttgcatttgatattgtgggcataagatgcttccatttatgagttactggtgcttgctctttcacaactctatactccttatcatgagctagtttttcttttttaatctgaaattgcttggccaattcagcacttgatcgaaactgaaaatcaaaacctatcttcttcataggactttgagctttgattcaaaccctttttctttgctcctcaatacattctcataaagaggaaaaatattaattagaaaataccgaaatacagaaagcaaaagatgtcgaaacaatgtgcagaaatgcagaaacgttctgaagatatgcaaaaatactgcagaaatgcagaaccgctatgcaaaaatgcagaaacactgtgcagaaagcaaaaaattcagaaacgcagcagaaacgtagaaattgccggaacgccatgcgtaaacgcagaacactgtgcaaaaatccataaataatttgtagaaatgtagaaacactatgcataaatgcaaaaacactgtgcaaaaatacagaaattgtcgaaatgatgtgcagaaatattgaaaatgcagaaaaattgtgcagaaacgcaaaaaatactgtccagaatgcagcaatttccgtaacgcagtgcagaaacccagaaaaaatgtgcagaaaatacactattcagaaaatgcagaactgtagaaatactacgaagaaataccgaaacgttgtgcagaaatgcaaacacactatgcagaaatgcaaaaattgctgaaatgctgtgcagaaatgcagaaaaacttcgtagaaacgcaaaaaccattgtccataaatgcaaaacattccaaaacgctgtgcagaaatgcagaaaatacagaaaaactgtgcagaaatgcaaaaatattgtgcaaaaatgcaaaaattgccgaaacgctgtgcataaatgcagaaaacttagcagaaacgcaaaaaacacagtccagaaatgtagaaatttctgaaacgctgtgcaaaaatgcagaaacgcaaaatgtcaatgactaacctttcaatggccatataagagcatcttatttatttggctatgtgaattaaagacattcaattagcagataactagtcgaacaaactcagaatacaactcctagcctaaaatttgatactctctgaagaagaaaacctatataaacacacaacataagttgtaactttattaaataattattttgtagcactatgtctgctcctcctagagagagtgaagaatagttgatcaaacaaagttatgcccaatttattttctcgaaatctcacctatttttcccttgataacgaacaaataatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaatttcaaaaaggtactgtcacgacccaattttacctgcaggtcgtgatggcgcccaacactacagctaggcaaaccaactaataaattaagaatacattgataaaatttaaaaccaagaaatcccaaactctaccaacgtgtgtgccaagacctggtgtcataagtgcatgagcatctagtagatgatacaaaactccaaatactgtctgtaatataagaagagacactggtagctgcagaacggcccagaaaggcagctcaccactatgcctcgggatgacgtggatatgtgatgataggtcctccactagtacccgtctcagatcctgcacaaaaagtgcagcaagtgtagtatgagtacgtaaacaacgtgtacccagtaagtatcaagcctaatctcaaagtggtagagacgagatggccgactttgacactcactatgggtcaataataataactgaaataaactaggatatttaaatcaacatgatttacagaatttacaataatttatttaatcagcgaaaataatcaaattccttcaaatgtaacaattctcaatacattaattagattccttcaattcaaataatttctaatttatcaattaaatctcatttacaggagtaacaattaattccttaacaagcaagaataataattaattacattccaaggattttccaatttatcaattagcttcacaagctgaaataaattattaaagtatcgtgtaattattattattaagcacgatttctgtcgaggacgtacggcccgatccagagtgtcgtgtacactgccgagggacgtgcggcacgatccatagatgcatctatcctgccgaggcgttcggcccgctccacaagaaaggaggacattttcttatgtacctccggaaggagagtatatttattataagataaattcgggaggaagaataatttatttaaacaattaattaatttaaatagaaaaccaagcatatgaggttttcatcctttaatatctttatctaacaattcacaatatattcatatatatcaattaatattaattaatcaaagaatataatttacacaagtaatgcatgctttgagtcctaaactacccggactttagcattaatagtagcgacgcacggactctcgtcaccttgtgcgtacgtagcccccaccattagcaacaattatttaattttaatcacctatgaggcagtttccccctcacaagagtagccaagagacttacctcgtcttgctccaatttaaccccctagaaggccttttccacgattatccaaccctgtccggctcgaatctagccagaataattcgatacaatcgggggggggggggggggaagaataatttatttaaacaattaattaatttaaatagaaaaccaggcatatgaggttttcatcctttaatatctttatctaaccattcacaatatattcatatatatcaattaatataaattaatcaaagaatataatttacacaagtaatgcatgctttgagtcctaaactacccggactttagcattaatagtagcgacgcacggactctcgtcaccttgtgcgtacgtagcccccaccattagcaacaattatttaattttaatcacctatgaggcagtttccccctcacaagattagacaagagacttacctcgtcttgctccaatttaacccactagaaggccttttccacgattatccaaccctgtccggctcgaatctagccagaataattcgatacaatcactaaatattataggaatcaattctataagaaaatactacatttttagtaaaaatcccgaaattaattaaatattcgtctgtgaggcccatatctcggaatccggcgaaagttatgaaatccgacaacccattcaattacgagtccaaccatactagttttactcaaatccgactccgaatcgataccgaaatctcaaaaattcgcttctatgagatttctaaattttttccaaatttcaatctcaaaacactaatttaatggtgaaaacaatgatatatttgtgtatatggaccaaatccgagttggaatcacttgccccaaatgtctttccttgacaatctgtcaaaatcgcctctcctccagctccaatttgttaaaaaggcgaatgagacgaatgctctctttttataaaactacccagacagcctttgattgtgaccctcgatcttgggtctcgatcctggccctcgagccttgcctttgatcatggccctcgagttggaccttcgatcatggcttcgnnnnnnnnnnnnnnnnnnnnnnnnnnnnnnnnnnnnnnnnnnnnnnnnnnnnnnnnnnnnnnnnnnnnatacacaagctcgagcctgagcctcgtcaaccctgggctcgatacctgggcccgatatctgggctcgatcacaacctagaatgtccaacagaaaaggaaatattgcagcagctttttaagtccaattttttatccgttaaccatctgaaactcacctgaggccctcgggacctcaaccaaatataccaacaaatcctaaaatatcatacaaacttagttgaacctctaaatcatatcaaacaacgctaaaaccatgaattataccccaattcaagcttaatgaaactaaaatattttcaacttctacattcgatgccggaacctatcaaatcgagtccgattgacctcaaattttgcacacaagtcatacatgacataacggagctgtgaagattttcagaactggattccaaccccgataacaaaaagtcaactccccggtcaaacttccaaactttaaattcctatttttgtcatttcaagcctaatttcactacggacttccaaataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgatcaagatcctaagtctaaaatcaacatacggagctgttagaatcatcaaaattctatttcggggtcgttttcacataattagacatccggtcactatttgaacttaaacttttaaattttttatcaaaattccatatctcgggctagggacctcggaatttgattccaggcatacgcccgagttccaaatcacgatacgaacctaccggaactgtcaaaacattgatccgaatccgtttgctcaaaatgttgaccaaagtcaactcaattgagttttaaagctctaattcacattttaatccatttttcgaggtcttagaacacataattaattattaaatttaaagatgacattttgggtcatcacattctccacctcttaaacaaacgttcatcctcgaacgggtttagaattatacctgaagtgctgaataagtgtggatatctgtttcgcatgttttcctcggcctcccaagtcgcttcctcgactggttggcctctccactagacttttactgtagaaatcctcttggaccttaactggcgaacctgtttatcaacaatggaaattggctcctcttcagaacccggtctattatctagctgagctgtgctgaagtctaacacatgtgataggtcgcaatgatactttcggagcatagatacatgaaagaccagatgaactcccgataggctgggaggaaatgcaagctcataagcaacctccccaactcgtttcaacacctcaaatgggcctataaaccttgggctcaacttgcccttcttgtcgaatctcataattcccttcatcggcgaaaccttcaagagaactttttcacctaccataaatgatacatcacgcgctttctggtccacgtaactcttttgtccggactgtgctatgcgaagtcactcctaaatcaactttaccttttccaaggcatcccttaacaaattagtaccatataacttagcctcacctggctcaaaccatccgataggtaaacgacatcgccggccatataaagcctcaaatggagccatttcgatgtgggattggtaactgttattataagcaaactcagccaaaggcaggaaacgatcccactgacctccaaagtcgatcacacatgccctgagcatatcctacaaaatctgaattgtccgctctgattggccgtcggtctgcggatgaaaggctgtgctgagctctacacaggtccccaactcactctgtactgctctccagaaatgtgaagtaaactgagggcctctatctgatatgatggaaattggcacaccgtgcaaccgaactatctcctgaatataaatctgggccaacctctctgaagtatacgtagtcacaacaggaataaaatgtgccgacttggtcaacctgtcaacaatcacccaaactgcatcaaacttcctcaaggtccgcggcaacccaactacaaagtccatagtaattcgttcccatttccactctggtatagtcatctgctgaagtaggccacctggcctctggtgctcatatttaacttgctggcaatttagacacctagctacatactcaactatgtcctttttcattcgtcgccaccaataatgctgcctcaagtcacgatacatcttcgtagcacctagatgaatagaataccgagaactgtatgcctcctccaggatctttttcctcagtccatccacattaagaacacatagacgatcctggagtcacagaacaccatccgctctaatagtaacttccttggcaccacctcatagtaccattttacgaagaaccatcaagtataggtcatcataatggcgagccttgatctgctcaaatagtgaagattgggccaccacacatgcaagaactcggctgggctctgaaatatccagcctcacaagtttgttagccaaggactgaatatctgaggctaatggcctttcttctgctgaaatgaaagccaaactacctatactctccgctttcctgctcaaggaatctgcaaccacatttgctttgcccggatgatacacgatagtaatatcataatcttttagtaactccagctatctgcgctgcctcaaatttagatctctctgcttgaacaaatgctacaaactgcgatgatcactgtaaacttcacaagacaccccataaagataatgcctccaaatctttagagcgtgaacaatcgcagataactccaaatcatgtactggataattcttcttgtggggcttcaactgacgtgaagcatatataataactcacctttcctgcatcaatgcacaacccaagccaacgcgtgacgcgtcgcaatacactgtatatattcccgaaccatatggtaacactaacacgggtgctgtagtcagtgctgtcttgagcttctgaaagcttgactcacattcatcggaccatcggaactgaacacccttctgggttaatttggtcaaaggtgctgcaatagatgaaaaaccttccacgaatcgacgataataacctgctaaacccagaaaactcctgatctcagtcgccgaagtgggacgatgccaattctgaactgcctcaatctttttgggatcaactttaataccttcgcccgatacaatatgtcccaaaaatgctacagactctagccaaaactcacatttagagaacttagcatatagcttttgttcccgcaatgtctgaagcactactctcatatgctgctcatgttcctccttactgcgcgagtagatcaaatgtcatcaatgaagacaatgacaaacgaatcaatatatggcctgaataccctgttcatcagatccataaacgctgttggggcattagataaaccgaaggacatcaccagaaactcataatgaccatatctagtccgaaaagaagtcttcggaacatccgaatcctgaatcttcaactgatggtaccccgaactcaagtcgatcttagagaataccctagcaccctgcaactggtcaaatagatcatcaatacgtggcaacgggtacttgttcttaatagtgactttgttcaattggcgataatcaatacacatctgcattgttccatccttcttcttcacaaataatactggtacaccccaaggcgatacactcggtctgacgaaccctttggctagtaactcttaaagttgttctttcaattccttcggagccatgcgatacggtggaatagatataggctgggtatttgaagccaagtcaatacagaaatcaatatcacgatcaggtagcatacctgaaagatctgacggaaatacatcagagaactcccgaactacaggcattgaatcaatagccagagtctctgcagtagtatccaaaacataggctagataagccaaacaacccttctcaaccatgtgttgagcctttataaaagaattaactcgattaaatgaactaacagacgaacccttccactccagattaggcaatgctggaatagctaaggtaccagtcttggcatgacaatctagaatatcatgatatggagataaccagtcaatgcccagaataatttcaaaattggtcatctcaagcaataggagatctgctctagtttcataatcacagaatgtaataatacaggaccagtagatctgattcacaataacagaatcgcccacaagagtggacacataaataggagtacacaaggactcacaagaaacaccaaggaatggagcaaatagaggtgacacatatgaatacgtagatcatggatcaaataatactgaggcatctttgccacaaacagaaataatacctgtaatcacggaatctgaggcctctacatctggtctagccagaaaagcatcgaaccgagttggagcgctaactggctggcctccgcctgactgacctccacctctaggacgacccctacccacctgtcctccacctctgggtggtcggactactggtggagcaactggtccgataatcataggctgctgaccctgatgtactggtctacccctaagcctggggcaaaacctccgcatataactgggatccccacactcgtaacaactcttcggtgcgatgtgctgctgactaagtgtctggccctagggacgtgaatacccactgggaggaccttgaatagttggtgggcggtaagaactctctaggatagcactgaggtaagggcgcactggagtacctcgaggaggtggtggtgctggatatgggggtctgctggagtgccccctcacgaattgacctctgcccccagacggagcacctctgaactctccagagtacctgaaccgcttatctctcataatctgctctcggctcnnnnnnnnnnnnnnnnnnnnnnnnnnnnnnnnnnnctctggctatctccacaactcgctcataagaagtacccatctcaacctctcgagccatagtggcctgaataccagtatgtaaaccggctacaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgcatggcgagataattcagaaaacctcgcctcataattagtcactgacatctgaccttgctatagctgctcaaactgaaatcgcaactcttccctctgggaggttggaatatacctgtccaggaagatacgagtgaacctgtcctaagtcatgggaggagaatctgttggacttccaagaacataagactgccaccatctacgggctctgccctctagctgaaaagtagcaaagtctaccccatgagactccaatatcctcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctcacccccaaagataggaggatgtagtctagtccatctgtccaatagtttctgaggatcagcggctacagctggcctggtctccacccacgcatagtgcaccatgggtctgatatacaacaactgcctatccatgagcctgcgcagtaggggtctgtgctcccccacccgcctgagatgtggctaggtctgctagaaataaaccggcctgagtcatattgtccatgaatcgcagcatacgacccatgacatcctgaaatcccggtgcagatgtgaagtccaccggagctggctctgccacaggcacctcaccctactccttaataatgggattctctgctggacccactggcggcataaatggaacagtcctggaatgtcctcgccctctaccacgggctggagccctccctcggactcggcctctgcttcggcctctagcaactgggggagtagctcttccctggtctggaacttcattcgagcgcgttctcaccgtctatgagaaaataagagaaggacttttagtgctacatcaattgcacgctggaatatgaagaaaggtaattgcctaataccctatagcctctcaaagataagtacagacgtcaccgtaccgatccgcaagactctattaggtctgctcataacttgtgatacctacgtaaacctagtgctctgataccatgttgtcacgacccaatttcacttgtaggtcgtgatggcgcccaatactacagctaggcaagccaactaataaattaagcatacattaataaaatttaaaaccaagaaatcccaaactctaccaacgtgtgtgccaagacctggtgtcacaagtgcgtgagcatctagtagatgatacaaaactccaaatattgtctgaaatgaaatagacagaatataaatataagaagagacactggtagctgcagaacggctcagaaaggcannnnnnnnnnnnnnnnnnnnnnnnnnnnnnnnnnnnnnnnnnnnngacatggatatgtgatgataggtcctccactagtacctgtctcagatcctgcacaaaaagtgcagcaagtgtagtatgagtacgtaaacaacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatttaatcaacggaaataatcaaattccttcaaatgtaacaattctcaatatattaattagattccttcaattcaaataattttgaatttatcaattaaatctcatttacaggagtaacaagtaattccttaacaagcaagaataataattcattaaattccaaggattttctaatttatcaattagcttcacaagctgaaataaattattaaagtatcgtgtaattattattattaagcacgatttctgccaaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaatttgggaggagaacaatttcttttaacaattaattgatttaaacagaaaatcaagcctatgagatttccatcctttaatatctttatctaacaattcacaatatattcatatagatatcaattaatataaataaatcaaagaatacaatttacacaagtaaggcatgctttgagtcctaaactacccggactttagcattaatagtagctacgcacggactctcgtcacctcgtgcgtacgtagtccaaaatcaccatacggagctgttggaatcatcaaaattctattccggggtcgttttcacataattagacatccggtcactattcgaacttaaacattttaatttttcatcaaaattccatatctcgggctagggacctcggaatttgattccgggcatacgcccaagtcccaaatcacgatacggacctaccggaactgtcaaaacactgatccgagtccgtttgctcaaaatgttgaccaaagtcaactcaattgagttttaaagctctaatccacattttaatccatttttcacataaaaactttccaaaaattttacggattgcgcacgcaagtcgaggaatgataaatagtacttttcgaggtcttagaacacataattaattattaaatttaaagatgacattttgggtcatcacattctccacctcttaaacaaacgttcgtcctcgaacgggtttagaattatacctgaagtgctgaataagtgtggatatctgctccgcatgttttcctcggcctcccaagtcgcttcctcgactggttggcccctccactggacttttactgcagaaatcctcttggacctcaactggcgaacctgtttatcaacaatggcaattggctcctcttcataacccaagctattatctagctgaactgtgctgaagtctaacacatgtgataggtcggcatgatacttccggagcatagatacgtgaaaaaccggatgaactcccgataggctgggaggcaatgcaagctcataagcaacctccccaactcgtttcaacacctcaaatgggcctataaaccttgggctcaacttgcccttcttcccgaatctcataattcccttcatcggcgaaaccttcaagagaactttttcacctaccataaatgatatatcacgcgctttctgatccgcgtaactcttttgtctggactgtgctgtacgaagtcgctcctgaatcaactttaccttttccaaggcatcccttaccaaatcagtaccatataacttagcctcacctggctcaaaccatccgataggtgaacgacatcgccgaccatataaagcctcaaatggagccatctcgatgctggattggtaactgttattataagcaaactcggccaaaggcaggaaacgatcccactgacctccaaagtcaatcacacatgccctgagcatatcctccaaaatctgaattgtcctctctgactgccatcggtctgcggatgaaaggctgtgctgagctctacacgggtccccaactcactctgtactgctctccagaaatgtgaagtaaactgagggcctctatctgatatgatggaaattggcacaccgtgcaaccgaactatctcctgaatataaatctgggccaacctctctgaagtatacgtagtcacaacaggaataaaatgtgccgacttggtcaacctgtcaacaatcacccaaactgcatcaaacttcctcaaggtccgcggcaacccaactacaaagtccatagtaattcgttcccatttccactctggtatagtcatctgctgaagtaggccacctggcctctggtgctcatatttaacttgctggcaatttagacacctagctacatactcaactatgtcctttttcattcgtcgccaccaataatgctgcctcaagtcacgatacatcttcgtagcacctggatgaatagaataccgagaactgtgtgcctcctccaggatctttttcctcagttcatccacattaggaacacacagacgatcctggagtcgcagaacaccatccgcaccaatagtaacttccttggcaccacctcgtagtaccgtttcacgaagaaccattaagtgtgggtcatcatactggcgagccttgatctgctcaaatagtgaagactgggccacaacacatgcaagaactcggctgggctctgaaatatccagcctcacaagtctgttagccaaggactgaatatccaaagctaatggcctttcctctgctgaaatgaaagccaaactacccatactctccgcctttctactcaaggcatctgcaaccacatttgctttgcccggatgatacaggatagtaatatcataatcttttagtaactccagccatctgcgctgcctcaaatttaggtccctctgcttgaacaaatgctgcaaactgcgatgatcagtgtaaacttcacaagacaccccataaagataatgcctccaaatcttaagagcgtgaacaatcgcagctaactccaaatcatgtaccggataattctttcgtggggcttcagctgacgtgaagcatatgcaataacttgcccttcctgcatcaatacacaacccaagccaacgcgtgaagcgtcgcaatacactgtatacatccccgaaccggaaggcaacactaacactggtgttgtagtcaatgatgtcttgagcttctgaaagctcacctcacaatcatcggaccatcggaatggagcacccttctgggttaatttggtcaaaggtgctgcaatagatgaaaaaccttccacgaaccgacgataataacctgctaaacccagaaaactcctgatctcagtcgccgaagtgggacgatgccaattctgaactgcctcaatctttttgggatcaactttaataccttcgcccgatacaatatgtcccaaaaatgctacagactctagccaaaactcacatttagagaacttagcatatagcttttgttcccgcaatgtctgaagcactactctcatatgctgctcatgctcctccttactacgtgagtagatcaaaatgtcatcaatgaagacaatgacaaatgaatcaatatatggcctgaataccctgttcatcagatccataaacgctgccggggcattagttaaaccaaaagacattaccagaaactcataatgaccatatctagtacggaaagcagtcttcggaacatccgaatcccgaatcttcaactgatggtaccccgacctcaagtcgatcttagagaacaccctagcaccctgcaactggtcaaatagatcatcaatacgcggcaacgggtacttgttcttaatagtgactttgttcaattggcgataatcaatacacatccgcattgttccatccttcttcttcacaaataataccggtgcaccccaaggcgatacactcggtctgacgaaccctttggctagtaactcttcaagctgttctttcaattctttcaattctttcggagccatgcgatacggtgggatagatataggctgggtatctggagccaagtcaatacagaaatcaatatcacgatcaggtggcatacctggaagatctgaaggaaatacatcggagaactcccgaactacaggcactgaatcaatagccggagtctctgcagtagtatcccgaacataggctagataagccaaacaacccttctcaaccatgtgttgagcctttataaaagaaataactcgattaaatgaactaacagacgaacccttccactccagcttaggcaatgctggaatagccaaggtaacagtcttggcatgacaatctagaatagcatgatatggagataaccagtccatgcccagaataatttcaaaatcggtcatctcaagcaatagagatctgctctagtttcataaccacagaatgtaataatacaggaccggtagatccggttcacaacaacagaatcgcccacaggagtggacacataaacaggagtactcaaggactcacgagaaacacccaggaatggagcaaatagagatgacacatatgaatacgtagatcctggatcaaataatactgaggcatctttgccgcaaacagaaataatacctgtaatcacggcatctgaggcctctgcatctggtctagccggaaaagcatagaaccgagctggagcgccaactggctggcctccgcctggctgacctccacctctaggacggcccctacccacctgtcctccacctcttggtggtcggactactggtggagcaactggtccggtaagcataggctgctgaccctgctgtactggtctaccccgaagcctggggcaaaacctctcgcatgtgactgggatccccgcactcgtaacaactcttcggtgcgatgggctgctgactaagtgtctggccctggggacctgaatacccactgggaggaccctgaatagctggtgggcgataagaactctctggtatagcactgagataaggtcgcactggagcacctcgaggaggtggtggtgctggatatgggggtctgctggactgcccctcacgaactgacctctgcccccagacggagcacctctgaactctccagagtacctgaaccgcttatctctcataatctgctctcggctccgctgacgtacaccctcaatcctccgggctatctccacaactcgctcataagaagtacccatctcaacctctcgagccatagtggcctgaataccagtatgtaaaccggctacaaaccttcgcactctctccgcctcagtagggagtatcataagtgcatggcgagataattcagaaaacctcgcctcataatcagtcactgacatctgaccctgctggagctgctcaaactgaaaccgcaactcttccctctgggagggtggaatatacctgtccaagaagatacgggtgaacctgtcccaagtcatgggaggagaatctgctggtctgccaagagcataagactgccaccatctacgggctctaccctctagctgaaaagtagcgaaatcaaccccatgggattccaatatcctcatgttgtacagtctatccttgcaacgatcaatgaaatcctgtggatcctcatgtcgctcacccccgaagacaggaggatgtagtctagtccatctgtccaatagtttctgaggatcggcggctacagctggcctgggctcaggtgtagctgctgccactggctggactccacccacgggtagtgcaccctgggtctgatatacagcagctgcctgtccatgagcctgcgcggtaggggtctgtgctcccccgcccgcctgagatgtggctgggtctgccggaaataaaccggcctgagtcatattgtccatgaatcgcagcatacgacccatgacatcctgaaatcccggtgcagatgtgaaatccaccggagctggctctgccacaggcacctcaccctgctcctcaataatgggattctctgctggacccactggcggcataactggaatagtcctgggacgtcctcgccctctaccacgggctggagccctccctcggcctctgcctcggcctctagcaactgggggagtagctcttccctggtctggaactcattagagcgtgttctcaccatctgtgagagaataagagaaggatatttagtactacatcaattgcacgatggaatatgaagaaaggtagtttcctaacacccttagcctctcgaagataagtacagacgtctccgtaccgatccgcaaactctattaggtctgctcataacttgtgagacctacgtgaacctagtgctctgataccatgttgtcacgacccaatttcacctataggtcgtgatggcgcccaacactacagctaggcaagccaactaataaattaaacatacattggttaaaattttattccaagaaaataataaaataccaaattctaccaatgtgtgtgccaagacctggtgtcacaagtgcatgagcatctagtagattatacaaaactccaaatactgtctgaaatgaaatagacagaatataaatataagaagagacactggtagctgcagaacggctcagaaaggcagctcaccactatgcctcgggatgacgtgggtatgtgatgataggtcctccactagtacctgtctcagatcctgcacaaaaagtgcagcaagtgtagtatgagtacgtaaacaacgtgtacccagtaagtatcaagcctaatctcgaagtggtagagacgagatggccgactttgacactcactatgggtcaataataataattgaaataaaactaggatatttaaatcagcatgatttacagaatttacaataatttatttaatcagcggaaataatcaaattccttcaaatgtaacaattctcaatatattaattaaattccttcaattcaaataaattccaatttatcaattaaatctcatttacaggagtaacaattaattccttaacaagcaagaataataattcattaaattccaaggattttccaatttattaattagcttcacaagctgaaataaattattaaagtatcgtgtaattattattattaagcacgatttctgccgaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaatttgggaggagaacaatttcttttaacaattaattgatttaaacagaaaatcaagcctatgagatttccatcctttaatatctttatctaacaattcacaatatattcatatagatatcaattaatataaataaatcaaagaatacaatttacacaagtaaggcatgctttgagtcctaaactacccggactttagcattaatagtagctacgcacggactctcgtcacctcgtgcgtacgtagccccccacaattagcaataattatttaattttaatcacctatgaggtagtttccccctcacaagattagacaagagacttacctcgtcttgctctaatttaacccactagaaggccttttccacgattatccaaccctgtccagctcgaatctagccaaaataattcgatataatcactaaaaattataggaatcaattctataagaaaatactacatttttaataaaaattccaaaattatttaaatattcgtctgtggggcccacatctcggaatccggcgaaagttatgaaatctgacaacccattcaattacaagttcaaccataccagtttcactcaaatccgactctgaatcgataccgaaatctcaaaaattcgcttctatgagatttctaaattttttccaaatttcaatctcaaaacactaattaaatggtgaaaacaatgatatatttgtgtatattgaccaaatccgagatgaaatcacttaccccaaatatctttccttgaaaatctgtcaaaatcgcctctgctccagctccaatttgttaaaaaaaagcgaaagagacgaatgccctctttttataaaactgcccaaatagccttcgattgtgaccctcgatcttgggtctcgatcctggccctcgagccttgccctcgatactgtccctcgagccttgccctcgatcctggccctcgagccttgccctcgatcctggccctcgagccttgccttcgatcatggccctcgagctggaccttcgatcatggcttcgatacacaagctcgagcctgagcctcgtcaaacctgggctcgttatctggtctcgatacctgggctcgatatctgggctcgatcacagcccagaatgtccaacagaaaaggaaaaattgcaacagctttttaaatccaatttttgatccgttaaccatccgaaactcacccgaggccctcgggacctcaaccaaatataccaacaaatcctaaaacatcatacgaacttagtcgaacctctaaatcacatcaaacaatgctaaaaccacgaattataccccaattcaagcttaaagaaactaagaatttttcaacttctacattcgatgccggaacctatcaaatcaagtccgattgacctcaaattttgcacacaagtcatacatgacatgacggagctgtgaagattttcagaactggattctgaccccgatctcaaaaagtcaactccctggtcaaacttccaaactttaaattcctatttttgtcatttcaagcctaatttcactagggactaccaaataaaatttcgatcacgcttctaagtccaaaatcaacatacggagctgttagaatcatcaaaattctattttggggtcgtttttacataattagacatccggtcactatttgaacttaaacttttaaattgttcatcaaaattccatatctcgggctagggacctcggaatttgattccgggaatacgcccgagtcccaaatcacgatacggacctaccggaactatcaaaacactgatccgagtctgtttgctccaaatgttgaccaaagtcaactcaattgagttttaaagctctaattcacattttaatcgattttttgaggtcttagaacacataattaattattaaatttaaagatgacattttggcctctccactggacttttactgcagaaatcctcttggaccttaactggcgaacctgtttatcaacaatggcaattgtctcctcttcataacccaagctattatctagctgaactgtgctgaattctaacacatgtgatccagtcgaggaagcgacttgggaggccgaggaaacatgcggagcagatatccacacttattcagcactccaggtataattctaaacccgttcgaggacgaacgtttgtttaagaggtggagaatgtatgacccaaaatgtcattttaaatttaataattaattatgtgttctaagacctcgaaaagtactatttatcattcctcgacttgcgtgcgcaatccgtaaaaattttggaaagtttttatgtgaaaaatggattaaaatgtgaattagagctttaaaactcaattgagttgactttggtcaacattttgagcaaacggactcggatcagtgttttgacagttcggtaggtccgtatcgtgatttgggacttgggcgtatggaatcaaattccgaggtccctagcccgagatatggaattttgatgaaaaattaaaagtttaagttcaaatagtgaccggatgtcaattatgtgcaaacgaccccggaatagaattttgatgattccaacagctccgtatggtgattttggacttaggagcgtgatcggaaattttatttggaagtccgtagtgaaattaggcttgaaatggctaaaataggaatttaagtttggaagtttgaccggggagttgactttttgatatcggagtcggaatccagttccaaaattttcatagctccgttatgtcatttatgacttgtgtgtaaaatttgaggtcaatcggagttgatttgataggttccgacatcgaatgtagaagttgaaaactcttagtttcattaagcttgaattggggtatgattcatggttttagcgttgtttgatgtgatttagaggttcgactaagttcgtatgatgttttaggacttgttggtatatttggttgaggtcccgagggcctcgggtgagtttcgattgtcacgacccaatttcacctataggtcgtgatggcgcccaacactacagctaggcaagccaactaataaattaagcatacattgattaaacttttattccaagaaaaataataataccaacttctaccaatgtgtgtgccaagacccggtgtcacaagtgcatgagcatctagtagattatacaaaactccaaatactgtctgaaatgaaatagacagaatataaatataagaagagacactggtagctgcagaacggctcagaaaggcagctcaccactatgcctcgggatgacgtgggtatgtgatgataggtcctccactagtacctgtctcagatcctgcacaaaaagtgcagcaagtgtagtatgagtacgtaaacaacgtgtacccagtaagtatcaagcctaatctcgaagtggtagagacgagatggccgactttgacactcactataggtcaataataattgaaataaaactaggatatttaaatcaatgtgatttacagaatttatttaatcagcgaaataatcaaattccttcaaatgtatcaattttcaatatattaattaaattccttcaattcaaataaattccaatttatcaattaaatctcatttacaggagtaacaattaattccttaacaagcaagaataataattcattaaattccaagattttccaatttataattagcttcacaagctgaaataaattattaaagtatcgtgtaattattattattattagcacgatttctgccgaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaatttgggaggagaacaatttcttttaacaattaattatttaaacagaaatcaagcctatgagattttcatcctttaatatctttatctaaacaattcacaatatatatcatatatatcaattaatattaaaaaaatacaatttacacaagtaattcatgctttgagtcctaaactacccggactttagcattaatagtagctacgcacggactctcgtcacctcgtgcgtacgtagcccccacaattagcaacaattatttaattttaatcacctatgaggtaatttccccctcacaagattagacaagagacttacctcgtcttgctccaatttaatccactataaggccttttccacgattattctaagcatacattgattaaacttttattccaagaaaataataaaataccaacttctaccaatgtgtgtgccaagacccggtgtcacaagtgcatgagcatctagtagattatacaaaactccaaatactgtctgaaatgaaatagacagaatataaatataagaagagacactggtagctgcagaacggctcagaaaggcagctcaccactatgcctcgggatgacgtgggtatgtgatgataggtcctccactagtacctgtctcagatcctgcacaaaaagtgcagcaagtgtagtatgagtacgtaaacaacgtgtacccagtaagtatcaagcctaatctcgaagtggtagagacgagatggccgactttgacactcactataggtcaataacaattgaaataaaactaggatatttaaatcaatgtgatttacagaatttatttaatcagcgaaaataatcaaattccttcaaatgtatcaattttcaatatattaattaaattccttcaattcaaataaattccaatttatcaattaaatctcatttacaggagtaacaattaattccttaacaagcaagaataataattcattaaattccaagattttccaatttataattagcttcacaagctgaaataaattattaaagtatcgtgtaattattattattaagcacgatttctgccgaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaattgggaggagaacaatttcttttaacaattaattaatttaaacagaaaatcaagcctatgagatttccatcctttaatatctttatctaacaattcacaatatatatatatatatatcatatatataattaatataaatcaaagaatacaatttacacaagtaattcatgctttgagtcctaaactacccggactttagcattaatagtagctacgcacggactctcgtcacctcgtgcgtacgtagcccccacaattagcaataattatttaatttaatcacctatgaggtaatttcccctcacaagattagacaagagacttacctcgtcttgctccaatttaatccactataaggccttttccacgattatccaactctgtctggctcgaatctagccaaaataattcgatacaatcactaaatattataggaatcaattctataagaaaatactacattttaaaaaatcccgaaattaattaaaaattcgcccgcggggcccacatctcggaatccggcgaaagttatgaaatccgacaacccattcaattacgagtccaaccataccagtttcactcaaatccgactccgaatcgataccgaaatctcaaaatttcgtttctatgagatttctaaacttttccaaatttcaatctcaaaacactaattaaatgtgaaaacaatgatatattcttgtatattgaccaaatccgagttagaatcacttaccccaatgtttttcccttgaaaatctgccaaaagtcgcctctgctcaagctcaagttcgcaaaaatggcaaatgggacgaatgtcctctgtttttataactgcccagcagttcggaactgggcctcgaacagggcctcgatcgcggcatcgaacatgtgccttcgatcagggcatcgagggttgggcctcgatcctagccctcgagccataccttcgatcatgccatcgagccttaccttcgatcgtgacttcgatcacaggctcgagcctggacctcggtcatggcctcgatcagggtatcgaggttgggccttcgatcatagcctcaatcatgcatcgagcttgagccttcgatcagggcatcgagcatgggtctcgatcctagccctcgagccttacttcgatcatgccctcgagccttgccttcgatcgaggcttcgatactgagcctcgtccctggcttcgactcaggcctcgatcgtgggctcgatatctggggctcgatctgatctcgatccagatcctcgagcccagaatcagcagaagagaaaattgcagcagctttttaagtccaacttttgatccgttaaccatccgaaactcacccgaggccctcgggacctcaaccaaatataccaacaagtcctaaaacatcatacgaacttagtcgaacctctaaatcacatcaaacaacgctaaaaccatgaatcataccccaattcaagcttaatgaaactaagagttttcaacttctacattcgatgtcggaacctatcaaatcaactccgattgacctcaaattttacacacaagtcataaattacataacggagctatgaaaattttcggaactggattccgactccggtatcaaaaagtcaactccccggtcaaacttccaaacttaaattcctattttagccatttcaagcctaatttactacggacttccaaataaaattccgaacacgctcctaagtccaaaatcaccatacggagctgttggaatcatcaaaattctattccggggtcgttttctcaaaatgttgaccgaagtcaaacttagcactttaaggccaacttaaggaaccaagtgttccggtttcacccaaacacttccaaatcccgaaccaaccatccccgcaagtcataaatcattacaagcacctacggaagttttattttagggaacggggttctaaaagttaaaatgaccggttgggtcattacattctccacctcttaaacaaacgttcgtcctcgaacgggtttagaattgtacctggagtgctgaataagtgtggatatctgctccgcatgtctttcctcggcctcccaagtcgcttcctcgactggttggcccctccactggacttttactgcagaaatcctcttggacctcaactggcgaacctgtttatcaacaatggcaattggctcctcttcataacccaagctattatctagctgaactgtgctgaagtctaacacatgtgataggtcggaatgatacttccagagcatagatacatgaaagaccggatgaactcccgataggctgggaggcaatgcaagctcataagcaacctccccaactcgttttaacacctcaaatgggcctataaaccgccgacctatcacatgtgttagacttcagcacagttcagctagataatagcttgggttatgaagaggagccaattgccattgttgataaacaggttcgccagttgaggtccaagaggatttctgcagtaaaagtccagtggaggggccaaccagtcgaggaagcgacttgggaggccgaggaaacatgcggagcagatatccacacttattcagcactccaggtataattctaaacccgttcgaggacgaacgtttgtttaagaggtggagaatgtatgacccaaaatgtcattttaaatttaataattaattatgtgttctaagacctcgaaaagtactatttatcattcctcgacttgcgtgcgcaatccgtaaaaattttggaaagtttttatgtgaaaaatggattaaaatgtgaattagagctttaaaactcaattgagttgactttggtcaacattttgagcaaacggactcggatcagtgttttgacagttcggtaggtccgtatcgtgatttgggacttgggcgtatggaatcaaattccgaggtccctagcccgagatatggaattttgatgaaaaattaaaagtttaagttcaaatagtgaccggatgtcaattatgtgcaaacgaccccggaatagaattttgatgattccaacagctccgtatggtgattttggacttaggagcgtgatcggaaattttatttggaagtccgtagtgaaattaggcttgaaatggctaaaataggaatttaagtttggaagtttgaccggggagttgactttttgatatcggagtcggaatccagttccaaaattttcatagctccgttatgtcatttatgacttgtgtgtaaaatttgaggtcaatcggagttgatttgataggttccgacatcgaatgtagaagttgaaaactcttagtttcattaagcttgaattggggtatgattcatggttttagcgttgtttgatgtgatttagaggttcgactaagttcgtatgatgttttaggacttgttggtatatttggttgaggtcccgagggcctcgggtgagtttcgattgtcacgacccaatttcacctataggtcgtgatggcgcccaacactacagctaggcaagccaactaataaattaagcatacattgattaaacttttattccaagaaaaataataataccaacttctaccaatgtgtgtgccaagacccggtgtcacaagtgcatgagcatctagtagattatacaaaactccaaatactgtctgaaatgaaatagacagaatataaatataagaagagacactggtagctgcagaacggctcagaaaggcagctcaccactatgcctcgggatgacgtgggtatgtgatgataggtcctccactagtacctgtctcagatcctgcacaaaaagtgcagcaagtgtagtatgagtacgtaaacaacgtgtacccagtaagtatcaagcctaatctcgaagtggtagagacgagatggccgactttgacactcactataggtcaataataattgaaataaaactaggatatttaaatcaatgtgatttacagaatttatttaatcagcgaaataatcaaattccttcaaatgtatcaattttcaatatattaattaaattccttcaattcaaataaattccaatttatcaattaaatctcatttacaggagtaacaattaattccttaacaagcaagaataataattcattaaattccaagattttccaatttataattagcttcacaagctgaaataaattattaaagtatcgtgtaattattattattattagcacgatttctgccgaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaatttgggaggagaacaatttcttttaacaattaattatttaaacagaaatcaagcctatgagattttcatcctttaatatctttatctaaacaattcacaatatatatcatatatatcaattaatattaaaaaaatacaatttacacaagtaattcatgctttgagtcctaaactacccggactttagcattaatagtagctacgcacggactctcgtcacctcgtgcgtacgtagcccccacaattagcaacaattatttaattttaatcacctatgaggtaatttccccctcacaagattagacaagagacttacctcgtcttgctccaatttaatccactataaggccttttccacgattattctaagcatacattgattaaacttttattccaagaaaataataaaataccaacttctaccaatgtgtgtgccaagacccggtgtcacaagtgcatgagcatctagtagattatacaaaactccaaatactgtctgaaatgaaatagacagaatataaatataagaagagacactggtagctgcagaacggctcagaaaggcagctcaccactatgcctcgggatgacgtgggtatgtgatgataggtcctccactagtacctgtctcagatcctgcacaaaaagtgcagcaagtgtagtatgagtacgtaaacaacgtgtacccagtaagtatcaagcctaatctcgaagtggtagagacgagatggccgactttgacactcactataggtcaataacaattgaaataaaactaggatatttaaatcaatgtgatttacagaatttatttaatcagcgaaaataatcaaattccttcaaatgtatcaattttcaatatattaattaaattccttcaattcaaataaattccaatttatcaattaaatctcatttacaggagtaacaattaattccttaacaagcaagaataataattcattaaattccaagattttccaatttataattagcttcacaagctgaaataaattattaaagtatcgtgtaattattattattaagcacgatttctgccgaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaattgggaggagaacaatttcttttaacaattaattaatttaaacagaaaatcaagcctatgagatttccatcctttaatatctttatctaacaattcacaatatatatatatatatatcatatatataattaatataaatcaaagaatacaatttacacaagtaattcatgctttgagtcctaaactacccggactttagcattaatagtagctacgcacggactctcgtcacctcgtgcgtacgtagcccccacaattagcaataattatttaatttaatcacctatgaggtaatttcccctcacaagattagacaagagacttacctcgtcttgctccaatttaatccactataaggccttttccacgattatccaactctgtctggctcgaatctagccaaaataattcgatacaatcactaaatattataggaatcaattctataagaaaatactacattttaaaaaatcccgaaattaattaaaaattcgcccgcggggcccacatctcggaatccggcgaaagttatgaaatccgacaacccattcaattacgagtccaaccataccagtttcactcaaatccgactccgaatcgataccgaaatctcaaaatttcgtttctatgagatttctaaacttttccaaatttcaatctcaaaacactaattaaatgtgaaaacaatgatatattcttgtatattgaccaaatccgagttagaatcacttaccccaatgtttttcccttgaaaatctgccaaaagtcgcctctgctcaagctcaagttcgcaaaaatggcaaatgggacgaatgtcctctgtttttataactgcccagcagttcggaactgggcctcgaacagggcctcgatcgcggcatcgaacatgtgccttcgatcagggcatcgagggttgggcctcgatcctagccctcgagccataccttcgatcatgccatcgagccttaccttcgatcgtgacttcgatcacaggctcgagcctggacctcggtcatggcctcgatcagggtatcgaggttgggccttcgatcatagcctcaatcatgcatcgagcttgagccttcgatcagggcatcgagcatgggtctcgatcctagccctcgagccttacttcgatcatgccctcgagccttgccttcgatcgaggcttcgatactgagcctcgtccctggcttcgactcaggcctcgatcgtgggctcgatatctggggctcgatctgatctcgatccagatcctcgagcccagaatcagcagaagagaaaattgcagcagctttttaagtccaacttttgatccgttaaccatccgaaactcacccgaggccctcgggacctcaaccaaatataccaacaagtcctaaaacatcatacgaacttagtcgaacctctaaatcacatcaaacaacgctaaaaccatgaatcataccccaattcaagcttaatgaaactaagagttttcaacttctacattcgatgtcggaacctatcaaatcaactccgattgacctcaaattttacacacaagtcataaattacataacggagctatgaaaattttcggaactggattccgactccggtatcaaaaagtcaactccccggtcaaacttccaaacttaaattcctattttagccatttcaagcctaatttactacggacttccaaataaaattccgaacacgctcctaagtccaaaatcaccatacggagctgttggaatcatcaaaattctattccggggtcgttttctcaaaatgttgaccgaagtcaaacttagcactttaaggccaacttaaggaaccaagtgttccggtttcacccaaacacttccaaatcccgaaccaaccatccccgcaagtcataaatcattacaagcacctacggaagttttattttagggaacggggttctaaaagttaaaatgaccggttgggtcattacattctccacctcttaaacaaacgttcgtcctcgaacgggtttagaattgtacctggagtgctgaataagtgtggatatctgctccgcatgtctttcctcggcctcccaagtcgcttcctcgactggttggcccctccactggacttttactgcagaaatcctcttggacctcaactggcgaacctgtttatcaacaatggcaattggctcctcttcataacccaagctattatctagctgaactgtgctgaagtctaacacatgtgataggtcggcatgatacttccggagcatagatacgtgaaaaacggatgaactcccgataggctgggaggcaatgcaagctcataagcaacctccccaactcgtttcaacacctcaaatgggcctataaaccttgggctcaacttgcccttcttcccgaatatcataattcccttcatcggcgaaacttcaagagaacgttttcacctaccataaatgatacatcacgcgctttctgatccacgtaactcttttgtctggactgtgctgtacgaagtcgctcctgaatcaactttaccttttctaaggcatcccttaccaaatcagtgattcgggaagaagggcaagttgagcccaaggtttataggcccatttgaggtgttgaaacgagttggggaggttgcttatgagcttgcattgcctcccagcctatcgggagttcatccggtttttcacgtatctatgctccggaagtatcatgccgacctatcacatgtgttagacttcagcacagttcagctagataatagcttgggttatgaagaggagccaattgccattgttgataaacaggttcgccagttgaggtccaagaggatttctgcagtaaaagtccagtggaggggccaaccagtcgaggaagcgacttgggaggccgaggaaacatgcggagcagatatccacacttattcagcactccaggtataattctaaacccgttcgaggacgaacgtttgtttaagaggtggagaatgtatgacccaaaatgtcattttaaatttaataattaattatgtgttctaagacctcgaaaagtactatttatcattcctcgacttgcgtgcgcaatccgtaaaaattttggaaagtttttatgtgaaaaatggattaaaatgtgaattagagctttaaaactcaattgagttgactttggtcaacattttgagcaaacggactcggatcagtgttttgacagttcggtaggtccgtatcgtgatttgggacttgggcgtatggaatcaaattccgaggtccctagcccgagatatggaattttgatgaaaaattaaaagtttaagttcaaatagtgaccggatgtcaattatgtgcaaacgaccccggaatagaattttgatgattccaacagctccgtatggtgattttggacttaggagcgtgatcggaaattttatttggaagtccgtagtgaaattaggcttgaaatggctaaaataggaatttaagtttggaagtttgaccggggagttgactttttgatatcggagtcggaatccagttccaaaattttcatagctccgttatgtcatttatgacttgtgtgtaaaatttgaggtcaatcggagttgatttgataggttccgacatcgaatgtagaagttgaaaactcttagtttcattaagcttgaattggggtatgattcatggttttagcgttgtttgatgtgatttagaggttcgactaagttcgtatgatgttttaggacttgttggtatatttggttgaggtcccgagggcctcgggtgagtttcgattgtcacgacccaatttcacctataggtcgtgatggcgcccaacactacagctaggcaagccaactaataaattaagcatacattgattaaacttttattccaagaaaaataataataccaacttctaccaatgtgtgtgccaagacccggtgtcacaagtgcatgagcatctagtagattatacaaaactccaaatactgtctgaaatgaaatagacagaatataaatataagaagagacactggtagctgcagaacggctcagaaaggcagctcaccactatgcctcgggatgacgtgggtatgtgatgataggtcctccactagtacctgtctcagatcctgcacaaaaagtgcagcaagtgtagtatgagtacgtaaacaacgtgtacccagtaagtatcaagcctaatctcgaagtggtagagacgagatggccgactttgacactcactataggtcaataataattgaaataaaactaggatatttaaatcaatgtgatttacagaatttatttaatcagcgaaataatcaaattccttcaaatgtatcaattttcaatatattaattaaattccttcaattcaaataaattccaatttatcaattaaatctcatttacaggagtaacaattaattccttaacaagcaagaataataattcattaaattccaagattttccaatttataattagcttcacaagctgaaataaattattaaagtatcgtgtaattattattattattagcacgatttctgccgaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaatttgggaggagaacaatttcttttaacaattaattatttaaacagaaatcaagcctatgagattttcatcctttaatatctttatctaaacaattcacaatatatatcatatatatcaattaatattaaaaaaatacaatttacacaagtaattcatgctttgagtcctaaactacccggactttagcattaatagtagctacgcacggactctcgtcacctcgtgcgtacgtagcccccacaattagcaacaattatttaattttaatcacctatgaggtaatttccccctcacaagattagacaagagacttacctcgtcttgctccaatttaatccactataaggccttttccacgattattctaagcatacattgattaaacttttattccaagaaaataataaaataccaacttctaccaatgtgtgtgccaagacccggtgtcacaagtgcatgagcatctagtagattatacaaaactccaaatactgtctgaaatgaaatagacagaatataaatataagaagagacactggtagctgcagaacggctcagaaaggcagctcaccactatgcctcgggatgacgtgggtatgtgatgataggtcctccactagtacctgtctcagatcctgcacaaaaagtgcagcaagtgtagtatgagtacgtaaacaacgtgtacccagtaagtatcaagcctaatctcgaagtggtagagacgagatggccgactttgacactcactataggtcaataacaattgaaataaaactaggatatttaaatcaatgtgatttacagaatttatttaatcagcgaaaataatcaaattccttcaaatgtatcaattttcaatatattaattaaattccttcaattcaaataaattccaatttatcaattaaatctcatttacaggagtaacaattaattccttaacaagcaagaataataattcattaaattccaagattttccaatttataattagcttcacaagctgaaataaattattaaagtatcgtgtaattattattattaagcacgatttctgccgaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaattgggaggagaacaatttcttttaacaattaattaatttaaacagaaaatcaagcctatgagatttccatcctttaatatctttatctaacaattcacaatatatatatatatatatcatatatataattaatataaatcaaagaatacaatttacacaagtaattcatgctttgagtcctaaactacccggactttagcattaatagtagctacgcacggactctcgtcacctcgtgcgtacgtagcccccacaattagcaataattatttaatttaatcacctatgaggtaatttcccctcacaagattagacaagagacttacctcgtcttgctccaatttaatccactataaggccttttccacgattatccaactctgtctggctcgaatctagccaaaataattcgatacaatcactaaatattataggaatcaattctataagaaaatactacattttaaaaaatcccgaaattaattaaaaattcgcccgcggggcccacatctcggaatccggcgaaagttatgaaatccgacaacccattcaattacgagtccaaccataccagtttcactcaaatccgactccgaatcgataccgaaatctcaaaatttcgtttctatgagatttctaaacttttccaaatttcaatctcaaaacactaattaaatgtgaaaacaatgatatattcttgtatattgaccaaatccgagttagaatcacttaccccaatgtttttcccttgaaaatctgccaaaagtcgcctctgctcaagctcaagttcgcaaaaatggcaaatgggacgaatgtcctctgtttttataactgcccagcagttcggaactgggcctcgaacagggcctcgatcgcggcatcgaacatgtgccttcgatcagggcatcgagggttgggcctcgatcctagccctcgagccataccttcgatcatgccatcgagccttaccttcgatcgtgacttcgatcacaggctcgagcctggacctcggtcatggcctcgatcagggtatcgaggttgggccttcgatcatagcctcaatcatgcatcgagcttgagccttcgatcagggcatcgagcatgggtctcgatcctagccctcgagccttacttcgatcatgccctcgagccttgccttcgatcgaggcttcgatactgagcctcgtccctggcttcgactcaggcctcgatcgtgggctcgatatctggggctcgatctgatctcgatccagatcctcgagcccagaatcagcagaagagaaaattgcagcagctttttaagtccaacttttgatccgttaaccatccgaaactcacccgaggccctcgggacctcaaccaaatataccaacaagtcctaaaacatcatacgaacttagtcgaacctctaaatcacatcaaacaacgctaaaaccatgaatcataccccaattcaagcttaatgaaactaagagttttcaacttctacattcgatgtcggaacctatcaaatcaactccgattgacctcaaattttacacacaagtcataaattacataacggagctatgaaaattttcggaactggattccgactccggtatcaaaaagtcaactccccggtcaaacttccaaacttaaattcctattttagccatttcaagcctaatttactacggacttccaaataaaattccgaacacgctcctaagtccaaaatcaccatacggagctgttggaatcatcaaaattctattccggggtcgttttctcaaaatgttgaccgaagtcaaacttagcactttaaggccaacttaaggaaccaagtgttccggtttcacccaaacacttccaaatcccgaaccaaccatccccgcaagtcataaatcattacaagcacctacggaagttttattttagggaacggggttctaaaagttaaaatgaccggttgggtcattacattctccacctcttaaacaaacgttcgtcctcgaacgggtttagaattgtacctggagtgctgaataagtgtggatatctgctccgcatgtctttcctcggcctcccaagtcgcttcctcgactggttggcccctccactggacttttactgcagaaatcctcttggacctcaactggcgaacctgtttatcaacaatggcaattggctcctcttcataacccaagctattatctagctgaactgtgctgaagtctaacacatgtgataggtcggcatgatacttccggagcatagatacgtgaaaaacggatgaactcccgataggctgggaggcaatgcaagctcataagcaacctccccaactcgtttcaacacctcaaatgggcctataaaccttgggctcaacttgcccttcttcccgaatctcataattcccttcatcggcgaaaccttcaagagaactttttcacctaccataaatgataatcacgcgctttctgatccgcgtaactcttttgtctggactgtgctgtacgaagtcgctcctgaatcaactttaccttttccaaggcatcccttaccaaatcagtaccatataacttagcctcacttggctcaaaccatccaataggtgaacgacaatgccgaccatataaagcctcaaatggagccatttcgatgctggattggtaactgttattataagcaaactcggccaaaggcaggaaacgatcccactgacctccaaagtcgatcacacatgacctaagcatatcctccaaaatctgaattgtccgctctgactgcccgtcggtcgcggatgaaatgttatgctgaactctacacgggtccccaactcactctgtactgctctccagaaatgtgaagaaaattgggggcctctatctcatatgatagaaattggcacaccgtgcaaccgaactatatccgaaatataaatctgggcccaacctttctgaagtatacgtagtcacaacaggaataaaatgtgccgacttggtcaacctgtcaacaatcaccaaaactgcatcaaatttcctcaaggtccgcgacaacccaactacaaagtccatagtaattcgttcccatttccactctggtatagtcatctgttgaagtaggccacctggcctctggtgctcataattaacttactggcaatttagacacctagatacatactcaactatgtcctttttcattcgtcgccaccaataatgttgcctcaagtcacgatacatcttagtagcacctggatgaatagaataccgagaactgtgtgcctcatccaggatctttttcctcggtccatccacattaggaacacatagacgatcctggagtcacagaacaccatccgctctaatagtaacttccttggcaccacctcgtagtaccatttcacgaagaaccatcaagtatgggtcatcataatagcgagccttgatctgctcaaatagtgaagattgggccaccacacatgcaagaactcggttgggctatgaaatatccagcctcacaagtttgttagccaaggactgaatatctgaggctaatggcctttcctctcctgaaatgaaaaccaaactacccatactctctgctttcctgctaaaggaatttgcaaccacatttgctttgcccggatgatacaagatagtaatatcataatcttttagtaactccagccatctgcgctgcctcaaatttagatccctctgcttgaacaaatgctacaaactgcgatgatcagtgtaaacttcacaagacaccccataaagataatgcctccaaatctttagagcgtgaacaatcgcagctaactccaaatcatgtactggataattcttctcgtggggcttcagctgacgtgaagcatatgcaataacttgcctttcctacatcaatacacaacccaagccaatgcgtgacgcgtcacaatacactgtatatattccgaaccatatggtaacactaacacgggtgctgtagtcagtgctatcttgagcttctgaaagcttgactcgcaatcatcggaccatcagaactgaatacccttctgggttaatttggtcaaaggtgctacaatagatgaaacaccttccacgaatcgacgataataacctgctaaacctagaaaactcctgatctcagtcgccgaagtgggacgatgctaattctgaattgcctcaatctttttgggatcaactttaataccttcgcccgatacaatatgtcccaaaaatgctacagactctagccaaaactcacatttagagaacttagcatatagcttttgttcccgcaatgtctgaagcactactctcatatgctgctcatgttcctccttactgcgcgagtagatcaaatgtcatcaatgaagacaatgacaaacgaatcaatatatggcctgaataccatgttcatcagatccataaatgatgctggggcattagataaaccgaaggacatcaccagaaactcataatgaccatatctagtccgaaaagcagtcttcggaacatccgaatcctgaatcttcaactgatggtaccccgacctcaagtcgatcttagagaataccctagcaccctgcaactggtcaaatagatcatcaatacgcggcaacgggtacttgttcttaatagtgactttgttcaattggcgataatcaatacacatccgcattgttccatccttctttttcacaaataatactggtgcaccccaaggcgatacactcggtctgacgaaccctttggctagtaactcttcaagctgttctttcaattctttcggagccatgcgatacggtgggatagatataggctgggtatctgaagccaagtcaatacagaaatcaatatcacgatcaggtggcatacctggaagatctgaaggaaatacatcggggaactcccgaactacaggcactgaatcaatagccggagtctctgcagtagtatcccgaacataggctagataagccaaacaacccttctcaaccatgtgttgagcctttataaaagaaataactcgattaaatgaactaacagacgaacccttccactccagcttaggcaatgctggaatagccaaggtaacagtcttggcatgacaatctagaatagcatgatatggagataaccagtccatgcccagaataatttcaaaatcggtcatctcaagcaataggagatctgctctagtttcataaccacagaatgtaataatacaggaccggtagatccggttcacaacaacagaatcgcccacaggagtggacacataaacaggagtactcaaggactcacgagaaacacccaggaatggagcaaatagagatgacacatatgaatacgtagatcctggatcaaataatactgaggcatctttgccacaaacagaaataatacctgtaatcacggcatctgaggcctctgcatctggtctagccggaaaagcatagaaccgagctggagcgccaactggctggcctccgcctggctgacctccacctctaggacggcccctacccacctgtcctccacctctggtggtcggactactggtggagcaactggtccggtaagcataggctgctgaccctgctgtactggtctacccaagcctggggcaaaacctccgcatgtgactgggatccccgcactcgtaacaactcttcggtgcgatgggctgctgactaagtgtctggccctggggacctgaatacccactgggaggaccctgaatagctggtgggcggtaagaactctctgggatagcactgagataaggtcgcactggagcacctcgaggaggtggtggtgctggatatgggggtctgctggactgcccctcacgaactgacctctgcccccggacggagcacctctgaactctccagagtacctgaaccgcttatctctcataatctgctctcggctccgctgacgtacaccctcaatcctccgggctatctccacaactcgctcataagaagtacccatctcaacctctcgagccatagtggctgaataccagtatgtaaatgtaatgacccaaccggtcattttaacttttagaaccccgttccctaaaataaaacttccgtaggtgcttgtaatgatttatgacttgcggggatggttggttcgggatttggaagtgtttgggttgaaaccggaacacttggttccttaagttggccttaaagtgctaagtttgacttcggtcaacattttgagaaaacgaccccggaatagaattttgatgattccaacagctccgtatggtgattttggacttaggagcgtgttcggaattttatttggaagtccgtagttaaattaggcttgaaatggctaaaaacaagaatttaagtttggaagtttgaccgatgagttgactttttgataccggagtcggaatccagttccgaaaattttcatagctccgttatgtaatttatgacttgtgtgtaaaatttgaggtcaatcggagttgatttgataggttccgacattgaatgtagaagttgaaaactcttagtttcattaagcttgaattggggtatgattcatggttttagcgttgtttgatgtgatttagaggttcgactaagttcgtatgatgttttaggacttgttggtatatttggttgaggtcccgagggcctcgggtgagtttcggatggttaacggatcaaaaatttgagttaaaaagctgctgcaatttttcctcttctgttggacattctgggctgtgatcgagcccagatatcgagcccagatatcgagcccgaagggttgacgaggtacaggctcgagctagtgtatcgaagccatgatcgaaggtccagctcgagggccatgatcgaaggcaaggctcgagggccaggatcgagacccaagatcgagggtcacaatcgaaggctcaagctcgatgccatgattgaggctatgatcgaaggcccaacctcgatgccctgatcgaggccatgaccgaggtccaggctcgagcctgtgatcgaagcccgatcgaggcccagttcgaggaccagttccgaaggctgctgggcagttttataaaaagagggcattcgtcccatttgccatttttgacgaacttgagcttgagcagagacgacttttggcagattttcaagggaaaaacattggggtaagtgattctaactcggatttggtctacatatacaagtatatcattgttttcacaatttaattagtgttttgagattgaaatttggaaaagtttagaaatctcatagaaacgaaattttgagatttcggtatcgattcggagtcggatttgagtgaaactggtatggttggactcgtaattgaatgggttgtcggatttcataacttttgccggattccgagatgtgggccccgcgggcgaatttttaattaatttcgggatttttcttaaaatgtagtattttcttatagaattgattcctataatatttagtgattgtatcgaattattttggctagattcgagccagacggagttggataatcgtggaaaaggccttatagtggattaaattggagcaagacgaggtaagtctcttgtctaatcttgtgagggggaaattacctcataggtgattaaaattaaataattgttgctaattgtggggggctacgtacgcacgaggtgacgagagtccgtgcgtagctactattaatgctaaagtccgggtagtttaggactcaaagcatgcctttacttgtgtaaattgtattctttgattatttatattaattgatatctatatgaatatattgtgaattgttagataaagatattaaaggatgaaatctcataggcttgatttctgtttaaatcaattaattgttaaaagaaattgttctcctcccaaatttatcttataataaatatactctccttccggaggcacataagaaaatgtcctcctttcttgtggagcgggccgaacgcctcggcaggatagatgcatctatggatcgcgccgcacgtccctcggcagtgtacacgacactctggatcgggccgtacgtcctcggcagaaatcgtgcttaataataataataattacacgatgctttaataatttatttcagcttgtgaagctaattagtaaattgaaaaatctttggaatttaatgaattattattcttgcttgttaaggaattaattgttactcctgtaaatgagatttaattgataaattggaatttatttgaattgaaggaatttaattaatatattgagaattgtacatttgaaggaatttgattatttccgctgattaaataaattattgtaaattctgtaaatcatgctgatttaaatatcctagttttatttcaattattattgacccatagtgagtgtcaaagtcggccatctcgtctctaccacttcgagattaggcttgatacttactgggtacacgttgtttacgtactcatactacacttgctgcactttttgtgcaggatctgagacaggtactagtggaggacctatcatcacatacccacgtcatcccgaggcatagtggtgagctgcctttctgagccgttctgcagctaccagtgtctcttcttatatttatattctgtctatttcatttcagacagtatttggagttttgtataatctactagatgctcatgcacttgtgacaccgggtcttggcacacacattggtagaattggtattttattattttcttggaataaaagtttaaccaatgtatgtttgacttattagttggcttgcctagctgtagtgttgggcgccatcacgacctataggtgaaattgggtcgtgacaacatggtatcagagcactaggttcacgtaggtctcacaagttatgagcagacctaatagagtcttgcggatcggtacggagacgtctgtacttatcttcgagaggctatatggtgttaggaaactacctttcttcatattccatcgtgcaattgatgtagtactaaatatccttctcttattctctcacagatggtgagaacacgctctaatgagattccagaccagggaagagctactcccccagttgctagaggaggcagaggccgagggagggctccagcccgtggtagagggcgaggacgtcccaggactattccagttatgccgccagtggatccagcagagaatcccattattgaggagcagggtgaggtgcctgtggcagagccagctccggtggatttcacatctgcaccgggatttcaggatgtcatgggtcgtatgctgcgattcatggacaatatgactcaggccggtttatttccggcagacccagccacatctcaggcgggcgggggagcacagacccctaccgcgcaggctcatggacaggcagctgctgtatatcagacccagggtgcactacccgtgggtggagcccagccagtggcagcagctacacctgagcccaggccagctgtagccgccgatcctcagaaactattggacagatggactagactacatcctcctgtctttgggggtgagcgacatgaggatccacaggatttcattgatcgttgcaaggatagactgtacaacatgaggatattggagtctcatggggttgactttgctacttttcagctagagggtagagcccgtagatggtggcagtcttatgctcttggcagaccagcagattctcctcccatgacttgggacaggttcacccgtatcttcttggacaggtatattccaccctcccagagggaagagttgcggtttcagtttgagcagctccagcagggtcagatgtcagtgaccgattatgaggcgaggttttctgaattatctcgccatgcactaatgatactccctactgaggcggagagagtgcgaaggtttgtagccggtttacatactggtattcaggccactatggctcgagaggttgagatgggtacttcttatgagcgagttgtggagatagcccggaggattgagggtgtacgtcagcggagccgagagcagattatgagagataagcggttcaggtactctggagagttcagaggtgctccgtctgggggcagaggtcagttcgtgaggggcagtccagcagacccccatatccagcaccaccacctcctcgaggtgctccagtgcgaccttatctcagtgctataccagagagttcttaccgcccaccagctattcagggtcctcccagtgggtattcaggtccccagggccagacacttagtcagcagcccatcgcaccgaagagttgttacgagtgcggggatcccagtcacatgcggaggttttgccccaggcttcggggtagaccagtacagcagggtcagcagcctatgcttaccggaccagttgctccaccagtagtccgaccacccagaggtggaggacaggtgggtaggggccgtcctagaggtggaggtcagccaggcggaggccagccagttggcgctccagctcggttctatgcttttccggctagaccagatgcagaggcctcagatgccgtgattacaggtattatttctgtttgtggcaaagatgcctcagtattatttgatccaggatctacgtattcatatgtgtcatctctatttgctccattcctgggtgtttctcgtgagtccttgagtactcctgtttatgtgtccactcctgtgggcgattctgttgttgtgaaccggatctaccggtcctgtattattacattctgtggttatgaaactagagcagatctcctattgcttgagatgaccgattttgaaattattctgggcatggactggttatctccatatcatgctattcaccttcttcttcacaaataatactggtgcaccttggggcgatacactcggtctgacgaaccctttggctagtaactcttaaagttgttctttcaattctttcaattcctttggagccatgcgatacggtggaataggtaaaggctgggtatctgaagccaagtcaatacagaaatcaatatcacgatcaggtagcatacttggaagatctgacggaaatacatcggagaactcccgaactgcaggcactgaatcaatagccggagtctctgcagtagtatcccaaacataggctagataagccaaacaacccttctcaaccgtgtgttgagcctttataaaagaaagaactcgattaaatgaactaacagacgaacccttccactccagcttaggcaatgctggaatagccaaggtaacagtcttggcatgacaatctagaatagcatgatatggagataaccagtccatgcccagaataatttcaaaatcggtcatctcaagcaataggagatctgctctagtttcataaccacagaatgtaataatacaggaccggtagatccggttcacaacaacagaatcgcccacaggagtggacacataaacaggagtactcaaggactcacgagaaacacccaggaatggagcaaatagagatgacacatatgaatacgtagatcctggatcaaataatactgaggcatctttgccacaaacagaaataatacctgtaatcacggcatctgaggcctctgcatctggtctagccggaaaagcatagaaccgagctggagcgccaactggctggcctccgcctggctgacctccacctctaggacggcccctacccacctgtcctccacctctgggtggtcggactactggtggagcaactggtccggtaagcataggctgctgaccctgctgtactggtctaccccgaagcctggggcaaaacctccgcatgtgactgggatccccgcactcgtaacaactcttcggtgcgatgggctgctgactaagtgtctggccctggggacctgaatacccactgggaggaccctgaatagctggtgggcggtaagaactctctggtatagcactgagataaggtcgcactggagcacctcgaggaggtggtggtgctggatatgggggtctgctggactgcccctcacgaactgacctctgcccccagacggagcacctctgaactctccagagtacctgaaccgcttatctctcataatctgctctcggctccgctgacgtacaccctcaatcctccgggctatctccacaactcgctcataagaagtacccatctcaacctctcgagccatagtggcctgaataccagtatgtaaaccggctacaaaccttcgcactctctccgcctcagtagggagtatcattagtgcatggcgagataattcagaaaacctcgcctcataatcggtcactgacatctgaccctgctggagctgctcaaactgaaaccgcaactcttccctctgggagggtggaatatacctgtccaagaagatacgggtgaacctgtcccaagtcatgggaggagaatctgctggtctgccaagagcataagactgccaccatctacgggctctaccctctagctgaaaagtagcaaagtcaaccccatgagactccaatatcctcatgttgtacagtctatccttgcaacgatcaatgaaatcctgtggatcctcatgtcgctcacccccaaagacaggaggatgtagtctagtccatctgtccaatagtttctgaggatcggcggctacagctggcctgggctcaggtgtagctgctgccactggctgggctccacccacgggtagtgcaccctgggtctgatatacagcagctgcctgtccatgagcctgcgcggtaggggtctgtgctcccccgcccgcctgagatgtggctgggtctgccggaaataaaccggcctgagtcatattgtccatgaatcgcagcatacgacccatgacatcctgaaatcccggtgcagatgtgaaatccaccggagctggctctgccacaggcacctcaccctgctcctcaataatgggattctctgctggatccactggcggcataactggaatagtcctgggacgtcctcgccctctaccacgggctggagccctccctcggcctctgcctcctctagcaactgggggagtagctcttccctggtctggaatctcattagagcgtgttctcaccatctgtgagagaataagagaaggatatttagtactacatcaattgcacgatggaatatgaagaaaggtagtttcctaacaccatatagcctctcgaagataagtacagacgtctccgtaccgatccgcaagactctattaggtctgctcataacttgtgagacctacgtgaacctagtgctctgataccatgttgtcacgacccaatttcacctataggtcgtgatggcgcccaacactacagctaggcaagccaactaataagtcaaacatacattggttaaacttttattccaagaaaataataaaataccaattctaccaatgtgtgtgccaagacccggtgtcacaagtgcatgagcatctagtagattatacaaaactccaaatactgtctgaaatgaaatagacagaatataaatataagaagagacactggtagctgcagaacggctcagaaaggcagctcaccactatgcctcgggatgacgtgggtatgtgatgataggtcctccactagtacctgtctcagatcctgcacaaaaagtgcagcaagtgtagtatgagtacgtaaacaacgtgtacccagtaagtatcaagcctaatctcgaagtggtagagacgagatggccgactttgacactcactatgggtcaataataattgaaataaaactaggatatttaaatcagcatgatttacagaatttacaataatttatttaatcagcggaaataatcaaattccttcaaatgtacaattctcaatatattaattaaattccttcaattcaaataaattccaatttatcaattaaatctcatttacaggagtaacaattaattccttaacaagcaagaataataattcattaaattccaaagatttttcaatttactaattagcttcacaagctgaaataaattattaaagcatcgtgtaattattattattattaagcacgatttctgccgaggacgtacggcccgatccagagtgtcgtgtacactgccgagggacgtgcggcgcgatccatagatgcatctatcctgccgaggcgttcggcccgctccacaagaaaggaggacattttcttatgtgcctccggaaggagagtatatttattataagataaatttgggaggagaacaatttcttttaacaattaattgatttaaacagaaatcaagcctatgagatttcatcctttaatatctttatctaacaattcacaatatattcatatagatatcaattaatataaataatcaaagaatacaatttacacaagtaaaggcatgctttgagtcctaaactacccggactttagcattaatagtagctacgcacggactctcgtcacctcgtgcgtacgtagccccccacaattagcaacaattatttaattttaatcacctatgaggtaatttccccctcacaagattagacaagagacttacctcgtcttgctccaatttaatccactataaggccttttccacgattatccaactccgtctggctcgaatctagccaaaataattcgatacaatcactaaatattataggaatcaattctataagaaaatactacattttaagaaaaatcccgaaattaattaaaaattcgcccgcggggcccacatctcggaatccggcaaaagttatgaaatccgacaacccattcaattacgagtccaaccataccagtttcactcaaatccgactccgaatcgataccgaaatctcaaaatttcgtttctatgagatttctaaacttttccaaatttcaatctcaaaacactaattaaattgtgaaaacaatgatatacttgtatatgtagaccaaatccgagttagaatcacttaccccaatgtttttcccttgaaaatctgccaaaagtcgtctctgctcaagctcaagttcgtcaaaaatggcaaatgggacgaatgccctctttttataaaactgcccagcagccttcggaactggtcctcgaactgggcctcgatcgggcttcgatcacaggctcgagcctggacctcggtcatggcctcgatcagggcatcgaggttgggccttcgatcatagcctcaatcatggcatcgagcttgagccttcgattgtgaccctcgatcttgggtctcgatcctggccctcgagccttgccttcgatcatggccctcgagctggaccttcgatcatggcttcgatacactagctcgagcctgtacctcgtcaacccttcgggctcgatatctgggctcgatatctgggctcgatcacagcccagaatgtccaacagaagaggaaaaattgcagcagctttttaactcaaatttttgatccgttaaccatccgaaactcacccgaggccctcgggacctcaaccaaatataccaacaagtcctaaaacatcatacgaacttagtcgaacctctaaatcacatcaaacaacgctaaaaccatgaatcataccccaattcaagcttaatgaaactaagagttttcaacttctacattcaatgtcggaacctatcaaatcaactccgattgacctcaaattttacacacaagtcataaattacataacggagctatgaaaattttcggaactggattccgactccggtatcaaaaagtcaactcatcggtcaaacttccaaacttaaattcttgtttttagccatttcaagcctaatttaactacggacttccaaataaaattccgaacacgctcctaagtccaaaatcaccatacggagctgttggaatcatcaaaattctattccggggtcgttttctcaaaatgttgaccgaagtcaaacttagcactttaaggccaacttaaggaaccaagtgttccggtttcaacccaaacacttccaaatcccgaaccaaccatccccgcaagtcataaatcattacaagcacctacggaagttttattttagggaacggggttctaaaagttaaaatgaccggttgggtcattacatttacatactggtattcagccactatggctcgagaggttgagatgggtacttcttatgagcgagttgtggagatagcccggaggattgagggtgtacgtcagcggagccgagagcagattatgagagataagcggttcaggtactctggagagttcagaggtgctccgtccgggggcagaggtcagttcgtgaggggcagtccagcagacccccatatccagcaccaccacctcctcgaggtgctccagtgcgaccttatctcagtgctatcccagagagttcttaccgcccaccagctattcagggtcctcccagtgggtattcaggtccccagggccagacacttagtcagcagcccatcgcaccgaagagttgttacgagtgcggggatcccagtcacatgcggaggttttgccccaggcttgggtagaccagtacagcagggtcagcagcctatgcttaccggaccagttgctccaccagtagtccgacacataaccagtccatgcccagaataatttcaaaatcggtcatctcaagcaattggagatctgctctagtttcataatcacaaaatgtaataatacaggaccggtagatctggttcacaacaacagaatcgcccacaagagtggacacataaacaggagtacgcaaggactcacgagaaacacccaggaatagagcaaatagaggtgacacatatgaatacgtagatcctggatcaaataatactgaggcatctttgccacaaacaaaaataatacctgtaatcacggaatctgaggcctctgcatctagtgtagccgaaaaagcatagaatcgagctggagcgccaactggctggcctccgcctggctgacctccacctctaggacggcccctacccacctgtcctccacctctgggtggtcgaactactagtggagcagctggtccagtaatcataggctgctgaccctgttgtactggtctacccctaagcctggggcaaaacctctacatgtgactatgatccctgcactcgtaacaactcttcggtgtgatgggttgctgactaagtgtctggccctggggacgtgaatacccactgggaggaccctgaatagatggtgggcggtaagaactctctgggatagcactgagataaggtcgcactggagcacctcgaggaggtggtggtgttagatatgggggtctgctggattgccccctcacgaactgacctctgcccccagacggagcacctctgaactctccaaagtacctgaaccgcttatctctcataatctgctctcggctccgctggcgtacaccctcaatcctcctgctatccccacaactcgctcataagaagtacccatctcaacctctcgagccatagtggcctgaataccagtatgtaaaccagctacaaaccttcgcactctctccgcctcagtagggagtatcataagtgcatggagagataattcagaaaacctcgcctcataatcagtcactgatgtggctgggtctaccggaaataaaccggcctgagtcatattgtccatgaatcgtagcatacgacccatgacatcctgaaatcctggtgcagatgtgaagtccaccggagctggctctaccacaggcacctcaccctactccttaataatgggattctctgctggaaccactggcggcataattggaatagtcctgggatgtcctcgccctctaccacgggctggagccctccctcggcctcggcctctgcgtcgacctctagcaactgggggaatagctcttccttggtctggaactttattcgagtgcgttctcaccatctgtgagaaaataagagaaggatttttagtgctacattagttgcacgatggaatatgaagaaaggtaatttcctaacaccctatagcctctcgaagataagtacagacgtctccgtaccgatccacaagactctattaggtctgctcataacttgtgatacctacgtgaacctagtgctctgataccatgttgtcacgacccaatttcacctgtaggtcgtgatggcgcccaacactacagctaggcaagccaactaataaattaagcatacattgataaaatttaaaaccaagaaaccccaaactctaccaacgtgtgtgccaagacctggtatcacaagtgcataagcatatagtagatgatacaaaactccaaatactgtctgaaatgaaatagatagaatgtaaatataagaagagacactggtagctgcagaacagctcagaaaggcagctcatcactatgcctcgggatgacgtggatatgtgatgataggtcctccactagtacctgtctcagatcctgcacaaaaagtgcagcaagtgtagtatgagtacgtaaacaacgtgtacccagtaagtatcaagcctaatctcaaagtggtagagacgagatggccgactttgacactcactatgggtcaataataataatgaaataaactagaatatttaaatcagcatgatttacagaatttacaataatttatttaatcagcgaaaataatcaaattccttcaaatgcaacaattctcaatatattaattaaattccttcaattcaaataatttctaatttatcaattaaatctcatttacaggaataacaattaattccttaacaagcaagaataataattcattaaattccaaggatttccaatttatcaattagcttcacaagctgaaataaactattaaagtatcgtgtaattattattattaagcacgatttctgtcgaggacgtacggcccgatccagagtgtcgtgtacactgccgagggacgtgcggcgcgatccatagatgcatctatcctgccgaggcacctccacaagaaaggaggacattttcttatgtacctccggaaggagagtatatttattataagataaattcgggaggaagaataatttcttttaacaattaattaatttaaacagaaaatcaagcatatgagattttccatcctttaatatctttatctaacaattcacaatatattcatatatatcaattaatattaattaatcaaagaatacaatttacacaagtaattcatgctttgagtcctaaactacccggactttagcattaatagtagctacgcacggactctcgtcacctcgtgcgtacgtagcccccacaaattagcaacaattatttaattttaatcacctatgaggtaatttccccctcacaagattagataagagacttacctcgttttgctccaatttaacctactagaaggccttttccatgattatccaaccctgtccagctcgaatctagccaaaataattcgatataatcactaaaaattataggaatcaattctataagaaaatactatattttaaataaaaatcccgaaattaattaaatattcgtctgtggggacaatatctcggaatccggcaaaagctatgaaatccgacaacccattcaattatgtgtccaaccataccagtttcactcaaatccgactccgaatcgataccgaaatctcaaaaattcgcttctatgagatttctaaatttttttcaaatttcaatctcaaaacactaattaaatggtgaaaacaatgatatatttgtgtatatagaccaaatccgagttggaatcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctctgctccagctccaatttgttaaaaaagttggtattggttcaacttttcaacttttgcacacaagtcatacatgacataacggagctgtgaagattttcagaactcgattccgaccccgatatcaaaaagtcaactccgcggtcaaactttcaaactttaaattcttatttttgccatttcaagcctaatttcactacggacttccaaataaaatttcgatcacgctcctaagtccaaaatcaacatacggagctgttggaattatcaaaattctatttcggggtcgtttgcacataattagacatccggtcactatttgaacttaaacttttaaatttttcatcaaaattccatatctcaggctagggacctcggaatttgattacgggcttatgcccgagtcccaagttatgatacggacctatcgaaactgtcaaaacactgatccaagtccgtttgctcaaaatgttgaccaaagtcaactcaattgagttttaaagctctaattcacattttaatccattttttacataaaagcttttcagaaatctttacggattacgcacgcaagtcgaggaatgataaatagtatttttgaggtcttagaacacataattaattattaaatttaaagatgatattttgggtcatcacaggtacaaactttaagaaactcaatttagaaaaattctataactcactttctgtaactaatggaaaaagagaagattgcataaacaacgcagccataagtaaaacaaatgatcagttgatacaaattgagattaatattaagaaaccaaattgaggaaaatacataacaagagaaagaaactcactttctgtataaacaatggagcaataagcaaagcaaattatcatggatgcaaatttgaatcaagaacgtcaaaagatagaaactttaagaaacccaattgagaaaaaaatggcaaataagagaaacccattaacctttctgtaccaggtgacctttaataacacaacccaagaagaaaatgcaagaaattcccttttgcttcttgaggaagcttaaaattacagggaagggtaatgtacttcaatcttctaggtgacgtgaattgggattcaattaggggaatgtgaattaaaaaaaatcccactcatgaaataattagttgatttaccagttgaaaaccctaatacaaagaacaatcgaagccacaaagcctaataaagataaattttggttaaaacccagaagtatcaaagggatttaagctgtagaggaacatgtaaagaaataaaataatttctaattaacagattataccttttgaatcctgaaaatttctctttcttagacgcaggtattgggtcaatggagaagaaaatttcaggggtgctggatttggtaccggtagaaccgagcgacttagtggtggagatggagattttgacgggtctatagagagggtggagatttcgacggttctttcttatgccctttcaaaatagtgaaaattttcactgaaagaaataatggagggaaatttttgatgaaattttttcctttattttttagcacacttattaagtgttgtttttgtgattaaaaagatagcatgctttaaaagcgtggtatataagtgaataagtattgccaaatattttatgatttggcaatacttaaaacgcattttcttcacgtttagaaagtacactttagaaacttagcttaaacttccgtggccaaaagatcaaaataaaggcttacacttataaagcgttcccatagatattattggcaatgctttccgagcgttgtctaaaattagtgtagtcttaggccaaatttgttgtagtgtgaattaaaacatttcttcaagctgatcccttaaagcattggttgttaattagaaacctttcctctatttcaaaagtcaaaaggtttaattaaaatatatttgctctaatttgcattttaagaaaattatggagtatctcattcaatgatgtatctctcgatcgggaggatttacacnnnnnnnnnnnnnnnnnnnnnnnnnnnnnnnnnnnnnnnnnnnnnnnnnnnnnnnnnnnnnnnnnnnnnnnnnnnnnnngttctgattagttgttacttgttaggaatactctgtctaacacttcatagtttggggcttccacatgttcccatgaaagtgtaggcttccacttcacttctgcaattttaaaacttattataattaatcatggaattgttttgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgcactgtaaactggagcactccgagtaatctgatgtgcggactgagctgaccgactgctcgagcctcctctataatgggtcctatctgaagagtaaaatccactgaaccctccagatcttcgagaccttttggcctccttagactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatcaattcctttaattaccaaaaaaaaaagaaaagaaggagaaatcaattgcaattcatctacattcggaagtaaaataagtcagataatagaataatatatatagtgcaaaaacatcattttccttgtgtattttgttgggtgaaaaacattttcctcaaaaaaatgtattctgcagattgtgctttgcatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaaaagagagaggcaacctgtaggctgtagccataccccatttaatttatatttcctgtctaatattgcgtgctatttttaatatattttcacctttttgaaaatctaatggacctttctttcttaaaatagaatacaaatgtttcttacatttgacagcaaatgcaatcagtaaaaccaaaagtaaaaaccaagaagtatacatatgctaagcttgcccatgaaaaaaatatttccgttataaattaactgatctcaagtaattctgaaattttaagaaatgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggcaccttcacagaaattccttacaaaaaataaaggtagggactagagctccaatcataggccaagcatataaatagacgtaggatatcaacaattctattcatccagaattaataaaccctagtaagtgaaagtgaaagaaactactcatccaaatatctatagaaaagtaaatgaatcccaataatgcaaccttctctttctctgagcttgatttccttcaatcaatagaaaaccatcttctgaattatgattccgatttttctgaaattctttcgccgatgagttcaagtaacgcattgcctaatagtcctagctcaagttttggcagcttcccttcggcagaaaatagcttggatacctctctttgggatgaaaactttgaggaaacaataccaaatctccaacttgaagaaaagtccgagtccgaggaggaaacaaaggggcatgtggtggcgcgtgagaaaaccacgacacaagattggagacggtacataggagttaaacggcggccgtgggggacgttttcggcggagataagggacccggagagaagaggcgcgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagctcgagagctcggctcaattttcctcacttaattggatcaaacatgcctaagccggctagagttacagcgagacgtagccgtacgcgctcacccgagccatcgtcttcttcatgcacctcatcatcagaaaaggggacaagaaaaaggaaaatagatttgataaattccatagccaaagcaaaatttattcgtcatagctggaacctacaaatgctgctataactgtatttggaaggaattaattaagggtattctatttttttgtattagaatttagaataatcacctaaagctcctgaaatcgggagctatgccttccaagcaaaataattagcagcaaaaaaaaaaaaaaactagcagctccatccaaattggtagagatattcctttccacggagtaaactgataaagaaaaaaattgaagaaaaaaaaatttaaaaaaaaaaactaagcccactaggaaattcaacccacaacacatgaaatataaaaaagaactgcgaaattttaaaaagaactgcgattcaaataattacaactcccaaaatccggtagaaataagtcacaatctctaaagagaaaatattgagtgtatatatacatcagagtctagtaaaataaagaaagcaacatattaaggatacagggggactccgaggtctgcggacgctggcagatataccttgaagtctccacgtacggtccagctcactggtatctagtttggtaggaagaacttggatctgcacaaaaaaagtgtagaagtgtagtatgagtacaccacaacggtacacagtaactgccaagactaacctcgatagagtaatgatgaggtcaggtcagggccctactagaataaaaaggaaacaagacacgagatataacaatataatgaaattacgaggaatttaaacaatgagaaattacagaaaaataacaacacagcgaataaaggtaaacaacaggggcgctcccgagataccgtctcgtagtcctaaatgtaaatgcacaacagggggagctcccgaggtacaacaggggcactcccgaggtaccgccttgtagtctcaaaagtaaatacactacacataacatatggaacaacaagtttacaacaaggactcatatagttaaagactcatgaatacaaaatcaaagaagcaggtaattcaactaagcatgttgcaaaaattgcaagtaagagttaagatacgtaggcatgctacattaggctaaacatgatgactacacatgctagagtaacttagttaaggaattaaaagaaaactactcagcaagaaccagattcttcaacatttaacccaagtacgcacttgtcacctcgcatacacgaccttcacgtattgcaaatataacagtaccaaaatctaaaggcaatttttcccacacaaggttagacaagtcacttacctcaaatctcgctcaatcagtcgataataatgcctttccttcgactttccgactctgaacgactcaaatctagcaaaaagaaattacatactataaatacaactacaagaaactaatttaaataataaatctacgacttagcaaagaatcgaaaaattacaccaaaatgccaacccgggcccacgtctcggaatcggataaaagtcacaaaatacgaacactcattcgataacgaatccaaccatactaaatttatcaaaatccgacaccaaatcgccactcaaatccccaaattaaactctccaaattcctagccgcaaactcccaaattccaccttaaatacaaacaaacttggtggaaaaatcaatggagaaacaaggttattgataaaaaatgagcacacgagacttacctcaagaaaaccctcgaaacgcctctcaagaatcgccaaaacccgagctcatcaaaatgtttaaaatgaagcataatcgcaaacccttgtatttaagtgttctgctagcacttccacttttgcggaaacttaaccgcttctgctgcgtcgcagaagcgaccaatcgcccgcatctgcggcttcttccactcttgcgtcccctcactccgcttcggcggactcgcttcttcgaacctccatgccgcttatgctatcctagctcgtttttccaattctgcttctgcggtcacgcatgtgcggcaattccctcgcacctgcggccaactgcatacccaatccaaaactcacacctgcgcattccagtctgcacctacgggctcgcacctacgatcaaagctctacaggtgcggttacaccagcagagcctagtcttcatcaatttctcaactttaactcgatccgttaaccatacgaaatcaacccgaggcctccgggacctcaaccaaacataccaacaagtcctaaaacaccatacgaacttagtcaagtctttaaatcacatcaaataacgctaaaaatatgaattgcacatcgattcaagcctaataaactttagtaaatttaaacttctacattcgacgccgaaacctatcaaatcaagtccgattgacctcaaattttgcacacaagtcataattgccattacggacctactccaactttcggaatcgaaatccgaccccgatatcaaaaagtccactcccggtcaaactttcaaaaaattatccaattttccaactttcaccagttgacgctaaaatgacctatggacctccaattcaacatccgaacacgctcctaagtccaaattcaccctccggagctattgggaccttcgaaactccattccagattcgtgtttacacaaataaacctacaattaatttctacgacttaaacttccattttaaggactatgattcccattttactccgaagccaaaaataaattctcctcgtaagtcacaaaacccaaaaatgaaatagagggagaaataaataggggtttggggctaatactctcaaaacgagcagccgggtcgttacatcctccccctcttaaaataaatattcgtcctctaacgagtatagggacatacctgaagtggggacaagatgaggatatcgtctacgcatatcaagctcggtctcccaagtcgtctcctcgacctgatgacccctccactacaccttcactgacgcgatgttctttgacctcaactttcggacctgcctgtccaagatggccaccggctcctcaacataagatagatccttgtctaactagactgagctgaagtctaacacatgagacggatcgacgtgatacttccggagcatggaaacatagaatactggatgaactgcagcgagactaggtgattgtgcaagtctgtaagccacctctccaaccctctcaagaatctcaaaaggcccgatatatctagggctcaacttgccttcctcccgaacctcataacacccttcatgggcataatccggagcaagatccgctcctcaaccatgaatgcaatgtcactaaccttccgatccgtataaactttctacctggactaggctgtacgaagttgatcctgaatcaatttaaccttttccaaagtatcctgaaccaggtctgtacccaataacctagcctcacccggctcgaaccagcccactggagatcgacaccgtctaccatatagagcctcatacggtgccatctgaatgcttgactgataactgttgttataggcaaactctgcaagtggcaagaatagatccaaaacacccccaaattctatcacgtaggtacgaagaatgtcctccaatatctgaatagtatacttgggttgtacgtccgtctgagggtgaaatgttgtgctcaactccacccgagtaccaaactcatactgtacggctctccagaaccgcgatgtaaactgcgtaccccggtcagagatgatagataccggtacaccatgaagcctgacaatctcgcgaatgtaaacctgagctagctgctacgaagagtaagtagtaaccacaggaatgaaatgagatgacttggtcaatctatccataatcacccaaactgcatcgaacttcctctgagtctgtgggatcccaacaacaaaatccatagtgatccactctcatttccactctgaaatctctaactactgaagcaatccatccagtcgttgatgctcatacttcacctgctgacaatttaggcaccgagctacatgttccactatgtccttcttcatccgcctccactaatagtgctgcctcaggtcctgatacatcttcgcggcacctggataactggagtaccactaactgtgagcctccgggagaatcaactcacgtaatccatctatattgggcatacatagcttgccttacatctataatacaccgacatcttcaattgtgacctccttggcattgccatactgaaccgcgtcattaaggacaaacagataggggtcatcatactgacgctctctgatacgataataaagagaagattgcgaaaccatacaagccaaaactcacctcggctcagaaacatccaatatgacaaactggttggccaaggcctgcacattcaaggctaaaggcctctctcctactggtaaatatactaaactgcccaaactccccgccttgcgactcaaggcatcgaccaccatattggcctttttgggatgataaaaaattgtgatgtcatagtccttaagaggctccaactatctccactgtcgcaagttaagatccttctatttaaatagatgttgtagactccggtgatcggtgtagacctcacaagggacaccatacaaataatgacgctagaccttcaaggcatgaacaatagatgctaagtcgaggtcatggacatgatagttcttctcatgcaccttcagttgtctagatgtgcaggcaatcaccctaccgtcctgcatcaacgttgcaccgagaccaatgcgcgacgtatcacaatacaccgtataggaccccgattaagtaggcaacactaacattggggttgtagtcaaagcaatcttgagcttttgaaagctctcttcacaatccttggtccacctaaatggagcacccttctgggtcaatctagtcaaaggtgcatcaatatacgagaaaccctctacaaatcgatggtaataacctaccaagccaagaaaactccggatctccatagctgaggacgacctgggccaactctgcactgcttcaatcttttttggatctaccttgatcccctcactcgatactacatgacccaaaaggccactgactttagttagaattcacacttcaaacatttttcatataactttttttccctcaaagtttgaagcacggtcctcatatgcttctcatgatcctcccgacttcgagagtacaccagaatgtcatcaataaacacaatgacaaaagagtcaagatagggctgaaacatactgttcatcaagtacatgaacgctgatggggtgttggtcagcccaaaagacatcacaaggaactcgtaatgaccatatcgagtcctaaaagtagtcttcgggatatttggctcccgaatctttaactgatgatagcttgaacgcaagtcgatcttagagaacactttggtaccctgaagctgatcaaataggtcatcaatacgtggcaatggatacccgttcttcactgtaaccttgttcaactggcgataatcaatatacattcgcatagaaccatccttcttctttacaaacaagacaggagcaccccaaggcgacacactaagccaaataaagcccttatcaataaactcttgcaattgttcatttaattctttcaactctggtagggccatacgataaggtggaatagaaataggcttagtgcccagtaacaaattaatgccaaagtcgatatccttgtcgtgaagcatgcttggaagatctgccgggaaaatatctgaatagtacctcactaccggaactgactcaatggtaggagcatgaacactaaaatccctcacatattccagataagcatcacaccccttctcaaccattcgctgagccttaagaaatgagataccctactaggaacatgatctaaggtacctctccattctagtcgcggtagacatgtccaacatcaccatcttggcgtgacaatcaagaatagcgtgatagggcgacaaccagtccatgcccaaaataatatcaaaatctaccatactgagcaataataaatcggctctagtctcaaaaccactaataaccatcaaacttgaccgatacacacggtcaacaacaaatggaatcacccacgggtgtagacacatagacaggagaacttagagaatcgcgggatatacccaaatatgaggcaaaataagatgacacataggaataagtggagtctagatcaaataagactaatgcatctctatgacagaccggaacaatacatgtgatgacagaatcagatgaaactgcctctgacctagacggaagggcataatatctggcctggcctcctcttctagggcaacctctacctgtccgacctccacctctagatggctgtgcaggtggggtggtagctagtgttgtaactatagcctgaggactcggtggagcacgcgatgcatgagtggtctgcgaaggtgcacccctcctgagtctggggcaatccctcaccacataacgagtgttactacactcaaaaaaagatctcggaggacatggctactgtgactagctcggggctgattggttggactgaccgctgaaagcaccccatgcaggaggtgcactagacaatggcggtgtataataaggagcctattgatggtaggttataattgcatgttttagtttctcatcgcactctaatttacttcactttaattgactttaagccttaattgctagtgttttgcactaattatgtgttttatgtcttgtaggagtgattccaagttgtgtagatattgtggcataatttcatgctattttggagctttgaagtctgataaaaacccaaggattaagttgggatcgagttcggggatcaacagacactagtgcacttaatgagaaaatcgaaaaatcgagaaggacgtcacccaggtgtgcgagcgcgaactgggcgcacatgtgaggcagaagaccatccaaagtgcgcagccatatgcacgagcacactcccaggtgcgctgccgtgcacgttcaactctggaaagagtcctattatgcgtaggagaaggtgtgttcatttgggcccgaccctacttggtatatatacatggagaaacgatatgtttggggcttttgacacatctaagacctaatgaagctaagaagaagtgggggaagcaagagcacaaggattgcatgattcaatcctcactcaagacaagagtttggatcgattattctttcctttaacttaaacttatttgtgatgaattactccatatctatggagtagttctctttagggattgatggattttgtgtattgatatttgcttgtggattattaactgtaatttgtatgtattgaatcgttttgggtattttaattattgcatctattttcacatgttcatgcaatcgagagaggcataacttgtgacatagttgtgttatcttgttggttgagtttattaggtttcttagtaatcgaaagaggctaattgaattattgtttaaccctagttaggaggataatcgagagaggttctcctaaagaccaatccactacaaattcttgcatatcttcactgagcttaaattggttcatattgtgaggttgagacttaatcgagagaggagtttctactaaacggttgaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagactcacttgaacattagaagtgaattaactagagttaaatccagacatttatcttgcacctatccaatcaatccctattttcttccatttgatatcttctttactcattgttgtgattgtcattactcaatagtttatacttttagtaaaaaaaaaatttaaatcacacaaatctaattgtcgatcgtcgtggatagtaattaaactagaagctacaaaaatactgtttaaatcaaatccttgtggatacaatatttttctatactatattcgaccagcgagcctatgttttatacatcagtttgtgccggggattggcaattaatagtgtttgaaatagtttgtagtgttaattcagaaaaaaaaattcttttatttttttcttttttcgtttagtgttacttgattgtgtgcagactgcaggttaaattggtgcatgactcgatcctcttggaaggaagtgatcccatatgaactagaaatcgagaaataactgcgacagttgaggaaggaaagaaatctccccgagaatacagagaaggttggacaatcctcaaccaaggaagttatggtgggagataatgataatgttgatttggctgcaagagaggcagcccagcaaagagaaaaagctgtatgagatgctgaagagacaactcttcaaaatgcacaacttgtcaatgaagaggagagggctcggagaattgctcagaatctacctttgggtgtagaccaattcagaaatatagctcccggtgctgggagaccattaggtgattattctatatcgatctacaaccaagacttatcaagtgtaaaactgtctccaattgcagctaacaattttgagttaaagcaagggttgcttcaaactcttcaaaatagccgtgtcttcacttgaaagataaacgaagatccaaacaatcatctgatggacttcaccagattatgaacacctttcaatacaacggtgtgtcacaaaatgcagtatacttaagggcattccctttcacactcaaagaagatacaaagcactggcttcgaagcttgcctaatggatcgattagaacatgggatgagatgaccagaacatttcttgacaaatatttctcatcagctaagacgagcaagtttagaagagaaatccataacttcttccagaacgagactaaaactatgtttgaagcttgggagaggtttaaggagatagtgcgaaagtgtcaacatagcggaattgaactctagatgcaactctaggacttttggtatggattgacacccgccgctcggagaacattgagcaatgcaactggaggttcgttgatgaagaagactttagaggatatagtcacaattctaaataagttatctgaagacgcaaatcagtagccctctgagatttctgaaagaagaagatcaactgttgttcaccaagtcgatgctaacacatctatgcaggtacaacttgatgccatggccaaggaaataagggagttgaccttagcttcaatacacagtgagccatatgcagcgtgtgatatatgtgtaagagggaaccctactcatgagtgccaagcctcaatcgaggaagataatgctatcgggaattataacttcaatgcaatgggtcataagcactttgatttttcatggagttcacttgggggtacgacaaacgcatggcaacaaaacaatcccagatttcaaggagctcctggttttgtgaattagccgaggctgcaattccagcctcaatattccactcagcctgggctagaagatctaatgaagtccttcaatgtcaagacagatgagagattagatggtcatggtttatctatcaaagaacttggtactggttttcaaaacttggagaagaaagtgggacaaattgcaactgtattgtctgagaaaatcccaggtactctaccagctgacactgaagaaatcccaaggaaacggtgaatgttgtgaccttgagaagcgggcaagtgttgaaagatcccgaccctgtccaacaagagagtttacctgaaaaagaagttgaaaagcagctgaaaatgaagttgataagaagaataaaggcaagaaaagagttgagaaaaagaagaaggatgagacttcaagaaggcaggaatctaatgagagcgagcatatgcctgctctaccctttccccaaaagttatatagagaaaagctggacaagtagtttgagagatttttagatatgctgagacaggttaatgtaaatttaccattcacagaagttctctcacaaatgccagcttatgccaaattcttgaaggagatccttacaaagaagaggaagatagaagacacctcagtggtcaagctcacagagcattgcagcacaatcttgcaaaacaaactcccacaaacgtgtggagatctagggagttttactataccttgctcgttaggcactcttaattttgataaatctttatgggattctggtgcctcaattaatttaatgcctttgtctatttacaagaagctggataatgagcttggagagataaggtctgtgctaaaatctttgcagctggcagaccaaagaactataatacccaaggagatagtggaagatgtcttagttcgggtagataagtttgtatttcatgtagatttcattgtggtgaagatggaggagaacaaagaggtccaccttatcttaggaagaccattcttagcaacgggcagagcaatattagacatacatgatagaaagctcatacttagaatgagtgaggagacggtgaattttgagatgaatgtagagatgggggtgagaaaggaaaagttaactgcaattgttgagtggaaggtgaagagctcaaaagagaagtcccagtgattgagaaatacaagtgtggggagtaccctaagaaggctgggaagaagctatctgcgtggatgtgtgcactagttcgggaacgaagaatggtgcccgactttgactcagaccccgactagagattcagggaggtttcctctacctcatgccttttaattgtgtgtcatgggtacatgccacaacttaaagtgtggggtggaggatatttgtatgttgtatgtatatgtatttctttttgcttagttataaaagtttgatggaaattgttttttggaaaaccataaaaaaaaattaaaattttcgattttttccaatgatggatatcattcgacaggtttcttgagggataaagttgaaagaaaaagacaaaaagatttttttagttagtgtattacccttggtttttctttgtgccgcggttcttttccaggggttttgtttgaaccgggtgtagttagtttttatttttgttaggagtagaaaactttgtgctatgatttgaattggaagcaatatttcttgactatgttataccttgagaatagtgagtgctctggttgtgatgcttaggctttgtttttcactctcgtagaggtaccttaaattgtatgtttttaactttgcttaactattttgactagagtgtcttgataatccaatcttgagtgagttatatgccatgtgtgtgagagattttggtgtattcggtgcattgcatttgatgtctagaatattccccgtgtgtttgcaaagcgaaatagtagttttattcagtcttggaagtgatataggcatttctttgttgagatagttatatgttattacccaccagattgttatgtatcatagttaaccccgttgagcctgtagtcctgtttctttggaaaccacattacaagacttacccttttgtttgaattgaccatctatttgaaccatttacttctcatgagcacttgacattgttatgaactgtgtaaaagttaaagtgtggggtgattggtttggcttttgagtggaactaatgaattaaggagacaggtgcactgttttgaaaaagtaagagccacttaaattgaaaacgaaaagcaatatagttgtattgttgtgaaaattattcattgataggtaggaactcttgatgtaatagtgcttaaagaagttgggagttaatatatgtggatgtgaaggtggagtcttggtttgacataagtgtggggttttgaatgaaatgtatgtattaaagtacttaaggaggtgtagacactcttatatataaatgtatcctacccattccgcaacctacattacaaccaaataaagtcctacttgatccttgactgaatgagctcgaattagtagagtagtacactacgggcaagcctatgatacatattttgtggcatatgaatgttgtttctgagagtgagcgagttctttctatcttgagttcctaattgttcttaatttctatgttgtgtggaactaccctctattgttatgtgagggcaattgattcatgaaataaaagtaatgtcgttgacctctaggttagagtaagtgagtgagttgtaaataatatgtggtacttgcgagtcaaatgttgagactaggatgttacactattgtgcttaatctattttaaatattcttggtatgatgagttatgagagttgtgtgatgaggtagtgtctatataaagtgtagtttgattgctcgaggacgagaaatggtttaagtgttgggtgtttatggtaggatataattgcgtgttttagttgcttactataatttactgcactttaattgagtttgagccttaatcgctagtgttttgcactaattatatgttttatgccttgtaggagtgattccaagctatttcgatattgtggcatgaattcatgctattttggagctatgaagtcttagaaaaaccctaaggattaagttgggatcgagttcagggatcaacggacactagtgcacttaatgagagaaacgaaaaatcgagcaggacgtcacccagatgcgtgagcgcgcactgtgcgcacatgtgaggcataagaccatccaacgttcatggccatatgcgcgagcacactcccaggtgcgtggccgcgcacgtccaactctggaaagagtcctatttcgcgtaggagaaggtgtgttcgtttgggtctgaccctacttggtatatatacatggagaaactgtatttttgggacttttgacacatctaagacctaaggaggctaagaagaagtgggggaagcaagagcataagggtttcatgattcaatcctcactcaagacaagagtttggattgtttatgctttcctttaacttaaacttatttgtgatgaattactccatatctatagagtagttttctttagggactgatggatttggtgtattgatatttgtttgtggattattaactctagtttgtatgtattgaggttttggttgttttaattgttgcatctattttcacatgttcatgtaatcgagagatccataacttgtgacatagttgcgttatcgtgttagttcaattcactaattcttcttagtaatcgaaagaggctaattgaattattgtttaaccctagttaggaggataatcgagagaggatctcctaaaggtcaatccactacgaattcttgcatatcttcattgagattaaattggttcatattgcgaggttgaaacttaatagagagaggagtttctactaaatggttgaactaataattgagtgaattcgagagactcacttgaacattagaagtgattaactagatttaaatcccacaaatttatcttgcacctattcagtcaatccctattttctcccattgatgtcttccttattcattgttgtgattgccattagtcaatagtttagacttttagtaaattttagttttaaatcgcacaaatctaattgtcgatcgtcgtggatagaaattaaactagaagctacgaaaacactaatcaaaatctaatccctgtggatacattatttttctatactatattccactagcgagcctaagttttatacaccggttttgcgcttatcacctgtggcctaggagtggccggagcaccgctggtggctgaaagtgcttaatgaatagggtgacccacatagcccttaccctgatgagctgcagctggggaactagtaccactatatgtgccagactctcaagacctcttggcctcctctcctctctctccctaatcaatataccctccaatctcctagcgatccccaccacctgctggtatgcgatgtccatatccaaatctcgggccatgctaaatctgatactgggcttgagccccttaataaatcgaagaactcgctcctgaactataataaccaaggctggtgcatgcctttccaaatcattgagctggacctcatactccgacacagtgatagaactctggagcaatgactcaaactctatgcgtcatgcatctatgagactatagggaacatacttcctcaagaacttatctcagaactgaatccaagtgagtgaagctgcctcggccggactacctaactcatatactcgccaccactgataggtcgctcctctaagctggaacatagtgaaagaaaccccactagactctgcaacacccatagtacggaggatacaacgacactcctcaagaaaaccctgggtatcctctgatgccaagccactgaaagtaggagggtggagggtgttacttcttgaaccactcgagcctaagttgctccccctcaaaaactgttgccctaacctcgggctgaactggaactaccagctgcatcggtatgacctcaggaacctggtcgacctagtcccgctactctggggtacggacaatgggagtctgtgctccatccccagcctgagatgtggaaggagcaagtggtatcaatccttcttgagccaaggtgctgaacatgctcaaaaactgggcgagagtctcctggaggactggtgcagtaataggcgtctcaggtgcctaccctccaattggagctacttgtggctcctctgtagcagcgagtgcgagcgctctggctgcaccacgtggatgtcctcatcctctaccccagccccaacctctcgtggctctatcagggggcacgagggatctggtcatttgatccagcagtacgtgtcctcaccatctgtgagagaataaaaagataaaaatttagaattcgaagtcaaaatctcgcactataaggaatcaaagaaatgaatcttttcctaacagttccatagcgtcctgaagataagtacagacgataccgtacagatccgtgagactctactaagcctgcttgtgactcataacacctatgaacctagtgctctgataccaacttatcatgaccccaatttacctccgtaggatgtcgtgattgcacctaatctctaagactaggtaagcctaacaatttgcggaataactgaatataaactaaactcaaccctcagcacatgagatataaataagaactgtgattcaaataattacaagtcccaaaacccggtagaaataaatcacaagctctaagagaaaatgttaagtgtctatatacatcagattctagtaaaataaagaaagcaacatattaaggatagagggggactccgaggtatacggacgctggcagatataccttgaagtctccacgtacggtgtagctcactggtatctggcttggtaggaagaacctggatctgtacaaaataatgtgcagaagtgtagtatgagtacaccacaggggtacctagtaactgccaagactaacctcggtagagtagtgataaggtcaggtcaggggcctactggaataaaaaggaaacaagacaggagatataacaatataatgaaatgacggggaatttaaacaatgagaagttatataaaagtaacaacataacgaatagaggtaaacgataggggcgctcccgaggtaccgtctcgagacccaaatgtaaatgcacaacaaggggagctcccgaggtaccacctcgtagtcccaagagtaaatatacaataggggcactcccgaggtaccaccccatagtcctaaaagtaaatacactacacataacatatggaacaacgagtttacagcaaggtctcatatagttaaagagtgaatacaagatcaaggaagcaggtaattcaactaagcatgttgcacaaattgaatgtaagagttaagacatgtaagcatgctacattaggctaaacatgatgactacacaggctggagtaacccagttaaggaattaaaagaaaactactcacaagaaccggattcttcaacatttaacctgagtactcactcgtcacctcgcgtacacggccttcacgtattgcaaatatcataacagcaccaaaacctaacggtagtttcacccacacaaggttagacaagttatttacctcaaatctcgctcaatcagtcgataagaatgcctttccctcgactttccgactccgaatgacccaaatctatccaaaagtaattacatactataaatacaactacaagaaacaaatttaaataataaatctacgacttagcaaagtatagaaaaatcgccctaaaacgtcgacccgatctcacgtctcggaatcaggtaaaagtcacaaaatacgaatacctattcgatatcgaatccaaccataccaaatttaccgaaatcagacaccaaatcgtcactctaatccccaaattaaactctctaaatccctagcctcaaactcctaaattccaccttaaatacacaaaaactaggtggggaaatcaatagggaaataaggttattgataaaaaaaaaatgagcacaagagacttacctcaaggtacctctcgaaagtcctcttaagaatcgccaaaacccgagctcaaaatgtttaaaatgaagcataatcgtgaacccttgtatttaagtgttctgccaccacttctgcttctgcggaaacttcactgcttccgcaacattgctgaagcgaccactcgcccgtatctgcggctttttccgctcttgcatcccctcactccgcttctgcgggctcgcttctacgagcctccaagctgcttctgtggtcccagctcccttacccaattctgcttctgcagtccccctaccgcatttgcggtcatgcaggtgcaaaaattccctagcacaagcggccacctacacaccccctccaaatctcgcacctgtgcattccagtccgcaccatcgggctccacctgcgatcaaagctccgcaggtgcagttacacctgcatagcccagtcttcaacaatttctcaacttcaaatcgatccgttaaccatcccaaatcaactcgaggcccccaggacctcaaccaaacataccaacaagtcctaaaacaccatatgaacttagtcaagcatttaaatcacatcaaacaacgctaaaaatacgaattgcatatcgattcaagcctaatgtactttagaacttcaaacttctacattcgatgccgaaacctatcaaatcaagtccgattgacctcaaatttttcacacacgttataattgccattacggacctactccaacttccggaatcgaaatccgaccccgatatcaaaaagttcattcccggtcaaactttccaaaaatcatccaattttccatgtttcaccaattgacgctaaaatgacctacggacctccaattcaacattcgaatacgctcctaagtccaaaatcacactaaggagatattggaaccgtcaaaactccattccagattcgtctttacactaatcaacctatagtcaattcctacgacttaaacttctattttaaggactatgtgtcccattttactccgaagccaaaaaattattctcccggtaagtcaaacaacccaaaaatgaaatagaaggagcaataaatagggatgcggggctaatactctcaaaatgaccggccgggtcaatacatcctccccctcttaaaataaacgttcatcctcgaacgagtataggggcatacctgaagaggggaaaagatgaggatatcgtctacgcatatcatgctcggactcccaagtcgcctcctcgataggatgacccctccactacaccttcactgatgcgatgttctttgacctcaactttcggacctgcatgtccaagatggtcacccactcctcaacataagatagatccttgtccaattagactgagctgaagtctaacacatgaaacgaatcgacgtgatacttccggagcatggaaacagggaatactggataaactacaacgagactaggtggttgtgcaagtcggtaagccacctctccaaccctctcaagaatctcaaaaggctcgatatatctagggctcaacttgcccttcctctcgaacttcaaaacacccttcatgggcgaaatccagagcaagacctgctccccaaccatgaatgcaatgtcgcgaaccttccaatccgtataactcttctacctggattaggctgtacgaagttgatcctgaatcaatttaaccttttccaaagcatcctaaaccaagtctgtacctaataacctagcctcgcccgactcaaaccaacccactggatattggcaccatctaccataaagagccttatacggtgccatttgaatgctcgactgataactgttgttgcagggaaactccacaagtggcaagaacagatcccaaacacccccccaaattctatcacgtaggtacgaagaatatcctccactatcttaatagtgcactccggttgtacgtccgtctgagggtgaaatgctatgctcaaatctacccgagtacccaactcatgatatacgactctccagaaatgcgatgtaaactgtgtaccccggtcagagatgatagatactggtacaccatgaagcctgacaatctcgcaaatataaacctgagccagctgctctgaagagtaagtagtaaacacatgaatgaaatgagctaacttggtcaatctatccacaatcatccaaactgcatcaaacttcctctgagtctatgggagcccaacaacgaaatccatagtgatccgctctcatttcccctctagaatatttaacttctgaagcaatccacccggtcgctgatgtttatacttcacctgctgaaaatttaggcaccgagctacatattgcactatgtccttcttcatccgtcttcagatttagtgttgcctcaggtcccgatacatcttcgtgtcacctggatgaatagagtaccatgaactgtgagcctcttggagaatcaactcacgtaatccatctacattaggcacacatagcctgccctgcatccgtaatacacagtcatatccaatggtgacctccttggcatcgccgtactgaaccatgtccttaaggacaagcacatgggggtcatcataccgacgctctctgatacgattataaagagaagagtgagaaatcacacaagccaaaactcgactcggctcgaaaatatccaatctgacaaaccggttggccaaggcctcaacatctaaggctaaaagcctctccgctactggtagatatgctaaactgcccaaactccccgccttacgactcaaggcatcggctaccatattggccttttcgggatgataaagaatggtgatgtcataatccttaagcacctccaaccatctctactaccgcaagttaagatccttctgtttaaacagatgttgtagactcctgtgatcaatgtagaccttacaagggacaccatactaataatgtcgccaggtcttcaaggcatgaacaatagctgctaattcgaggtcgtagacaaaatagttcttctcatgcacctttagttatctagacgcgtaggaaatcaccctaacctcctgcatcaacattgtgcctagaccaatacacgacgcatcacagtatactgtgtaggaccgcgatccagtaggcaacactaatactgggttgtagtcaaatcagtcttgagcgtttgaaagctctcctcacaatccttggtccacctgaacggagcacccttctggttcaatctagtcataagtgcagtaataaatgagaaaccctctacaaatcaacggtaataccccgccaagccaagaaaactccggatctccgtagctgaggacggtctaggtcaactctgcaccgcttcaatcttcttcagatctactttgatcccctcacttcaaaatttttgcatataacttctttttcctcaaagtctgaaacacggtcctcgggtgctgctcatgatcctcccgactccgggagtacaccagaatgtcatcaaaaaatacaatgatgaaagaatcaagatggggttgaaatgcactgttcatcaagtgcctgaacgctgctggggcattggtcaacccaaaagacatcacaagcaactcgtaatgaccatagagagtcctcaaagaagtattcaagatatcttgctcccaaatcttcaattgatgatagcctgaaggcaagtcgatcttagagaacactctgacaccctgaagctggtcaaattggtcataaatacatggcaatggatacttgttcttcattgtaaccttgttcaactggcgataatcaatacgcatttgcatagaaccatccttcttatttacaaacaagacaggagcaccccaaggcgacatactaggccgaatgaaacccttatcgagcaactcttgcaattgttcctttaatttattcaactctgctatggccatacaataaggtagaataaaaatgggttgagttcccggtaataaatcaataccaaagtcgatatccttgttgggtggcatgcccgaaagatctagcgggaaaacacctgaatagtccctcactaccggagctgactcgacggtaggagtatcaacagtaacatccctcacttattccagatatgcatcacaccctttctcaaccatttgccgagccttaagaaatgagacaacccttctacgaacatgatctaaggtacctctctactctagccatggtagacctgtcatagccaacgccactgtcttggcatgataatcaaggatagcgtgataggtcgacaactagtccatgcccaaaataacattgagatccaccatactgagcaataataaatcagctttggtctcaaaatcactaagaacaatcaaacacgaccgatacacacggtcaagaacaatgaaatcacacacgggtgtagacacatagacaggagaactcagagaatcacgggatacacccaaataaggggctaaatatgatgacacataggaataaatggatcatggatcaaataagactgatgcatctctatgacagaccagaacaatacatgtgatgacagaatcggatgcaaccacctccgtcatagaaggaagggcataatatttggcctggcctcccctctagggtgacctctacctgtccgacctccgcatctagttggatgtgcaagtgggatggtagctggtgttgtaaccatagcctgaacccggtggagcacgcggtgcctgagtgtctgtggaggtgtacccttcctgattttggggcaatccctcaccacatgacgagtgtcaccacactcaaaataagatctcgaaggacgtggctattgtgactggatcgggcgtgatcggttggactgaccgctgaaagcaccccatgcaagaggttcactagacaatggcaatgcataataaggagcctggggcctagaaacggtcggagcaccgcaggtggctggaagtgctgaaagaatagggcgacccacatagcccctaccctgacaagcagcagctgggggacgagtaccactatatgtgccagaatctcgagacctcttggccaccctctcctctctctccataatcaacataccctataatctcctggcgatccccaccacctgctggtatgcgatatcaatctccaactctaggccatgctaaatctgatattggggttgagcccctcaataaatcgacaaactcactcccaaactgtagcaaccaaggatggtgcatgcctgtccaaatcactgattcggaccgcacactccgacacggtcatagaaccttagcgtaactgctcaaactctgtgtgccatgtatctctgagactctagggaacatactccttctagaacatatctaagaattgagtccaagtgagtgaagctgcttcggccggactacccaactcatatgctcgtcaccactgataggtcgttcctctaagatggaacgtagtgaaagaaacccaactagactccaaaacacccatagtacagaggatacgatggaactcctcaagaaaaccctgggcatcctctggcgccaagacactgaaagtaggagggagttacttcttgtacctctcgagcctaaactgctccccctcagaaacggttgccctaacctcgggctgaactggaactaccggctgcattggtatgaccacaggaacctgggcgacctggacctgctgctctggggtatgggcggcgggagtctgtgctcctcccccggcctaagatgtggtaggagaaagtggtattaatcctgcatgagcgaaggtgctgaacatgctcagaaaactgggcgagagtctcctggagggctggtgcagtaacaaacgtctcgggtgtgtgtcctccaactgaactggagctactaatggctcctctgcatcagctcgtgcgattgctctggctgtaccacgtggacgtcctcggcctctaccctggccccagactctcgtggttctagcagggggcgcgaggtgtttggtcatttgatccagtggtacgtgtcgtcaccatctgtgagagaatagaaagccaaaaatttagaatctgaagtcaaaatgtcgcacgataaggaatcaaagaagtgaagctttttctaacagtttcaaagcctcccgaagataagtacagacgtctctgtactgatccgtcagactctactaagcctacttgtgactcataacaccaatgaatctagtgctctgatactaacttgtcacgaccctaatttccttccgtaggatatcatgatggcacctagtctctaagactaggtaagcctaataatttgcggaataaccgaatataaactgaactcaaccctcaacacatgaaatataaataaaaactgcgattcaaataattacaagtcgcaaaactcgatagaaataagtcacaagctctaaagagaaaatattaagtgtctctacacataatagtctagtaaaataaagaagcaacatattaaggatagagggggactctgaggtcagcggacgttggcagatataccttaaagtctccacgtacggcccaactcactgctatctggtctggtaggaagaacatggatctgcacaaataatgtgtaggctagggatttggagagttaaatttggggatttgagtggcgattcggtatcgtattttggtaaatttggtatggttggattcgatatcgaatgggtattcatattttgtgacgtctacccgattccgagacgtgggcccgggttaacattttggagcaattttttaattctttgctaagtcgtagatttattatttaaattagtttcttgtagttgtatttatagtatgtaattgcttttggctagatttgggtcgttcggagtcagaaagtcgagggaaagacattcttatcgactaattaagcgagatttaaggtaagtgacttgtctaaccttgtgtgggagaaactccccttaggttttggtactattatgatatttacaatacgtgaaggccgtgtacgcgaggtgacgagtgcgtactcggattaaatattgaagaatccggttcttgatgagtagttttcttttaattccttaactgagttactctagcatgtgtagtcatcatgtttagcctaatatagcatgcctacatgtcttaactcttacttgcaatttgtgcaacatgcttagttgaattacctgcttccttgatcttgtattcagtctttaactatatgagtccttgctgtaaactcgtcgttccatatgttatgtgtagtgtattttcttttaggactacgaggcggtacctcgggagtgcccctattgcatatttacttttgggactatgaggtggtacctcgagagctccccatgttgtgcatttatatttgggactacgagacggtatctcgggagcacccttgttgtttacctctattcgttgtgttgttacttttctgtaacttctcattgtttaaattcccgtctttttaatatattgttatatctcctgtcttgtttcctttttattccagtaggggcctgacctgacctcgtcacaactctaccgagattaggctccgtaggtgcggttacaccatcagagcctagtcttcagcaatctctcaacgttaaccatctgaaatcaacccgagacccccaggacctcaaccaagcataccaacaagtcctaaaacaccatacaaacttagtctagcctttaaatcatatcaaacaatgctaaaaatacaaattgcacttcgattgaagcctaataaactttagaactttaaatgtctacattcgacgctgaaacctatcaaatcaagtctgatttacctcaaattttgcacacaagtcataattgacattacggacctactctaacttccgaaatcaaaatccgaccccgatatcaaaaagtccactcccggtcaaactttccaaaaatcatccaattttccaactttagccaattggcgctaaaatgacctacggacctccaattcaacattcgaacccgctcctaagtccaaaatcaccctgcgaagctattggaactgtcgaaactctattccggagtcatcttcacacaaatcaacctacaatcaattcctactacttaaacttccattttaaggactatgtgtctcattttactccgaagccaaaaacaaattctcctggtaagtcacaaaatccaaaaatgaaatagaaggaataataaataggggctcggggcaaatactctcaaaacgatcggccgggtcgctacaaacggccgtgcatccaatcaagatatttcaaaaatctagagatcttataattggttctcattttagattgaatctgaaatataatgtttaaattccttcatttttagtcgatcatgtaagaatatcttgaataatattattttctttttactgtaaaatcgaatttcgctattttaattttgctagtccttgggaacagtgtagcaacagataattcaaaatcagaataggtccagtcgaggggacaaatcaatggaaaatgctatttgcttcgtaagaataagaattcacttctatgaaatggaagagtttcacggaaattgtctagattgttggatatcattgagaaagaaatagaaagaagtgttatcgaacgatttcctgcaattcttcccggtatgcaatgagtaaagaatcaagctacaagtctcgatcgatacgaaacgatttgatgaatcactgttaggtgttccaaaaatagtatggaatgagtaaagaatcaagctacaagtctcgatctatacgaaacaatttgatgaatcacttttaggtgttccaaaatatttttgcagtatttgtatgtaggttctgctttagttaaggaggacggcgttataaactattttactaacaatttgtagctattttcacccaagtgatgagactctcttttaatttaattaagcaggaataaccgcgctaaatacctgcttaattataaaagaacctcattcacttgacttctttaatcctggaacagtcagcaataaattgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtcatagatctcaatccaactccattggagcaaaaaaaatgcaacacatgctattacttttttttaagcgaccattttcagaatttttaaaatttacgtactctattataatattttaattattatcgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatcctgacaacggtgtcagtccatgggtcatgagaaaacttaaagagcgagagaaaaaaaaaaaaaaaaaaaggatactacattggatatataaactaaatataatcatctattcacccaaatcagaggtccgtaagttacaagtttgtctggataatccagttaaatctttcacgagtgtcaaatggacgaattttcctgaatttaagcgggttaaaacggattaaattaacaaatcaataagttatgtatccgttctattagacgtttgttctaattttcttattatatttagtttttctatctttcgaatgaaagacaacctatttaccataattaattttacaatttacgtaaagaaaaatataattctttcatatttggcaagtttttttcttggaggaaaagatttttaacatctataaattgataatccttccttctcatttaatagcatccacaatgtagtccataaggggtattagagtcttatttatttgaagaaattttagacaagtattagtctgtctcttgtgtgtgcctcttagtggtttttttctcgatattttgtactctcttttatatagtgtattgcttatctccgcctgtggatgtaggtcaattggccgaacaacattaaatatttgtgtctcttttgctatatttttcttttgttatttaatttatcgtcgttcaaggtctgttttgttagcttcagcataaaacctggttatttttattttaaaacacttaaaggttaattgaacatatgtatgaatcaaaacagacaaaacaatagatcgtaagttataacttcaaatttgagtggatcatttttttatgggctaactttgacaccttaaatcttaatctctcgtgatcttcagttgaaaatctaaatatgaatcatttttgtgtcggtgacattaatttgcgagagatcttgcttttcactcatatcccaagttatggaatctcgtgaaatgcatcgaagtatgaccatattggcatatgtaaactgactcatataaaagtttaagcaattaaacatgaaatattgatgttatttaatttaaattggcaacatgaaacatgagtcagctattttaactgactcataatgttaaattaaacattatgttttaatttcctcaaataattagccaatcattcgatcaatttgttgagttttacgacccaaaaacccgcctcatgcatcaagatgacacctaatttctaagactagattagtcgattacttgaaaatgaaaaagattatagtataatacattactttatataatatatatataaaattaagttacaatctcccgagaagggtaaataagtttataatgtaatatagataggtcaaaattcctttaagctgttttcacatcaattaagcaaaacaataaatacaaggtatagtttattaaattattcctatataatgaaagtagttagatttttttttttaaataccatgcattcttattaatattaagggtataatctaaaacaattaacaagtttaattttgaattcctaaagtgatagtaattttttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatttttttaattttgagctaaaacgaaagtagttaagatgtcaacaaagtcttatggtggtctttacggcgtcccgcttttttttttcttaggttaactaattaatcttgtctgcactatttttcttccctttccgttatactttttcagtgacgtgtgcagtggtggttttcttttctccttcttctaatagcagttatagtaagaaattttatttaaagcattcatgagcaattgttgggacaaatttgataaagaaaacaagtagccatcttatcgtacttttaacaaatgaagaaagttaacactaaaaaaggaaaaattggcgtcttcatgttagatggagatggtgatgaaattgtggggactgggaagtatgcccatcgattaaaattttatttttttgttttcaggaactagcaagattggtcccagagtaaattcaatgaagaaaagaaaatttaaaaagaaaaaaatggccatttaagttgggaaaggccgattgatgcacaattgcacattcgtctagtatttttgtactcattctttattggaattctccaacaatcaatatagtgatatgaattattaaacaagtttttaaattcagaaaagctattggtacacccataatcttgttctttatcaaactatttgcaggtgaattaacactatcaacctgcaacactttaataatttaatttgttacctcaaccaaccgaaattagaatagagaatgctttctgacatttgatagctcatattgtcaccataagaatacaaacttgtttatcaaataaaacctttcctttatatacgtgcaaagattatattccagtgattttaaataaataatccgaaggttttggaaatgaacgtgatctcgtcatacatgatgtacgatattaatatagttgtttactcacttttcaagaaggaaatataatattcattacatataatagattatcaactcacattatttatttctcttcaaattttaccggaaaaatcggataacgttagatttgtgtatggttctaaaaatatgcgatacaattcgatgtaaatcgcgtagagaaatggaaatatgtgtattgttgactgtgaggatgaaaataataagcgaaaagaataaataagtaaaacaagcacaaggggataactatcaatataagaagtgatcttcttttttcggggtccatagcttacaaggattcctccttttatagaagagggtcattacaaaaaataataaaataaaacatatagtggatggcccatgatgacttgtctcttccttgattcctgccaagattctctctcttggtgcggttgcaacggctcatgtctgtgagctcgatactagctcgaactcgttacttggtcgggcccttcgatcttggatcgagttcggccttcgagatgggcgtcgcacatttccgacctcgaagcagtgccttgcggatcgattcggtcacgggctcgataggattatcgagccgcctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaacattcgaactcgatctaacgtaggaaggccgaaatctatttttaccgtatacagatagtcccctcgtttcttgaaaaaggatatggtgagaaacgatatgatttcccaacagctctgtcacgaccccaaatttcctccgtaggatgtcgtgatggcacctagtctctaagactaggtaagcctatcaatgcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaataattacaaataatatctcgtggaatcaaaacagaatttccttcaactttctgaaaatcacaacaattaatcgaaagcaactatggccataaatcaatatcaacaagggcactcacgaggtaccgcctcgtagtcccaaatcataaataaattcacaatatctcattttcttatatcaccgcgggagccttcataatttatttaaagaaaatatttttttccgaaatagcaccccgcgttttagccacccttatcacaccgcatgacttctagtagttcccctactagccacgcgtatcaagccacccttatctcaccgcatggtcattttaagcatttacactcctttcaactatttgaggtcttgcataacttcctacgaggtattatgacttgtgtaaattatcggttttggttttaaggtatttcggagttagcttggaagaatgaatttcatgttggaagcttaagttgaaatagtggatcgatatggacctatgtgtaaacgaattcggatttgaatttttatgatttcaatagatccgtattgaaattttggagccatagcaaaaagaatcgtcgaattcggacatcgtatgagagagttatgcccatttctgtatcggaggagatttcccgtcgccgcgagcgcccagggtagcgtggggcgctagccctggcgctgggaatttttgggtactggaaactgcgccacaggcagcgccccacgctacctgtgacgctcaaaaacaccagaggctctataaacgggttttttgaccatttttgacaaaaatagagttggggagctcggtttgggcgatattgggcgattttcatgggtaaacattggggtaagtgttccttatcctatattgattatatttcatatccatggtcatcattttatttcggatttatggaagaaatcaagatttttgcaaaatcttccaaaaatgtaaaatttaagatttggaggtcgagttgttatcggaattttggtaaaattggtatgggtggactcgtaattgaatgggttatcggattttgtagtttcgttggattccgagacatgggtcccacgggcgatttttgagttaaatttcggattttgttggaaaaatttgtattctcatatggaattaattcctacgattcgtgttgagtatattgaattaattgtgaatagatttggagcttttggagaccgagtccagagacgagggcatcccggagtaggattttacgctgtttaggtaagtaacagttttaactctggctttgagggtataaacctggagatttgacatcacgtgattgtttggaagtgatatccacgctaggtgacgagcgtgtaagtgtgcaccgcgagagattgagacttggtccgtcccgtgaggttgtgaggcctaatggctattatctatggttatgtgtttatttgttgttgaacttgtttgccttcatgttagagatcatgcttaggctttattcatgctcacattattggtactaagtcagagaaaatattgtacatgttacctcagtctctattatttgctaaaatgtggtggtacttgatgtgggttgtgttcccttatttgttggtgatgatgaggctagtgaggtacatgattgagtgaggccgagggcctggttgtgaggatattaatatcatagcgcatgagttgtccgcgtagcacgtgagttgaccgtgcgggtccaggtagtgataccatagcgcgtgagttgtccgcgtagcacgtgagttgaccgtgcggatccaggtattgatattgattgagtgaggcagagggcctggttgtgaggatattaatatcatagcgcgtgagttgtccgcgtagcacgtgagttgaccgtgcgggtccaggtagtgataccatagcgcgtgagttgtccgcgtagcacgtgagttgaccgtgcggatccaggtattgatattgattgagtgaggcagagggcctggttgtgaggatattaatatcatagcgcgtgagttgtccgcgtagcacgtgagttgaccgtgcgggtccaggtagtgataccatagcgcgtgagttgtccgcgtagcacgtgagttgaccgtgcggatccaggtattgatattgattgagtgaggcagagggcctggttgtgaggatattaataccatagcgcgtgagttgtccgcgtagcacgtgagttgaccgtgcgggtccaggtagtgataccatagcgcgtgatttgtccgcgtagcacgtgagttgaccgtgcggatccaggtattgatattgattgagtgaggcagaggacctggttgtgaggatattaataccatagcgcgtgagttgtccgcgtagcacgtgagttgacccaggtattgataccatagcgcgtgagttgtccgcgtagcacgtgagttgaccgtgcggatccaggtattgatatgatggcacgtgagttgtccgtgcttagcgcttgggctttgggagcccctccggagtctgtacacacccccagtgagcgcagagtgttgagtgttttgagtattgagtgctgagtgcgagtgatgagtgatggagtgacactgctgtgaggttgtatttatttgtgttgttgctgcatttatctgttaaacttctttgtggcatttactgagttatggaatttacctgtttattctgtttatttttaaattgtgaaaataaataattggactgttttacttagctcgtcactactgctcagttccttagttatttctgttactactgaggttgtactcatactacaccctgcactttatgtgcagatccaggtgagttagagcgcgacgattgttgatatctgtggagattgcaaggtagctgctagcgtccgcaggaccttgttactccttttatcatttcttcttttggattgtattgacagttagacagtttcatttcttagttcatagatttagacgctcatgacttagtgacaccccgatgtttggggctcgttttcgtatttctaaaatatattagagttgatttagtttatgagaaattcaaatgttgaaatgttttattaaattcttataatcgatttagtagaaatattttgggaagtaggcttgccttgtaacacgataggcgccatcacgaccatggttagattttgggtcgtgacaagttggtatcagagcctaggttacataggtctcacgagtcatgagcgggtttagtagagtcttgcggatcggtacggagacgtctgtacttatcttcgagaggctgcagaacctttaggaaaacttcacattcttgaattcttttcgtgcggtattgattcagcttgaagtgtaactctttgaattccttccacgcattcgtatgcgcacatggcgctcggtatcagttgtgcatcgacggcttgtgattccctggatgaggtgcgagatgtgatttctgtgtgttgatgttgggccagtctggaggactgaggccggggttttgactatagcttgagcactgaggtgttgattgtgtgagcgcgtgcttgtggtacttttggggatatttaagagagtattcagcggcttatgagccttagggcggtgtggttttatgcttgggtctcgtgtggtgagtctgggttgaggattgtggtgttatggcggggcaaagtatcaatttgaaggtaattcagaaggaactcggatagataggacatcttggtagtaggttggatcggcatggtaatgggtatgattagttctttgggtgtgtatgaggtaatgagttctacaggtgttttgtggcaatgtccttgggtttttggtggtctgcgtagcttggttgagttagaaggattcagtcctgacggattgatttgtgccattggggttcggagaagttcttgatggttttgagaacaactcttggcacgttcgaggacgaacgtatgtttaagtgggggagattgtaacgacccgaccggtcgttttaagcatttacactcctttcaactatttgaggtcttgcataacttcctacgaggtattatgacttgtgtaaattatcggttttggttttaaggtatttcggagttagcttggaagaatgaatttcatgttggaagcttaagttgaaatagtggatcggatatggacctatgtgtaaacgaattcggatttgaatttttatgatttcaatagatccgtattgaaattttggagccatagcaaaaagaatcgtcgaattcggacatcgtatgagagagttatgcccatttctgtatcggaggagatttcccgtcgccgcgagcgcccagggtagcgtggggcgctagccctggcgctgggaatttttgggtactggaaactgcgccacaggcagcgccccacgctacctgtgacgctcaaaaacaccagaggctctataaacgggttttttgaccatttttgacaaaaatagagttggggagctcggtttgggcgattttgggcgattttcatgggtaaacattggggtaagtgttccttatcctatattgattatatttcatgatccatactcatttatatcatgaatccgtgaatttatggaagcaaaatcagatttttgtaaaatcttccaaaaatgtaaaatgaagatttgaaggtcaatccgatatcggaatttgataaaattggtatgggtggacttgtaattgaatgggttatcggattttgtgagtttcgttggattccgagacatgggtcccacgggcgatttttgagttaaatttcggattttgttggaaaaatttgtattctcatatggaattaattcctacgattcgtgttgagtatattgaattaattgtgaatagatttggagcttttggagaccgagtccagagacgagggcatcccggagtaggattttacgctgtttaggtaagtaacagttttaactctggctttgagggtataaacctggagatttgacatcacgtgattgtttggaagtgatatccacgctaggtgacgagcgtgtaagtgtgcaccgtgagattgagacttggtccgtcccgtgaggttgtgaggcctaatggctattatctgtggttatgtgtttatttgttgttgaacttgtttgccttcatgttagagatcatgcttaggctttattcatgctcacattattggtactaagtcagagaaaatattgtacatgttacctcagtctctattatttgctaaaatgtggtggtacttgatgtgggttgtgttcccttatttgttggtgatgatgaggctagtgaggtacatgattgagtgaggccgagggcctggttgtgaggatattaatatcatagcgcgtgagttgtccgcgtagcacgtgagttgaccgtgcgggtccaggtagtgataccatagcgcgtgagttgtccgcgtagcacgtgagttgaccgtgcggatccaggtattgatattgattgagtgaggcagagggcctggttgtgaggatattaatatcatagcgcgtgagttgtccgcgtagcacgtgagttgaccgtgcgggtccaggtagtgataccatagcgcgtgatttgtccgcgtagcacgtgagttgaccgtgcggatccaggtattgatattgattgagtgaggcagagggcctggttgtgaggatattaataccatagcgcgtgagttgtccgcgtagcacgtgagttgaccgtgcgggtccaggtattgataccatagcgcgtgagttgtccgcgtagcacgtgagttgaccgtgcggatccaggtattgatatgatggcacgtgagttgtccgtgcttagcgcttgggctttgggagcccctccggagtctgtacacacccccagtgagcgcagagtgttgagtgttttgagtattgagtgctgagtgcgagtgatgagtgatggagtgacactgctgtgaggttgtatttatttgtgttgttgctgcatttatctgttaaacttctttgtggcatttactgagttatggaatttacctgtttatttctgtttatttttaaattgtgaaaataaataattggactgttttacttagctcgtcactactgctcagttccttagttatttctgttactactgagtggttgtactcatactacaccctgcactttatgtgcagatccaggtgagttagagcgcgatcgttgagttcaggctatctgtggagattgcaaggtagctgctagcgtccgcaggaccttgttactccttttatcatttcttcttttggattgtattgacagttagacagtttcatttcttagttcatagatttagacgctcatgacttagtgacaccccgatgtttggggctcgttttcgtatttctaaattatatttagagttgatttagtttatgagaaattcaaatgttgaaatgttttattaaattcttataatcgatttagtagaaatattttgggaagtaggcttgccttgtaacacgataggcgccatcacgaccatggttagattttgggtcgtgacaccacccttatctcaccgcagcgtttcaacacccagaccttataccaccgcatgcgtatcaatatcacaatatatcacaatttgcacctcaagtgctcaaataatttaacttgccaaaataattcaacaacaatatttttccacaataaagagctcacggctcatgccaaaataaatcatcaataataacaataaagagctcacggtccacaataatattcacaataaagagctcacggctccctcacaatgagtctaaaaatattcaggaataaataatttaggaaaataatatttcaaaatctttactacgttgcttcaatatcaagtttaaaaatgtcaaatacttcatattaataatatttaatttaaagaaaatcaaccttcaaataatgcacagaataaaagaaaccaagtttcaactaaacaggtaaaacaattagtaagaaaagatcaaacaaatttgaagtatatatctcagatcaatgatgaagaatataacaagataaaataatttaataaatgcgcaacagtgatctacacaatttaaaaatataatctttcgcaatttagcccgtgtacacactcgtcacctcgtgcacacgactttcaacatatttcaataatcacatcaataccaatcgtaggggaaatttcccccacacaaggttagacaagtcacttacctcgatttgctccaatttaaccaagtattatgcttttttctcgattttccgactccgatcgactcgtatctagtcataattaattcgatacggtcaacataaattatagtaatcactttcataagaaaatattacattttcattaaaattcgaaattagctcaaaatttgctcatgggcccgacatctcggaatccggcgaaacttataaaatccgacaacccattcaattacgagtccacccataccaattttaccaaaatccaataacaacagccgtgagctctttattgtggaaaaatattattgatgaattattttgacatgagccgtgagctctttattgtctattattgatgatttattttggcaaactattattgatgatttattttggcatgagccgtgagctctttattgtggaaaaatattgttgttgaattattttggcaagttaaattatttgagcacttgaggtgcaaattgtgatatattgtgatattgatacgcatgcggtggtataaggtctgggtgttgaaacgcatgcggtgagataagggtggcttgatacgcgtggctagtagggggaactactagaagtcatgcggtgtgataagggtggctaaaacgcgggatgctatttcgggaaaaaatattttctttaaataaattgtgaaggctcccgcggtgatataaggaaatgagatattgtgaatttatttatgatttgggactacgaggcggtacctcgggagtgcccttgttgatattgatttatggccgtagttgcctttgattattgttgtgattttcataaagttgaaggaaattctgttttgatttccacgagatattatttgcaattatttggtgtcattaaatgtgacatactatttgattcattttcaatgtcattttattttactacattgataaacattttaccatgccattattatattccagtagggcctcacctgacctcgtcactactctaccgaggttaggcttggcacttactgggtaccgctgtggtgtactcatactacgcttctgcacatctttttgtgcagatccaggtacattttaccagcctagacgtcagtgagttacctgcgcacggagacttcgaggtatatctgccagcgtccgcagactccggagtccccttctatcattttatgttgcttccttatattttatttagaccttgacatatagagacattgagaataaattcttagaagcttgtgacttatttctaccgggttttgggagttgaaattgtttgaattgtagtttatttatttcagatatttattattattccgcattgataggcttacctagtcttagagactaggtgccatcacgacatcctacggagggaatttggggtcgtgacaagttggtatcagagcactaggttcataggtgttatgagtcacaagcaggtttagtagagtcttgcggatcggtacggagacgtctgtacttatcttcgagaggctatggaactgttaggaaatattcacttctttgactccttatcgtgcggcattgatttagcttgaaacatatatcttatattcctttgtatccactcgtgtatgacattgcgcactcggtatcagttgtgcgtcgacggttcgtgatgccgcagatggactacgagggagccagagatgctcaaacattgcctcaacgtgtggttccgactgaagatgtgggcgtattgagagatcacctagtgaatcatgtgggggtgcaacggacgttggcgtctggttgatttatacaagctgtgaaggttattattgtggatcatcggacgttgtgacctatgacttcgcgccgagtgggggagtccactaccaatgggtggattgcggggtcatgtattatatcagttttggcctgaaatgtatatatgtggtactgaaaggttccctaaaatttacacatgtttaagacctgagattttgtagaggataaggttgggacttgcggtatgtccgcctccttaataatcctatacttcaataccaaaggagttatagaaacaactctaaatttgtagaaggtctactcagcgtggacgtcactgttgcggattttggggtgcttcggagtaagtacagttgttgacgagattctggactatgtggttcgtgccaagatttgtctgtatggagctctacttttgtgatcgttgtgtataaataggggtaagggttaccccaaagaagaatcaaagagtatgttaagaaatgggtcagctcaacagtgttgagtcagcataacaaaagaagaaatttgccttgggagagataattctccaccagtgttcgtggtaagcctatgaagagggcagaccagccaatgcaacaccgcccacttggctcaggcagtcgtccagcccagtctgcacatcggattactcggggtgctccagtaagttcttttaatgcaccaccgacatgagttcctacaatggttattccagttatctggcacagactcaatatgagcagcctaacccgcaaaagggttgttatgaatacggtgatactaggcacatcatgagaaaaattcccaaacttgggagagacttatttcatcaaagcactcaggctacgtgccccattgcagttactacaccacccacacgaccagttaggggtggaggacagacgggtaaaaggcgtcctagaggtggagacccagccgttgatatatttgttttacggtatggcggaggtcgctacatcagatggtgtcgttacaggtacgacctcgatttaatataaaggaataatttccttaagttgattcggttctcaatatcgaaacgagtcttcctattgtgctccacttatgagtgagcttcataattctataatctacttatgtgtttacccctgttgggagattttatggagataactacgcctatcatttcgtgttggtcactaataagagctgcgaggctaaatgtggctttctgttactcatttcggtaaattttgatgtaaattccgaataattaattgcaaattgtgaattatatgccctaccggtgtggggttcattatgtgttgtgatttggtgtaaccgaaattatttaaaaggagaaaatggaaattttcaattggcacgatgtgcatattacttgtgattcagaactgaggacgagatcctcacatttttatataaattgatatgtttaaaccgggctacgagctgcggtggaagttatataaggacgagatccttgtgaggaaaattcttgtgtttaagttctcccttgtgaaattaaatttgtactatagtactaatagggagtcatgcctgttaggcttatttgaaaattcttatatgaaattctctgtgcatagttgtcaaattcgtgttgtaattattaatttttaacctacgaggtaggtgcccgcctaggtggcgttaaatgtgactcgttaattcgggtaaataattatgaagtcttcatgcctcgcatctagttatcagtattgtgaaggtttgcaacgagatttttgttaacatgaggttaaatgacgattctgtaattgattatgaacaactattaagaccaaattgatccaagagggtgccccatttacagggtcagacgagtgtgagttaagctttcagaagctcaagatcactttgactccgacacaagcgttggtattacttacatattcaaggtcttatactgtgtattgtgacgcgtcgcgtattggtctcggcgcgatgttgatgcaagacggtagggtgattgcctacgcgtccagacagttaaaggtacatgagaagaattatcggtccatgaccttgagttagcagctattgttcatgccttgaaaatttggcggcattatttgtacggtgtccattgtgaggtctacaccgatcaccgaagtctacaacatctgtttaaacagaaggatcttaatttgcggcagagatggttggagttgcttaaggattatgatatcaccattctctatcatcctgggaaggccaatgtagtggccgatgccttgagtcgtaaggcggagagtttgggcagcttagcatatttaccggtagcagagaggcctttggccttggatgttcaggccttggccaaccagtttgtcagattggatgtttcgagccgagtcgagttttggcttgtgtggtttctcagtcttctctttatgatcgtatcagggaacgtcagtatgatgacccccatctgcttgtccttaaggatacagttcagcacggtgatgccaaggaagtcactattggagatgaagatgtattacggatgcagggcaggctatgtgtgcctaatgtagatggttttcgtgaattgattctccaggaggctcacagtttgcggtactccatacatccgggtgctgcgaagatgtagcaagacttgagacaacactattggtggaggcggatgaagaaagacatagtggaatatgtagctcggtgcctaaattgtcacaggtgaaatatgagcatcaacgaccgggtggattgcttcagaagttggaaattccagaatggaaatgggagcggatcactatggatttcgttgttgggctcccacggactcggaggaagttcgatgcagtttgggtgattgtggatagattgaccaagtcagctcatttcattcctgtgattactacttactcttcagagcagctggctcaggtatatattcgcgagattgtcagacttcacggtgtaccggtatctatcatctctgaccggggtacacagtttacctcacggttttggagggcagtacatgagagttgggtactcggtagagttgagtacaacatttcaccctcagacggacgggcagtccgaacgcactattcagatactggaggatatgcttcgtgcgtgtgtgatagattttgggggtgcttgggatcagttcttaccacttgcggagtttgcttacaacaacagttaccagtcaagcattcagatggctccgtatgaggccttgtatggtaggcggtgccggtctccagtgggttggttcgaaccgggcgaggctagactattgggtacagacttggttcaggatgccttggaaaaggttaagttgattcaggatcgacttcgtacagcccaatctagacagaagagttatgcggatcggaaggttcgtgatgttgcattcatggttggtgagcgggtattgctccgggtttcgcctatgaagggtgtgatgaggttcgggaagaagggcaagttgagccctaggtatattgggccttttgagattcttgagagagttggagaggtggcttacagacttgcactaccacctagtctctctgcggttcatccggtattccatgtttctatgcttcggaaatatcacggcgatccgtctcatgtgttagacttcagttcggttcagttggacaaggatctatcttatgttgaggaaccagtggctattttagataggcaggttcgaaagctgaggtcaaagaacattgcttccgtgaaggttcagtggaggggtcatccggtcgaggaggcgacttgggagaccgagcatgatatgcagctgttatccacacttattcaccagctcaggtactttttctaactccgttcgaggacgaacgtttgttttagaggtggagaatgtgatgacccaaaatgtcatctttaaatttaataattaattatgtgatctaagcactatttatcattactcgacttgcgtgtgcagtccgtaaaattttcggaaaagttttcaggtgaaaaatggattaaaatgtgaattagagctttaaaactcaactgagttgactttggtcaacattttgagcaaacggactcggatcagtgttttgacagtttggtaggtccgtatcgtgatttgggacttaggcgtatgcccggaatcaaattccgaggtccctagcccgagatatggaattttgatgaaaaattaaaagtttaagttcaaatagtgaccggatgtcaaattatgtgcaaacgaccccggaatagaattttgatgattccaacagctccgtatggtgattttggacttaggagcgtgatcggaattttatttggaagtccgtagtggaattaggcttgaaatgccgaaagttgaatttttgggaagtttgaccgaggggttgactttttgatatcggggtcgaaatccgattctgaaaatttttataaatccattatgtcatttatgacttgtgtgcaaaatttgaggtcaatcggaattgatttgatatgtttcggcgcaaaatatagaagttggaagatttgaaaactcataattcgattcgatgcgcgattcgtaatttcggcgttgtttggcatggtttgaagcctcaactaagttcatattgtattttgggacatgttggtatatttggttaaggtaccgagggcctcgggtggatttcggaaggttaacggaatgaatttcggacaaaaaggagctgctggaatttttctgctgcagaagctgtttttggacagcaaccggtgcaatcgcagagctgactttggaagcttatatctcgaaatctataaggaatctgaacattttcaaaacatgaaagttgtagccctttgattctagtttccagaatgataaaccatttatcattcagacatttatacaaaatgttatgatcgattgactgaagctgtactgcagatttttgctacagcagtgtgcatcgccagaaaaccccaaaaacactatcccggtcgctaaaagtccaatcccgtcactaaaagtgtcacatctggtcgctaaaggtgcacaccaggactatttataccaacagttttatttcactaaaaatgctctaactccatcatacgaactcggaattcgacgattcttgttcctattagtcacaaataaaactacgaacccattcgttcaatcgaaactcaatttggagctcatttgctcaatgtgataccaattttgctcgttaaacaattaactcatatttcgcgcttaaaactcaatcgcgacttgatgaaattagaccaaacttttcagatcactcctataattcattatcaaaatgtcaaaagtctcgaaatcgaatttcgatctctagaactaaaaatgaacttttggatcattacatgcttatgttgaaaacatcaaactcttcctcgacagcctgtagtgtatcaatcataacttcttgtactcaactccaacttccaaacggtttaaagttctgcaaactagatacaatgtactacaactttcatgtttttctcatctcccaacttcttatagattgcgagatataagctcccaaagtcagccctgtgcagcagaatgataaatggtttatcattctggaaactagaatcaaagggctacaacttttatgtttcgaaaatgttcagattccttatagatttcgagatataagcttccaaagtcagctctgcgattgcaccggttgctgtccaaaaatagcttctgcagcagaaaaattccagcagctcctttttgtccgaaattcattccgttaaccttccgaaatccacccgaggccctcggaccttaaccaaatataccaacatgtcccaaaatacaatatgaacttagttgaggcttcaaaccatgccaaacaacgccgaaattacgaatcgcgcatcgaatcgaattatgagttttcaaatcttccaacttctatattttgcgccgaaacatatcaaatcaattccgattgacctcaaattttgcacacaagtcataaatgacataatggatttatgaaaattttcagaatcggatttcgaccccgatatcaaaaagtcaacccctcggtcaaacttcccaaaaattcaactttcggcatttcaagcctaattctactacggacttccaaataaaattccgatcacgctcctaagtccaaaatcaccatacggagctgttggaatcatcaaaattctattccggggtcgtttgcacataatttgacatccggtcactatttgaacttaaacttttaatttttcatcaaaattccatatctcgggctagggacctcggaatttgattccgggcatacacctaagtcccaaatcatgatacagacctaccaaaattttcaaaacactgatctaagtttgtttgctcaaactgttgaccaaagtcaactcagttgagttttaaagctctaattcacattttaattcatttttcacctgaaaactttnnnnnnnnnnnnnnnnnnnnnnnnaaatagttcttagatcacataattaatcattaaatttaaagatgacattttgggtcatcacaagctcgatcagatatacactaatatttttatcgatcccgaccatgacgtatgtaatgctcgatcatcttatgcgtctttatagtccccgactttatcgaggatacccgaattttttcttcccttttgggaattgccagttaccttcggtgcttggtgaccggagaagatcaatcagtgatgaatacggtagggcccgcctgtcttttcaacgaggcccaacatgctttgaatcgggtaacttctgatggcgttttcgctgcttcttttacacagagttttaggtaattctaatgtttctccttttgtttgcaggcttcgatgttacatcacgaggcttttctccgaattagggaggagcatgaggagatggctgaacaagtattctgaatattccatgatagtgaagatgaaaaagagataactactaacgatccgattctgtaggttcggcagaggatcgagcaggtcggacggtttaattcacaggtagatgtgctgctggccgaggcagaagaatttaaaaggtgtatggataaccttgcctcgaaaaaaggaagccatcgaagctcagttggagctgtccgatgcccaattttgatctgcgaaagaaaatgctttggggttgatcgaaaagatgaaagagcttcagcatcggttggatttggccactttagataaagcagattttgccaaagaactcgaagtggccagatctgaagtggtcgaggccaacagatgagccgatgccaaagtggctcagttcaggatcgatgtcgaagttaatcaagccaaatcagtgggcatggtcgaacatgcaaagtggcaggcttggagagaggctctcgaaggggtcaaagctcagggcttcgatattggggccgagattgaagtcgcctaggggggaggagaacagagctcggaggttggcctttcctgaggaggactctgatgactcgggggagtctgaagacgaggacgatgccgagaatacggcctccgatgaagattaggtcatttagggccttaggtcgatcgctgcgttcttgtgatactgcttacgatttttgtataaagaacttcctttcggaagagtagccgcctctgtacaaaaaaattgtaaatacaaatctttcttctttttaaagagaaatggcctttcaaactaaatagatagtttgaatttaattctctgttgccttcgggcctcgtgggtagtcccctttgctttatcgggctcgagcgtccttcagcttaaatagtcaagtgtttgttttaattcgaagaaatgagtagttttgctcgaaataatgtagcccataggcgtaatagtcgagcgagtgattgctcgaactcgaaataaaggtagcccgtaggcttagcagtcgagtgaataattcaaactcgatgcagtgtagcctgtaggcataatagtcaagtagcccgtaggcttaatggtcgagtgagtgattgctcgaactcgaaataaaggtagaccgtaggcttggcagtcgagcgaatgattcaaactcgatgcaatgtagcccgtaggcttaatggttgagtgactgattgctcgaactcgaaataaaggtagcatgtaggcttggcagtcgagcgaatgatttgaactcgatgcaatgtagtccgtaggcgtaatagtcaaagtagcccgtaggcttaatggtcgagtgagtgattgcttgaactcgaaataaagatagcccgtaggcttggcagtcgagcaaatgattcgagctcgatgtgatgtagccggtaggcgtaatagtcaaagtagcccgtaggcttaatggtcgagtgagtgattgctcgaactcgaaataaatgtagctcgtaggcttgacagtcaagcaaatgatttgatctcgatgcgatgtagcccgtaggcataatagttaaagtagctcgtaggcttaatggtcgagtgagtgaatgctcgaactcgaaataaaggtagcccgtaggcttggcagtcgaacgaatgattcgaaatcgatgcaatgtagcccgtaggcgtaatagtcgaagtagcccgtaggcttaatggtcgagtgagtgattgctcgaactcgaaataaaggtagcccgtaggcttggcagtcgagcgaatgattcgaactcgatgcaatatagcccgtaggcgtaatagtcaaagtagcccgtaggcttaatggtcgagcgaatgattcgaactcgatgcaatgtagcccgtaggtgtaatagtcgaagtagcccgtaggcttaatggtcaagtgagtgattgctcaaactcgaaataaaggtagcccgtaggcttggcagttgagcgaatgattcgaactcgatacaatgtagcctgtaggcataatagtcaaagtagcccgtagatttggcagtcgagcgaatgattcgaactcgatgcaatgtagcccgtaggcgtaatagtcaaagtagcccgtaggcttaatggtcgagtgagtgattgcttgaactcgaaataaaggtagcccgtaggcttggcagtcgagcgaatgattcaaactcgatcatgtttgcataataaatcttgaacatagaatatcggtaaagaagagagctttctttgcaagtcattatacatgggttcatgttttgcgtcaaggctcgggtcaactatataagcatggttcgttttgaccatttggcccttacgacgtttcgcgttgagacactgtttgtcatgaaataacgaagtaacttcctttgcaccgaacttgataatcatcacagatgcgttcaatgataaagccccctgtacgaggttgattttaaagaggcctcggatactcagcagtagtatcgtttccgctatatggctggtatcgatctctggtcgacttttgctttttcgtaacggacctagaaatcaactggtcatcttcgactcttattttggattgatatcgattgtgcacatcggtccaagtaatagctgggtactcgatcagattttgcttcagccgccgtgaagccatcgagctccgctcgtttagaccttgagtgaaagcttgaacagcccaatcgtctgtgactggtggcagatccattcgttccatttgaaaacgagctacgaactcccttagcatctcgttatccttttgtattaccttgaacagtccgactttctggtttcgacctttatggctccggcatgtgcttttacgaagcaatctgcaagcatagcaaaagaatcaatagagttagatggtaaattatgataccatattgcccctttgacagggtttcaccgaattccttgatggcacacgtgtaagaagtgacgtgctcgttggggtcggtcgttccgttatatttgggtatttcgggcatacggaattttttggggattggttttggggctgcactcgagggaaaaggcttttgaatgaattttttcgaatctagcccttttatcattggtggagctcccgggatctgatcgaccctggaattatatgtttctacttttttatcgttggcttcgactcgttttgtgagttcctcgagcaatttagtaatttcgggagtagtccccgattcttgctcatttgacttcactatggctggttccgttctgtgggtgatttctcgaagcggattgggctccggcctgctttgtacctgagtttggctctgcaactgagctatcgctatttgctgggcttgtaacatctcgaagatcatccgtaagctgactccgatctcctccacgttatgggtgtctcgagctacggatcgagtaccgccctgaatgcttctttccggttcggaacgctgattcgcctctagagctatttgtgaattgacatccaatggtacttcggctcgaatttcgggtgcttcgattcgagcctcagtgccttcatcgagtggccttccggccccgggtgccaagttgttggtttcatcttgaaggccggcttcgtggtcgataggtaagccattgctgatttgaagttgtaaactggtgtgtactttagatttatatcaaacaatcactgttacccttagccccacggtgggcgccaaactgtttacccgaaaaatcggataacgttagatttgtgtatggttctaaggatatgcgatacaatttgatataaatcgtgtagagaaatagaaatatgtgtattcttgactatgagaatgaaaatagtgagcaaaaagaataagataaagtaaaacaagcacaaggggatatctttcaatatgagaagtgatcttttgttacccccttgcttacaatccatccctctttatagtagagggatcctactttatatacaataaaaaatacgtagtggagagcccatgatgtattgtcttttcctcgatttccgccaagattctctcccatagtgcggttgcaacggcccttgtctgcgagctcgatactggctcgagctcggtattggatcgagccctcggccttggtccgagctcgattctgacttggggtctcgatattcggggtgagtgttggtcggtccatgcatcttcgataatctccgctttgcctcgtagttcgatttggatatgagctcgataatgatatcgagcttgtcattgatcggtcttagagctcgaagctcgccgcccttacttcggacctcgaccgagcttgtcatgcagatatcctttgatcgaaacattatcgtctcgaccagtccgtacgactgactcaaatcggttttgaccgtacacagatagtcccctcgtttctcggaaaaggatgtggcgagaaacgatatgatttcccaacagctcgatcagatatatactgacgttttcatcgatcccgaccatgacgtatgtgatagctgtcccatcggttcggttttaccaaggcatttaatgtgtcagacggtggtcggccacctctgatattgaaccgtcattgcttcaatctataaatagcctttccttccaccattcatcacttttacgtcttcaatcttccaaattttcaagttccttttcgttttctgagttttctgcctgtaaatctgtgagttttactgcaaactcttccttaaacaccaaatacttccgttctttgttcacgaaattttaaatggcaaaaacgtctaaaactgttccgcaaaaagagaccgcttcttcatctcgacctgctggtggcgaggatgtggaagagccccgccctgaggaattcgttccggtagggtgttcgactgtaggcgattttaaaattgaaaagccttctccgataccgggtcggtgtgagccgatgtcgaggtaccaatgttcaattaccgaaaaagttctcgataaagtcatacaagaatgcaactgggataataaactcgtagtaatcccatcgcccgatgaatcaattactacccacgtcgaagggttcttaagtgtttatacttatcctttcacgttgggacccttagaccctgtcatcgttgccttttgtaagaggtacgatgtgaccctcggccaaatccacccttccttttggaggatagtgattcttcttcgatttttctcgagcaaggtcgaggggcgtatcttcaccctcgatcatcttatgcgcctttacagtccccgactttatcgaggagggttgatcaagcttgctcgccgagcaaccaaagcgccattctcgagcatagacgagacccgggatcggggttggatgggccgttttgttcgaatcaaaacctcggacctgatccctgccgatgacttgccatttcccgagaaatggaatatgagccgtgagtaaacgtttctctttgcccgttttgattttgtgattgcctttctattttgttgatccatttttctttccttatcacagccgtagctcgaatgccggaaccgatcccggatcttagacaatgggtcgaaagcctggtgttgcagagaccgtactccgagcgtgcttgggtcgaattatcaaagggtcgatgggaggcccgcagtcatggtaaatctttttgtcgatttgtctcttcatcggtttgtatggtaaatctccctcttcccttttgtaggactcgggaaagatgtagtcatgaggccccatctggtggcgaagaagttcctgtcctgaagcaggtaaaagaaaggaagagaaaagacgtatcgggctccccgagctcggaaaagaagaaaccggctaagagatctcgaaagccgaaggggggctctggtgttatgtcttcggaagtggtccgccatttaagggacgagcccgaagaaggagaggagaatttagcctgcgtacgggctaatgttgtgattcaacagtcttccaatttggtggaagcaaatcagggaaccttggccataatcccagaacaagaagaagccgagattatcccttctcgagctaagatgattgaaagggataccgagggtggatcttctcgggcagtagaagatatttcaagggatgagttcgggatagttgacattggcggatcccctcagatttcggatgccatgattcgagaggccgtcatgttggaggatcggtcctatgagggtattcaggagtcggccgatatccatggttttctggaggggctcgagtcaggtgcctcggaggaggttaccggttttggtggaatgccggtacccaaaaaagcatcgtggtcgggttctaccgagccttcatcgattcataaactggtggaccgatttccggccccgagtatcgatcccgaccgaaggcggaagatagtgctctccgtacctgcggatacccgaattttttcttcccctgtggggattgccagttaccttcggtccttggtgaccgaagaagatcaatcagtgatgaatgcggtggggcccgcctgtctcttcaacgaggcccaacatgctttgaatcgggtaactctgatggcgtttttgccgcttcttttacacagagttgtaggtaattctaatgtttctccttttgtttgcaggcttcggtgttgcatcacgaggcctttcttcgaatccgggaggagcatgatgccgaggttcggagcctcactgagaagagtgactcgtacaagctccttagtgaaaaacttcgagcagatttgacagcggctcgggaagagcatgaggagatggctgagcaggtattccgaatgttccatgatagtgaagatgaaaaagagataaccactaacgatccgattctgcaggttcggcagaggatcgagcagattggacggcttaactcacaggtagatgcgctactggccgaggcagaagaatttaaaaagtgtatggatatccttgcctcgaaaaaggaagccgtcgaagctcagttggagctgtctgatgcccaacttcgatctgcgaaagaaaatgctttggggctgatcgaaaagatgaaagagcttcagcatcggttggatttggccactttagataaagcagatttggccaaagaacttgaagtggccagatctgaagtgatcgaggccaataaaagagccgatgccaaagtggctcagttcaggatcgatgtcgaggttaaccaagccaaagctgagagcatggtcgaacatgcaaagtgcaagctcggagagaggctctcgaggaggtcagagctcagggcttcgatgttggggccgagattgaagtcgccagggcggaggagaacaaagctcggaggttggcctttcctgaggaggactccgatgactcgggggagtctgaagatgaggacgatgccgagaatacggcctccgatgaagattgagtcatttagggccttaggtcgatcgctgcgttcttttgataccgctttcggtttttgtataaagaacttccttttggagagtagccgcctctgtacaaaaaatttgtaaatataaatctttcttctttttgaagaaaatagcctttcaaactaaatagatagtttgaatttaaatctctgttgccttcgggccttgtgggtagttttgctcgaaatcggtcccgtaggcttagtagtcgagtgaatgattcgaactcgatgcaatgtagcccgtaggcgtaatggtcgagtgagtgcttgctcgaactcgaaataaaagtagcccgtaggcttagtagtcgagtgaatgattcaaactcgaaataatgtagcccgtaggtaataaagtagcccgtaggcttaatggtcgagtgagtgcttgctcgaactcgaaataaaagtagcccgtaggcttagcagtcgagtgaatgattcgaactcgatgcaatgtagcccgtaggcataataggtcgagtgagtgcttgctcgaactcgaaataaaagtagcccgtaggcttagtagtcgagtgaatgattcgaactcgaaataatgtagcccgtaggcataatggtcgagtgagtgcttgctcgaactcgaaataaaagtagcccgtaggcttagtagtcgagtgaatgattcgaactcgaaatgtagcccgtaggctaatgtcgagtgagtgcttgctcgaactcgaaataaaagtagcccgtaggcttagcagtcgagtgaatgattcgaactcgatgcaatgtagcccgtaggcgtaatgtcgagtgagtgcttgctcgaactcgaaataaaagtagcccgtaggcttagtagtcgatgaatgattcgaactcgatccatcagatcctgtttgcataataaatcttgaacatagaatatcggtaaagaagagggctttctttgcaagtcattatacatgtgttcatgttttgcgtcagggctcgggccaactacataagcatggttcgttttgaccatttggctcttacaacgtttcctgttgagacactgtttgtcatgaaataacgaagtaacttcctttgcaccgaacttgataatcatcacagatgcgttcaatgataaagccccccagtatacgaggttgattttaaagaggcctcagatactcagcagtagtatcgtttccgctatatggctggtatcgatctcttattgacttttgctttttcgtaatgaacctagaagtcaactggtcatcttcgactcttattttggattgatatcgattgtgcacatcggtccaagtaatagctgggtactcaatcatattttgcttcagccgccgtgaagccctcgagctccgctcatttagaccttgagtgaaagcttgaacaacccaatcgtctgtgactggtggcagatccattcgttccatttgaaaacgagctacgaactcccttagcatctcgttatccttttgtattaccttgaacagtccgactttctggtttcgacctttatggctccggcatgtgcttttacgaagcaatctgcaagcatagcaaaagaatcaatagagttagatggtaaattatgataccatattgcccctttgacagggtttcaccgaattccttgatggcacacgtgtaagaagtgacgtgctcgttggggtcggtcgttccgttatatttgggtatttcgggcatacggaattttttggggattggttttggggctgcactcgagggaaaaggcttttgaatgaattttttcgaatctagcccttttatcattggtggagctcccgggatctgatcgaccctggaattatatgtttctacttttttatcgttggcttcgactcgttttgtgagttcctcgagcaatttagtaatttcgggagtagtccccgattcttgctcatttgacttcactatggctggttccgttctgtgggtgatttctcgaagcggattgggctccggcctgctttgtacctgagtttggctctgcaactgagctatcgctatttgctgggcttgtaacatctcgaagatcatccgtaagctgactccgatctcctccacgttatgggtgtctcgagctacggatcgagtaccgccctgaatgcttctttccggttcggaacgctgattcgcctctagagctatttgtgaattgacatccaatggtacttcggctcgaatttcgggtgcttcgattcgagcctcagtgccttcatcgagtggccttccggccccgggtgccaagttgttggtttcatcttgaaggccggcttcgtggtcgataggtaagccattgctgatttgaagttgtaaactggtgtgtactttagatttatatcaaacaatcactgttacccttagccccacggtgggcgccaaactgtttacccgaaaaatcggataacgttagatttgtgtatggttctaaggatatgcgatacaatttgatataaatcgtgtagagaaatagaaatatgtgtattcttgactatgagaatgaaaatagtgagcaaaaagaataagataaagtaaaacaagcacaaggggatatctttcaatatgagaagtgatcttttgttacccccttgcttacaatccatccctctttatagtagagggatcctactttatatacaataaaaaatacgtagtggagagcccatgatgtattgtcttttcctcgatttccgccaagattctctcccatagtgcggttgcaacggcccttgtctgcgagctcgatactggctcgagctcggtattggatcgagccctcggccttggtccgagctcgattctgacttggggtctcgatattcggggtgagtgttggtcggtccatgcatcttcgataatctccgctttgcctcgtagttcgatttggatatgagctcgataatgatatcgagcttgtcattgatcggtcttagagctcgaagctcgccgcccttacttcggacctcgaccgagcttgtcatgcagatatcctttgatcgaaacattatcgtctcgaccagtccgtacgactgactcaaatcggttttgaccgtacacagatagtcccctcgtttctcggaaaaggatgtggcgagaaacgatatgatttcccaacagctcgatcagatatatactgacgttttcatcgatcccgaccatgacgtatgtgatagctgtcccatcggttcggttttaccaaggcatttaatgtgtcagacggtggtcggccacctctgatattgaaccgtcattgcttcaatctataaatagcctttccttccaccattcatcacttttacgtcttcaatcttccaaattttcaagttccttttcgttttctgagttttctgcctgtaaatctgtgagttttactgcaaactcttccttaaacaccaaatacttccgttctttgttcacgaaattttaaatggcaaaaacgtctaaaactgttccgcaaaaagagaccgcttcttcatctcgacctgctggtggcgaggatgtggaagagccccgccctgaggaattcgttccggtagggtgttcgactgtaggcgattttaaaattgaaaagccttctccgataccgggtcggtgtgagccgatgtcgaggtaccaatgttcaattaccgaaaaagttctcgataaagtcatacaagaatgcaactgggataataaactcgtagtaatcccatcgcccgatgaatcaattactacccacgtcgaagggttcttaagtgtttatacttatcctttcacgttgggacccttagaccctgtcatcgttgccttttgtaagaggtacgatgtgaccctcggccaaatccacccttccttttggaggatagtgattcttcttcgatttttctcgagcaaggtcgaggggcgtatcttcaccctcgatcatcttatgcgcctttacagtccccgactttatcgaggagggttgatcaagcttgctcgccgagcaaccaaagcgccattctcgagcatagacgagacccgggatcggggttggatgggccgttttgttcgaatcaaaacctcggacctgatccctgccgatgacttgccatttcccgagaaatggaatatgagccgtgagtaaacgtttctctttgcccgttttgattttgtgattgcctttctattttgttgatccatttttctttccttatcacagccgtagctcgaatgccggaaccgatcccggatcttagacaatgggtcgaaagcctggtgttgcagagaccgtactccgagcgtgcttgggtcgaattatcaaagggtcgatgggaggcccgcagtcatggtaaatctttttgtcgatttgtctcttcatcggtttgtatggtaaatctccctcttcccttttgtaggactcgggaaagatgtagtcatgaggccccatctggtggcgaagaagttcctgtcctgaagcaggtaaaagaaaggaagagaaaagacgtatcgggctccccgagctcggaaaagaagaaaccggctaagagatctcgaaagccgaaggggggctctggtgttatgtcttcggaagtggtccgccatttaagggacgagcccgaagaaggagaggagaatttagcctgcgtacgggctaatgttgtgattcaacagtcttccaatttggtggaagcaaatcagggaaccttggccataatcccagaacaagaagaagccgagattatcccttctcgagctaagatgattgaaagggataccgagggtggatcttctcgggcagtagaagatatttcaagggatgagttcgggatagttgacattggcggatcccctcagatttcggatgccatgattcgagaggccgtcatgttggaggatcggtcctatgagggtattcaggagtcggccgatatccatggttttctggaggggctcgagtcaggtgcctcggaggaggttaccggttttggtggaatgccggtacccaaaaaagcatcgtggtcgggttctaccgagccttcatcgattcataaactggtggaccgatttccggccccgagtatcgatcccgaccgaaggcggaagatagtgctctccgtacctgcggatacccgaattttttcttcccctgtggggattgccagttaccttcggtccttggtgaccgaagaagatcaatcagtgatgaatgcggtggggcccgcctgtctcttcaacgaggcccaacatgctttgaatcgggtaactctgatggcgtttttgccgcttcttttacacagagttgtaggtaattctaatgtttctccttttgtttgcaggcttcggtgttgcatcacgaggcctttcttcgaatccgggaggagcatgatgccgaggttcggagcctcactgagaagagtgactcgtacaagctccttagtgaaaaacttcgagcagatttgacagcggctcgggaagagcatgaggagatggctgagcaggtattccgaatgttccatgatagtgaagatgaaaaagagataaccactaacgatccgattctgcaggttcggcagaggatcgagcagattggacggcttaactcacaggtagatgcgctactggccgaggcagaagaatttaaaaagtgtatggatatccttgcctcgaaaaaggaagccgtcgaagctcagttggagctgtctgatgcccaacttcgatctgcgaaagaaaatgctttggggctgatcgaaaagatgaaagagcttcagcatcggttggatttggccactttagataaagcagatttggccaaagaacttgaagtggccagatctgaagtgatcgaggccaataaaagagccgatgccaaagtggctcagttcaggatcgatgtcgaggttaaccaagccaaagctgagagcatggtcgaacatgcaaagtgcaagctcggagagaggctctcgaggaggtcagagctcagggcttcgatgttggggccgagattgaagtcgccagggcggaggagaacaaagctcggaggttggcctttcctgaggaggactccgatgactcgggggagtctgaagatgaggacgatgccgagaatacggcctccgatgaagattgagtcatttagggccttaggtcgatcgctgcgttcttttgataccgctttcggtttttgtataaagaacttccttttggagagtagccgcctctgtacaaaaaatttgtaaatataaatctttcttctttttgaagaaaatagcctttcaaactaaatagatagtttgaatttaaatctctgttgccttcgggccttgtgggtagttttgctcgaaatcggtcccgtaggcttagtagtcgagtgaatgattcgaactcgatgcaatgtagcccgtaggcgtaatggtcgagtgagtgcttgctcgaactcgaaataaaagtagcccgtaggcttagtagtcgagtgaatgattcaaactcgaaataatgtagcccgtaggtaataaagtagcccgtaggcttaatggtcgagtgagtgcttgctcgaactcgaaataaaagtagcccgtaggcttagcagtcgagtgaatgattcgaactcgatgcaatgtagcccgtaggcataataggtcgagtgagtgcttgctcgaactcgaaataaaagtagcccgtaggcttagtagtcgagtgaatgattcgaactcgaaataatgtagcccgtaggcataatggtcgagtgagtgcttgctcgaactcgaaataaaagtagcccgtaggcttagtagtcgagtgaatgattcgaactcgaaatgtagcccgtaggctaatgtcgagtgagtgcttgctcgaactcgaaataaaagtagcccgtaggcttagcagtcgagtgaatgattcgaactcgatgcaatgtagcccgtaggcgtaatgtcgagtgagtgcttgctcgaactcgaaataaaagtagcccgtaggcttagtagtcgatgaatgattcgaactcgatccatcagatcctgtttgcataataaatcttgaacatagaatatcggtaaagaagagggctttctttgcaagtcattatacatgtgttcatgttttgcgtcagggctcgggccaactacataagcatggttcgttttgaccatttggctcttacaacgtttcctgttgagacactgtttgtcatgaaataacgaagtaacttcctttgcaccgaacttgataatcatcacagatgcgttcaatgataaagccccccagtatacgaggttgattttaaagaggcctcggatactcagcagtagtatcgtttccgctatatggctggtatcgatctctggtcgacttttgctttttcgtaacggacctagaaatcaactggtcatcttcgactcttattttggattgatatcgattgtgcacatcggtccaagtaatagctgggtactcgatcagattttgcttcagccgccgtgaagccatcgagctccgctcgtttagaccttgagtgaaagcttgaacagcccaatcgtctgtgactggtggcagatccattcgttccatttgaaaacgagctacgaactcccttagaatctcgttatccttttgtattaccttgaacaggtccgactttctggtttcgacctttatggctccggcatgtgcttttacgaagcaatgtgcaggcatagcaaaagaatcaatggagttagatggtaaattatgataccatatcattgtcccctttgatagggtttcaccgaattttttcaataatacagattcgatctcatcgtcttccaaatcattgcccttaatggcacacgtgtaagaagtgacgtgctcgttggggtcggtcgttccgttatatttgggtatttcgggcatacgaaattttttggggattggttttggggctacattcgagggaaaaggcttttgaatgaatttttttgaatctagaccttttatcattggtggagctcccgggatctggttgaccctggaattatatgtttctatttttttatcgttggcttcgactcgttttgtgagttcctcgagcaatttagtaatttcgggagtagtccccgattcttgctcgtttgacttcactatggctagttccgttatgtgggttacttctcgaagcggattgggctccggcttgctttgtacctgagtttggctctgcaactgagctatcgctatttgctgggcttgtaacatctcaaagatcatccgtaagctgactccgatctcgtccacgttatgggtgtctcgagctacggatcgagtaccacactgaatgcttctttccggttcagaacgctgattcgcccctatagctatttgtgaattgacatccaatggtacttcggctcgaattttgggtgcttcgattcgagcctcagtgccatcatcgagtggccttctagccccgggtgccaagttgctggtttcatcttgaaggtcggcttcatggtcgataggtgaagccattgctgatttgaagttgcaaactggcgtgtactttagatttatatcaaatgatcactgttacccttagccccacggtgggcaccaaactgtttaccggaaaaatcggataacgttagatttgtgtatggttctaaggatatgcgatacaattcaatataaatcgtgtagagaaatggaaatatgtgtattgttgactgtgaggatgaaaataataagcaaaaagaatgaataagtaaaacaagcacaaggggataactatcaatataagaagtgatcttcttttttcggggtccatagcttacaaggattcccccttttatagaagaggatcattacaaaaaataataaaataaaacatatagtggatggcccatgatgacttgtctcttccttgattcctgccaagattctctctcttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtctgtgagctcgatactagctcgaactcgtaacttggtcgggccctacggtattggatcgagttcgaccttcgagatgggcgtcgcgcatttccgacctcgaagcagtgccttgcggatcgattaggtcacatgctcgataggattatcgagccgcctcctcgagtgaccttcgggctcgaggtttgttagtaccgacctcagagctcactcccaaatctcattctgactttttaacgttcgaactcgatcgaacgtagaaaggccgaaatctatttcgaccgtatacaatatagttgtttactcacttttcaagaaggaaatataatattcattacatataatagattatcagttcacattatttatttctcttgaaattttacaataatgaatgttaaaagcacaatatgcgggtgtttgaaatgtaatcttcgtggaagttcctaccaacatatcaagaaaaaaaaaactgaaaatgtataagtagcagtagggtttcaaacattccattnnnnnnnnnnnnnnnnnnnnnnnnnnnnnnnnnnnnnnnnnnnnnnnnnnnnnnnnnnnnnnnnnnattttgttagtgaaagtgcaacaaattaaactagtcatccaaatattatagggaaaagaaaatgaatccagctgatgaaaccttatctttctctgaccttgatttccttgaatctatcaagcagaaccttttgaatgatccaattttttttgagaatttttcaaatgacgcggcattgtctaatagccctagctcaagttcagtagaaaacagctttaacacctccctttgtgatgaaaactgtgaaaagtccgagtccgaggaggaaagaaaggggcctatggaggcgcgtgagaaaaatgtgccgcaagattggaggcgctacataggagtgaggcggcggcaataggggacatttacggcggacataagagatccgaataggagaggcgcgagactgtggctaggaacgtatgagagtccggaggatgcagcattagcttatgaccaagctgcttttgagattcgcggctcgaaagcacggctcaattttccgcacttaattggctcgaacataactaagccggctagggttacagcgaggtgtcgtatgcgctcaccggagtgtcacgacccaaaatcccaccacaggagtcgtgatggcacctagtctctaagattaggtaagccgatttccattgcatttttttgaagccatttttttaaaataaataaataatcaaaactaacagcgaaaataattataatatacaacctcccaagacatgtagtactgagtcacgaactctaattgaagacatagaatgatcacgaggaccgaatatacaatactgtttgattacaaattaacagtacaatgaaatgaaaagactccaagggactgcgacaaccaagcagctctaccttgaatccttacgatcccgctttaactctgctcaagtccgttattttcaatacctggctctgcacaaaaatgtgcagaagtgtagagtgagcacaccacagcggtgcccagtaagtatcaagactaacctcaatggagtagagacgaggtacactcaagacactcactagtctaataacttatgcaatataatatacaaaataatagaaaacaaataatcataaaggcaggataaaacaaccagtgatatgcacaacagacaacaagaataccattaattcttccagataactctctttcaaatataatttttctcaaataattatttttcaaatataattctttcaataaatcttttcaaatacaatttcctcaaataaatatctttcaaaatacaattcttttatataatactttctaagtaaaaatccttccaaataaatattttgaatataattctttcaattaaaaagtcaccatgtgatacctcatttcaaaatcatcaaaatacgggtctcagcccattttcatatttttcgtaaatacgggtctcagcccatttttatatttcaacggcacctcgtgcccataattaaatcatcatatctgcccgacacctcgtgtcctcgtttcatgtcaaactgcacggataattcacgtgccaaatatcattatcattttatcacagcacctcgtgccgacattttatatcaaaactgtacggacaattcacatgccaatatccccatttcatatcataattcacggcaccttgtgcccacattttattttataaaccgcctggcaatagccacaggctcccaatttcaacataaatcaaattattattaatttactaacaacaagacaagttgcacaaggtataaaaataaacacaagaaaatcacaacatcacatgaaaattgtcaacaccacaacccacatcatcacatatcgtccctgacaatagccaccttatcaattgccacccttatcgctcctattgccacccttatcgctcataggcacccttatcgctccgcccagacaataccaatagccacccttatcgctcctattgccaaccttatcactcctatagccacccttatcgctccgcccagacaatattctaacaaacacaacagtgaaatgctactcttataaccacataatatcaacggtgaaatgccacccttatggccccaaaataacaaccaatttacacgaaaaattatcacagcaacataataaaatctattcttatcacaatttgtccaatggccacaaccaaatttcaaagatatgacaaaatcaattaatttcacaacaaatagcccaaggctccacacaatgtatataacacccaaaaataatcaatggagatagaaattactcaacataaagcaaagtcttcattaaattcaaatttttaataattatataaacacctcttcttaagctcatttaattaattatttgtagaggaaaattcatattggaattaattttcaagaaatattaaaccaacaatactcacgaaagttcataaatatttcaaataacaatcacatcaaattatcatataaaaacaaattcaacaataaggatttaggcatggcaaatagatgatttaataatttttcataatttcctaatttactacacaaaaatgcctaagactttaattcaatgaatttttgcacgtataatcccgagtacgtactagtcacctcgcgtacacggcttttcacaattcacaaatggcacataagactcaatgcctaaggggtaattcccccactcgaggttaagcaagacacttaactttttgaagttaagccgatattccaaaatagccttcttgcttgaattgaccttcggacagctcaaatctacccaaattatttgtataacttcattaaaattaatcggaaacaattccggataataatgcgtagacataaaattttatttcaaagagtcaacaaaagtcgacgcggggcccgcccctcggaacctgacaaaactttcatgaaatccgaacacccattccgatacgagttcaaccataccaattttatcgaattccaataacaactcgacctccaaatctaaaattttcgttttcaaatccctaagttcaaacctccgatttatacctcaaaaccatgtaatctaatctgattattcgatgataatttaatattatggagtagaaatgatcacaagggacttacctcaagttttcccgtgaagaccttgctcaaaaatcgcccaacccgagcttgaaatgcccaaaaatggctaaagcttggaacccctctgtttttgtattgcccaggggttttcgcatccacggtaatttcttcgcacctgcggcttcgcacttgcggtaaaggtttcgcacccgcagctttcgcatccgcggcaaaattttcgcatccgcgacaaagtattcgcacccgcggtgcctggccagcctatgaattttccgcgactcatttctcgcatccgcgagctcgcacctgcggtcctttttcgcgcaggtgcgatcacaccagcaacccagctgctttagctcctcctccaaatccaaattcgatccgttaagcatccgaaactcacctgagaccctcgggaccccgtccgaacatacaacaaattccataacataacatggatctactcgaggcctcaaatcatatcaaacaacatcaaaacgacgaatcgcacctcaaatcaaaatttatgaactttgaactttcaaattctatatcttgtgccgaaacatatcaaatcaatccggaatgacttcaaattttgcacacaagtcataaatgacataacagacctattcaaatttccataatcggattccgatctcgatatcaaaatgtcaacccccggtcaaacttcccaaaaatttaactttcgatatttcaagcttaattccactacagacctccaaataatttttccgacacgctgttaagtccaaaatcaccatacggaactattaacatcatcaaaattccatttcggagtcgttttctcaaaagtcaattctccggtcaactctttccatttaagcttcaaattaaggattgttcgtttaatttaatttcgaatctttagtaaatcaaaatcgaccacacccgtatgccataatacatattgcgaagcttctcgagaccttaagtcattgaacagggcataaattcttaaaacgacaagtcgggttgttacattcttcacctcttaaacaagcgttcgtcctcgaacatgctaagaatctttctaaggactttaaattactgagtatattcttgcactcgtactagtgagtgattttatattcccgcaatttaacacgggtccgacaacaccatctcaattgagattatttcttttctccattcttataagctttagagcaaaagtccctaactctccattcattttcaaaatacttgtttttcactttgacgcatggtattagtctcaactagctacagcaactcatgcctatgcacacatcaaattttatggggtatttcattcttccccgcttaggatcattcgccctcaaacacacaacataacttatctcttctttcacacatctcaatcccccaaatttttctaactcccaaattatttttttcagaaaatttcggcagagtctcccctgtaattgggcctatccacctgccagagtaacacccaaacaactcctaacaacatatccacaacccaacaaaataccacagggtatatatcaataacattaatctcgacatcacaagcactgcattaccataatgatatcaggacatgaagcacatcatatgtatgcttatcaccacatctctggtcttaaaagttgttcataattaattccagcatcatcaattaatctcatattaaccaccacctcattttgaattttcacaacactaacaacggaatgtgaggcatgaagacctcatgattacttactcggattaatgagtcacatttaacgccacatgggcactcacctcataggctaaaactcaatatttacagcacgaaaatggctgaatatgaacagaaaatatacaagcattatcaaataagcctaaccggtatgtctccctattaatattattgcacaaattaaatttcacaagggagaatattaaactcataaacatttcaccacaaggacctcgtccttatataacttccatcgcggcttgcaggccggtataaatatttcacatcatgtaaaaatgcgaagatctcgtcatcaaatccgaattacaattatgttgcacattatgccaactgaaattttcaatttcctttatttcttcctttcaatacatttcataaataattttcacaacatataatgaactctcataccggtagggcgtataattcataaaaattggaatcaattattctgaaaatcattaaacccactgtaatgaataataaaaattatttttggacttatagccctcaatagtgtacagaaataaaataacagacacggactcacnnnnnnnnnnnnnnnnnnnnnnnnnnnnnnnnnnnnnnnnnnnnnnnnnnnnnnnnnnnnnnnnnnnnnnatctttaaatctcccaacatggataaacatataagtgggtcacaatttttcgaagctcaccataagtggagcataataggaggactcacctcattattcagaactaaatcatattaagaaaaatatccttttataataaaaatcaggatcgtaccttcaacgacaccatcttgtatattggccccagccaaatcatagtgattatatcagtgggtcgggtctacacctcttaggcgcccactacccgcatgtcctccacctctagctgactgtgcacgtggagtatcaactggaataaagcttgtagctggagtgttctgatgaaatccacccctcccaagtctgggataatctctcatgatatgcctagtatcaccacactcataacaacccctatgaggtcgcggttgcttgtactgagcctgtgccggataactggaataaccactgtaagaatctcgtgtcggtggtgcactataaattggagcaccccgagtaatctgatgtgtggactgacctgactgactgctcgagcctccgctataatgggttctagctgaagagtaaaacccactgaaccctccagatcttcgagaccttttggcctccttagacttcctttcctctcctaaaacaccctcaatcttccttgcaatctccacactagttgaaatagagtatcagtttgcaattctcgagccatgcatattttaatatcataatcgagcccctcaatgaatctacggacccgttctctgattgtaggaaccaagatcggtgcatgacgagctaactcattgaacctgatagcatattctgacactgttatagtgccctgacgcaatcgttcaaactctgtgcgccacgcatctctgagagtctggggaacaaactctttcaagaacatttctgaaaattgagcccaagttggtggtgttgcatcagatggtctaccttcttcatagatttgccaccaccgatacgttgcgcctgacagttgaaatgtagtaaaggtggtgcggagaatacggtgacaattttcttgaaattcttgggcatcctctatagttgtgccactgaaagtaggtggactatacctcttaaacctttcaagtctcttttgttcttcttctgatgactcgggcctgacctcaggctgaaccggaataacaggttataccggtattgcacccggaacctgaccaacgtgaacctgctgctatggaattatggtaggagtctgatctactcccccaatctgcgaaatatttggtgcagcagagatcaatcccgcctgagttaatgtaccaaacatactcatgaactgtgctaaggtctcctaaagtccaggggtaacaacaagtgcttctggtacctgtcccccaactggagctactagtggctcctcaactgttgttctgacaggtgctctagtcgcaggtgcccttcctcgaccctcgcctctacctcggccccggccttttgcagccctaacagtatgtacggatacctgctcagctaacccagtagcacgtgtcctcaccatatgtgagagaatggagatacaaaggttcaaattccaaattcaacaaattccgcacgataagaatgaaagaaatggaaatttcctaacagttttgtaacctctcaaagataagtacagacgtctccgtaccgatccgcaagactctactagactcgttcgtgactcgtagaacctatgaacctagagctctgataccaacttgtcacgacccaaaatcccaccacaggcgtcgtgatggcacctagtctctaagactaggtaagccgatttcaattacattttttgaagccatttttttgaattaaataaataatcaaaactaacagtggaaataattacaatatacaacctccaagactggtagtactgagtcacgaactctaattgaagacatagaatgatcacgaggaccgaatatacaatactatttgattacaaattaacaatacaatgaaataaaaagactccaagggactgcgacaacgaagcagctctaccttgaatccttacgatcccgctttaactctgctcaagtccgttatcttcaatacctggctctgcacaaaaatgtacagaagtgtagagtgagcacaccacaacagtgcccagtaagtatcaagactaacctcaatggagtagagacgaggtacagtcaagacactcactagtctaataacctgtgcaatataatatacaaaataataggaaaataaaaaatcataaaggcaggataaaacaaccagtgatatgcacaacagagaacaagaatactattaatatcactcaataattcataaacacaattacacccaattaaatcaagcccttcaaataaatgtctttcacatagttcttccagataactcactttcaaatacaatttttctcaaataattatttttcaaatataattctttcaataaatcttttcaaatacaatttcctcaaataaatatctttcaaaatataattcttttatataatactttctaaataaaaatctttccaaataaatattttgaatataattctttcaataaatcttttcaaatacaatttcctcaaataaatatctttcaaaatataattcttttatataatactttctaaataaaaatctttccaaataaatattttgaatataattctttcaattaaaaagtcaccatgtgatacctcatttcaaaatcatcaaaatacgggtctcagtccattttcatatttttcgtaaatacgggtctcagcccattttcatatttcaacggcacctcgtgcctataattaaatcatcatatctgcccgacacctcgtgtcctcatttcatgtcacaactgcacagacaattcagtgccaaatatcattatcattttatcatagcacctcgtgccgacgttttatatcaaaacggtaaggaacaattcacgtgccaatatccccatttcatatcacaattcacggcaccttgtgcccacattttattttataaaccgcctgaaaatagccacagactcccaatttcaacataaatcagattattattaatttactaacaacaagacaagttgcacaaggtataaaaataaatacaagaaaatcacaacatcatatgaaaattgtcaacaccacaaccctacatcatcacatatcgtccctgacaatagtcacccttatcgctcctatttccacccttatcgctcctatagccacccttatctctccgcccagacaataccaatagccacccttatcgctattattgccacccttaacgcttctatagccacccttatcgctccgcccagacaatattctaacaaacacaacagcaaaatgccacccttataatcacataatatcaacggtgaaatgccacccttatctccccaaaataacaactcacacaacacaacaatttacatggaaaattatcacaacaacataataaaatcaattcatatcacaatttgcccaatggccacaaccaaattccaaagatatgacaaaatcaattaatttcacaacaaataatccaaggctccacacaatgtatataacacccaaaaacgatcaatggagatagaaattactcaacataaaacaaattcttcattaaattcaaattttcaataattatataaacatctcttcttaagctcatttaattaattatttgcagaggaaaattcatattggaattaatttccaagaaatattaaaccaacaatactcacgaaatttcataaatatttcaagtaacaatcacatcaaattatcatataaaaacaaattcaacaataaggatttaggcatgacaaacatacgatttaataattttccataatttcccaatttactacacaaaaatgcctaagactttaattcaatgaatttttgcacgtataatcccgagtacgtactcgtcacctcgcgattttattatgttgttgtgataattttccgtgtaaattgttgtgttgtgtgagttgttattttggggagataagggtggcatttcaccgttgatattatgtggttataagggtggcatttcactgttgtgtggaatattgtctgggcggagcgataagggtggctataggagcgataagggtgggaatattgtctgggcggagcgataagggtggctataggagcgataagggtggcaataggagcgataagggtggctattgtcagggacgatatgtgatgatgtggggttgtggtgttgacaattttcatgtgatgttgtgattttcttgtgtttatttttataccttgtgcaacttgtcttgttgttagtaaattgataataatctgatttatgttgaaattgggagcctgtggctattgccaggcggtttataaaatgaaatgtgggcacgaggtgccgtgaattgtgatatgaaatggggatattggcacgtgaattgtccgtgcagttgtgatataaaatgtgggcacgaggtgctgtgatgaaatgataatgatatttggcacgtgaattgtccgtgcagttgtgatatgaaatgagggcacgaggtgccgggcaaatatgatgatttaattatgggcacgaggtgccgtgaaatatgaaaatgggctgagacccgtatttacgaaaaatatgaaaatgggctgagacccgtattttgatgattttgaaatgaggtgtcacatggtgactttttaattgaaagaattatattcaaaatatttatttggaaggatttttacttagaaagtattatataaaagaattgtattttgaaagatatttatttgaggaaattgtatttgaaaagattattgaaagaattatatttgaaaaataattatttgagaaaattatatttgaaagagagttatctggaagaactatgtgaaagacatttatttgaagggcttgatttaattgggtgtaattgtgtttattaattgttgagtgatattaatggtattcttgttgtctgttgtgcatatcactggttgttttatcctgcctttattattatttgtttcctattattttgtatattatattgcacaggttattagactagtgagtgtcttgactgtacctcgtctctactccattgaggttagtcttgatacttactgggtaccgctgtggtgtactcatactacacttctgcacatttttgtgcagagccaggtattgaagataacggacttgagcagagttaaagcgggatcgtaaggattcaaggtagagctgcttggtcgtcgcagtcccttggagtcttttcatttcattgtactgttaatttgtaatcaaacagtattgtatattcggtcctcgtgatcattccatgtattcagttagagttcgtgactcagtactaccagtcttgggaggttgtatattgtaattatttcgctgttagtttttgttatttatttaaaaaaaaatggcttcaaaatgtaatgaaatcggcttacctagtcttagagactaggtgccatcacgacgcctgtggtgggattttgggtcgtgacaagttggtatcagagctctaggttcataggttctacgagtcacgaacgagtctagtagagtcttgcggatcggtacggagacgtctgtacttatcttcgagaggctacagaactgttaggaaatttccatttctttcattcctgtcgtgcggaatttgttgaatttggaatttgaacctttgtatctccattctctcacagatggtgaggacacgtgctactgggttagctgagcaggcatccgcacatactgctagggctgcaagaggccggggccgaggtagaggtcgaggaagggcacgtgctgcgactagagcacctgtcagaacaacagttgaggagccactagtagctccagttgggggacaggtaccagaagcacctgttgttacccccggacttcaggagactttagcacagttcctgagtatgtttggtacattaactcaggcgggattgatctctgttgcaccaaatatttcgcagattgggggagtagctcagactcctaccacaactccagagcagcaggttcacgttggtcaggttccgggtgtagtaccggtacaacctgttattccggttcggcctgaggtcaggcccgaggcatcagaagaagaacaaaagagacttgaaaggtttaagaggtatagtccacctactttcagtggcacagctacagaggatgcccaagaatttctagaaaattgtcaccgtattctccgcaccatgggtattgttagttgcctttactacatttcaactgtcaggcgcagcgtatcggtggtggcaaatctatgaagaaggtagaccagccgatgcacaccaccaacttgggctcaattttcggaaatgttcttgaaagagtttgttccccagactctcagagatgcgtggcgcacagagtttgaacggttgcgtcagggcactatgacagtgtcagaatatgctatcaggttcagtgagttagcccgtcatgcacctatcttggttcctacaatcagagaacgggtccgcagattcattgaggggctcgattatgatattaaaatatgcatggctcgagaattgcaaactgatactccatttcaacaagtagtggagattgcaaggaagattgagggtgttttaggcgaggaaagggagtctaaggaggccaaaaggtctcgaagatctggagggttcagtggattttactcttcagctagaacccattatagcggaggctcgagcagtcggtcagctcagtccgcacatcagattactcggagtgctccagtttatagtgcaccaccgacacgagattcttacagtggttattccagttatccggcacagactcagtacgagcagccgcgacctcagaggggttgttatgagtgtggtgatactaggcatatcatgagagattgtcccagacttgggaggggtggatttcatcagaacactccagctacaagctttattccagttgatactccacgtgcacagtcagctagaggtggaggacaggcgggtagtgggcgcctaagaggtggaggcccgacccgttgatttaatcactatgatttggctgaggccaatacaccagatggtgtcgttacaggtacgatcctgatttttattataaaaggatattttccttaatttgattcggttctgaatattgaggtgagtcctcctattatgctccacttatggtgagcttcgtaaatttgtgacccacttatatgtttatccctgttgggagatttaaagatgtgagccgtgtctgttattttatttctgtacaccattgagggctataagtccaaaaataatttttattattcattacagtgggtttaatgtgtttcggaataattgattccaatttttatgaattatacgccctaccggtatgagggttcattatatgttgtgaaaattgtttatgaaatgtattgaaaagaagaaataaaggaaattgaaaatttcagttggcacaatgtgcaacataattgtgattcggatttgaggacgagatcctcgcatttttacatgatgtgaaatatttaaaccgggctgcaagccgcgatggaagttatataaggacgaggtccttgtggtgaaatatttatgagtttaaaattctcccttgtgaaatttaatttgtgcaataatattaatagggagtcatgcctgttaggcttatttgataatgcttgtatattttctgttcatattcagccattttcgtgctgtaaatattgagttttagcctatgaggtgagtgcccaggtggcgttaaatgtgactcattaatccgagtaagtaatcatgaggtcttcatgcctcacattccgttgtcagtgttgtgaaaattcgaaatgaggtggtggttaatatgagattaattgatgatgctggaattaattatgaacagcttttaagaccagagatgtggtgatgagcatacatatgatgtgcttcatgtcctgatatcattatgataatgcagtgcttgtgatgctgagattaatgttattgatatataccctgtggtattttgttgggttgtggatatgttgttaggagttgtttgggtgttactctggcaggtggataggcccaattacaggggagactctgccgaaattttctgaaaaatttgggagttagaaaaatttgggggattgagatgtgcgaaagaagagataagttatgttgtgtgtttgagggcgaatgatcctaagcggggaagaatgaaatcccagaaaagttgatgtgtgcataggcatgagttgctatagccagttgagactaataccgtgcgtcgaagtgaaaatcaggtattttggaaatgaatggagagttagggatttttgctctaaagcttataagaatggagaaaagaaataatctcaattgagatggtgttgtcggacccgtgttaaattgcgggaatgtagaatcacccacaagtatgtgtgcaagaatatactcagtaatttaaagtcctcagaaagattcttagcacgttcgaggacgaacgtttgtttaagaggtggagaatgtaacgacccgacttgtcgttttaagaatttacgccccgttcaatgacttaaggtctcgagcagcttcgcaatatgtattatgacctgcgggtgtggtcgagtttgatttactaaagattcggaattaaattaaacgaacaatccttaatttgaagcttaaatggaaagagttgaccggagagttgacttttgagaaaacgactccggaatggaattttgatgatgtcaatagctccgtatggtgattttggacttaggagcgtgtcggaaaaattatttggaggtctgtagtggaattaagcttgaaatgccgaaagttgaatttttgggaagtttgaccgggggttgactttttgatatcgaggtcggaatccgattctggaaatttgaataggtctgttatgtcatttatgacttgtgtgcaaaatttgaagtcattccggattgatttgatatgtttcggcacaagatatagaatttgaaagttcaaagttcatagattttgatttgaggtgcgattcgtcgttttgatgttgtttgatatgatttgaggcctcgagtaggtccgtgttatgttatggaacttgttggtatgttcggacggggtcccgagggcctcgggtgagtttcggatgcttaacggatcgaatttggatttggaggaggagctgaagcagctgggctctggtgtgatcgcacctgcgcgaaaaagggccgcaggtgcgagctcgcggatgcgagaaatgagtcgcggaaaattcatgggctggccaggcaccgcgggtgcggccgcggatgcgaaaaggtgcgcgggtgcgaaaatttgtttgtataacttcattaaaattcatcggaaacaatttcggataataatgagtagacataaaattttattctaaaaagtcaacaaaagtcaacgcgggggcccgcccctcggaacctgacaaaactttcatgaaatccgaatacccattccgatacgagttcaaccataccaattttatcgaattccaataacaactcgacctccaaatctaaattttttgttttcaaatccctaagttcaaacccccgatttacacctcaaaaacatgtaatctaatcggattattcgatgataattcaatattatggagtagaaatgatcacaagggacttacctcaagttttcccgtgaagaccttgctcaaaaatcacccaacccgagcttgaaatgcccaaaaatggcaaaaactcggaacctctctgattttgtattgcctaggggttttcgcatccgcggtgatttcttcgcacctgcggcttcgcacttgcggtaaaggtttcgcacccgcggcaaattttttgcacccgcggtgcctggccagcccatgaattttccgctttcgcgactcatttctcgcatccgcgagtcctttttcgtgcaggtgcgatcacaccagcaacccagctgcttcagctcctcctccaaatccaaattcgatccgttaagcatccgaacctcacccgaggccctcaggaccccgtccaaacataccaaaaaatttcataacataacatggacctactcgaggcctcaaatcatatcaaacaatatcaaaacgacgaatcgcacctcaaatcaaaatttatgaactttgaactttcaaattctatatcttgtgccgaaacatatcaaatcaatccggaatgacttcaatttttgcacacaagtcataaatgacataacagacctattcaaatttccagaatcggattccgacctcgatatcaaaaagtcaacccccggtcaaacttcccaaaaatttaactttcggcatttcaagcttaattccactacagacctccaaataatatttccgacacgtcgctaagtccaaaataacctacagagctattgacatcatcaaaattctattccggagtcgttttctcaaaagtcaactctccggtcaactctttctatttaagcttcaaattaaggattgttcgtttaatttaattctgaatctttagtaaatcaaactcgaccacacccgtaggtcataatacatattggaaactgctcgagaccttaagtcattgaacggggcgtaaatttttaaaacgacaagtcaggtcgttacacggagccatcgtcttattagcttcttcagaaaataggacaaggaaaaggaagatagatgtgataaactccatagctaaagcaaagtttattcgtcatagcttgattaatctgcaagtgttggtataattgtgaggaatttaggtttcttcgtgtttgacaattgcaatattctcaaagaagaagaaaaaaaaagctgctggacgacgacttgtaaatgtactttctcttacgtgaccttttatttaacgagattacttagttgaaagataaatcacttcataaatgtcgttttttctatcaaacctctctataacagatctatatataacattcattcactataaaagctaagtttttctcaaaactaatttttaagttatattttacctctctataacagtttttttacctgtaacatcaacaaccatatttatagcagaacattctttgtaaaattacccttccatatatattctttaagattactaataataactctaaaaatatgtacaatcttttccgttaaataatgtttctatcttgcataaaatataagatttgaagatttgcacatgataacttttccattggacaaattccaaaatatatgtggatagaatatttaactattaagctcttagattgtcttcaaggaaaaactattgaatacctttttgctaaaaatttggacacaaatcttcgccaattcaagcgttatattgctagtaagagaatgaaatctacgaaacaagctacaattacaacgtacttacatcactcttgaaagaatttatttttgctaggtagttttaaaatgtctgccttggagtttaaatctttatatgtttagttgtgaatttactaataacatattagctttcttcaatatttaactagtgaaaaatgcatatcttttgagattttaaatttgaataaattttttatcttttatatgtaatattaaaaagaaaaaatctatttttggataattttatctataacaactaaaaaaatatttaaccgtcaaatgctgtgtttaacagccattcactataaaagccaaaatatatcggaacaaacgaggttattatagagagggttgactgtaaaagccttaacacaaaaggatgacaagaggtaaaaaatgttagagtgagaagcgagcttctctctactgtaacagtccggcttgtcgttttgaatatttacgctcctttaaactatttaaaatcttgagtagcttcatatgatgtattatgaccagtgtatattgtcggctttggttttcggatgattcaggattaaattgaaagaacaatccttgtttagaagcttaaaggcaaagggttgaccggagtttgacttttgtgcaaacgactctggaatggaatttgatggtttcgataactctgtatggtgattctgaacttaggagtatgtctggatatttattttgaagtccgtagttgaatttggcttgaaatggcgaaaataagaaattgaaggtttggaagtttgaccgaaacttgacttttatgatatcgaatccagattgtgattccagaaattttagtagcttcgttatgtcatttatgacttgtacgcaaaatttgagctcattctggattgattttatatatttcggcgcgaaatttggaagttgaaagatttaaagttcattaagtttggattgaggtgcaattcatcgtttcgacgtcgtttcttcaagcataagttatatcacattaagcaaatgagttccaaattcagtgttgattgaagcattagacccgtattaaaattacggaaccatagcaaaaagaatcatcgaatgcgaacattgtacaagagagttatgctaatttccgggcgaaatagaaaagatttcttatcaccagcgccaagggcagcgtgtggcgctggaatttttgaggctctggaaactgggccacaggtagcgccccacgctacctgtggcgctcaaacattaatccctataacggaggatttcaccatttttgacataaacaaagttggggagctcgatttgggcgattttaagaggcaaatttcaccacaaaacttggggtaagtgttcttgacttccttgtgattatatttcatgaattaatcttcgtttttggcgttagattattgatttttcaagaaaaatcggagaaattttctacaattccataaaataaattttcgagttttgaacactgatttggagtcggatttgaatcaaattagtatggttggactcgtaattgaatggattgtcagattttataagtttcttcgggttccgagatgtgggccccactgttgatttttgagttgaatttcgaatttttgttggaaaatttagcattttcatattgaattgattcctacatccactacaagaaattaggtttttagtgacgatctttagtggcgacggttcttgttgccacaataatactagttttagtggcgactaaaacatgtcgctactaaaataatataaatttagtagcgacctacattatcgcctcaaaaagctggttttagtggcgactttaccgaggtcgcccctagtagttactaagtttttattttgaaactttcctgtagaataatttgtagcgacctttaaatacttgccacaaaattgtatttgtagcgacaaagtcgctactagttatattactaatcttttttatgtttttggattatatcgcttaaacttaagaaagagaatatgctgccagtgtttcctttatttcccttgtttccccaaatcccttcccctttctcccaaaaccctagccgatgcaaaaatgtttcttaaatcccttcttctgctcttcccaaaccttcactactgttagatctaatcgccgttcagctctcacccgtggctgttaaaggacttagagttgaaagttgtgaccataccatgaaattttggaagaagttggggactattctgtgtgccgttgtgtttggaagatttttatgacggatgtgatttctttctctgtaaagaagagaattcgttgatccttcttagggtcttgggactcttgtttacacatattttacctagaagaaattcgattatcaggcatttggagccaaattcaaggtaaaagtggatcattcatttttacgaattattatgatgtttcagtttatatatttttcgttttttcccctttaaatttggaactcaattaaatgtgattctaatttattttcttttctgttaattacatattatatttgttgttctcttccgaactgtagatactttaaaaagtaacttcttgatttttcttcttagatcaatctaattttgtttttgtttgtggcttttgttttttgtttttaattggtaacaagtgtggtcctttgttttgtggcttgtgttccgtagatagtttcttatgtggtcacaaggacatatatgacgggttgaaaaggttgggtaattggctatattgcaataaagttttgattcttgaacgtatgatttagtattaacttgagtagagaaataataatcatttgagagaaggaggaactgtaatttgatttactaggatgatatttgggatactactaaagaatacgttgaaaagaaaaagaacctcgttagcattcgatcccaacttttcatcagttaattttagcacttctttaaaaacatataatgtaattcttatattacaatctggttgtaattgaaattcttgaaccatatgaacaaatgataaattttttgatcactttgttccttttggtggagtcttaaagttttgtaacgacccgactggtcgttttgagcatttgtactttttctcggtagtttgagggctcgagtttctccgcatgatgtattatgatttgcgtaaatcgtcggtgttggtttccaagttatccggaatcgatttggaagaatgaacttcaagatttaagctctaagttggaagagttgaccaagtttgaccttttagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttcgttagttccgttagctccgttggatgattttggacttaggagcgcgtccagattataatttagaggtctgtagtcgaattagtcttgaaatgacggaagttggatttttttgggaagtttggccgggagtggactttttatatcggggtcggatttcgattccggaagttggagtaggtccgtaatgtcaaatgtgacgtgtgtgcaaaattcgaggttaattagacgtgttttgataggtttcggcatcggttgtaaaagttgaagtttcaaagttcattgatttttacttgaggtgcgactcgtcgtttcgaggttgttatgcgtgatttgaagcctcaagtaggttcgtttcgtcatatagaacttgtctgcaaaattggcgccatttggagctgatttgatatagttcggacgctcggttacgattctagaggttcttgaagtttactttgatcttcatgcgttttggcgttcgattcatgattctagaggttattttgatgttttgatcactcgagtgagttcgtgttatatttttagacttgtgtgggtgtttggtttggagcctcgggggctcgggtgagtttcagattagcttcggagtgttttggtaagaaccttgagtgttgttctggtttcatcgcatttgcgatgttttggaaacatcgcaaatgcgactaccgcatttgcgaggtagtgttgttcgcatttgcgaacctaggctgctggggactggatcgcatttgcgatgaagttatcgcttttgcgaagtctgaagagttttgcatttgcgaactctgcatcgcatttgcgatgaaggcctggtctgtcaggggtcgcatttgcgatgttttgtctgcatttgcgaaccatttgtcgcaaatgcgacatctgcagcttgctaaatgctgagaattccgagacttagtttcattttgttatattttgaaccctagcttcgatgggaggcgattttgtgaagggattttcataccaaatcattgggtaagtacctctaatcaattctcaactacatttcatgattttacataagatttaacatcaaattcacgagaatctagggaaaaatttggggattttgtcaaaactttaaaaaatgaaaatttaggattcgagagtcgaataggactcggatttggaaacaaaatacgtatttggactcgtgaggctatgggtagtcaagacctacccttgaacccgggttttgatcgggcgggcccgatggttaatttttgttgactttttagaaattatataaaaattacaactttattaattgaaattgttttcccttgcattgtgtggtgtatttaagtcgtctttggctagattgagccgggcggaggtgaatttgtaaaaataaaagctaaattgagtgttgagttagccaaattgaggtaagtgtcttgcctaactttgttgagggaatttttcctactatttgacattgtttgctacatgcgggggtgatacatatatgaggtgacgagaatatatgcatgtgacagggttaaccatgctgggggggtaaattatgttataaattgtgtcttatagaatcacgtgaccttcttgcctcatgccttagttgactcctagatactaagaacatagtattaaatgttagaaactaagacttagcttattacaacttgatcaaatttgatggaattctgagaatacattggtgtgtttaattcggtcatcaatatgcataatcattaatacattgctatggccgatatttttgagagactagattctatacttgtgttgtagatcatttgtgggatttgttggaatacttgaataataatgttcttgcgggtttattgaactattgttggcttggaaagttgtgattgggattcatttggaatatttgtttaaacactctcattgacgttatttatgcttcctgccttgtttgtcattgatatacatatgcttggtaaggaagagtgtaaaacacgaagggtgatgtcgtgcctttgtttatacattatcatgtgagggagagtgtaaaacacgaagggtgatgccgtgccatattattgagagtaaaagcatgaagggtgatgccgtgccatattattgagagtaaaagcacgaagggtgatgccaagcacgaagggtgatgtgatagtattgagagtaaaagcacgaagggtgatgccgtgccatttcatttgtgagtaaaagcacaaagggtgatgccgtgccatgttatgtgagtgtaaaacacgaagggtgatgtcgtgccatttcatttatattatcatgctttaaattatcatgagttcatgatgggtgttttcatgcaggtgaggacgagggacatgcattatgttatgatatctttcctttgtgtatacgttcctgccgttacgttgagctgttattattgtatttatggttcttatgtgacttttcgttaatgccctgttcttgttctttatcttatttgttattgtgtcactcatgccttctacttgctaaacttgcaaataccatgcctacttcctgctgtcataattatatctttgtcgtatctattttggttgcacttagtacatgccttctaccgtgttagtcattcatgcttctacttgttaacgcataaagatcatgtgttcccctcttattcgttatatttgtatttatgcctccaccatgctagttagttgaagttacattccttttcctgattgttgtcatcacctctatgctttccgcctagtctgttactgatgcccatttgtacattctcgttcattattgctacttgggtatttcctactttgtcattactgttatcggcatttctgccatccggttggtactgttgtatgcatatttagtgaggatgagataaatgcacgaagtgtgttgccgtgcaattgacttgatatcagagtatattcctcacgttatgaaagttatggggtgactcttgtggtttattggtttccctctaaggaaaagattggttgagatattggaaactactgaattgtgatctcttctagtactttattattgttttgtacatttgtttcgtgtactctatcctgttatattgtagcatagttctattgctagatttcagtacagatttttattagtgagcatctttttactaaaaagcctcgtcactacttcgacgaggttagacaaaatacttactgggtatatggggtcggttatactcatactacacttctgcacattgcatgcagacttttggagcggagctgctggttatgtcgggagctgaccctgaagatgttcgtacattccggatataactgtcacctgtccttggaggctttagatttcgttaatctgtttatgtagcgttcaaacagatcgtgtaattatttgtatcagctttgtaaattctaagtcttagaagctcatgatttatactatcagttcttgggttaatttgtaaatgtccagataattcttcactatttttctataatttcatttggattgtattgtttgttagttagcttacctagcgggtcgagttaggttccatcacgactagtgatttttgggtcgtgacaagttttcataacaagaataccagttgcagaggctacagatctagtatttctttaaatatatcagttgtaatacatatactatctccaaagtagattatagttgcctgatactcgaacaaaaactatgttgagaaattaaacatgctttagaatgttaaagagaaaagtttaatatataactagtgcaaagtgtactaatctcaatatgtgcattagagatctctagttcttagatattgatatcaatgtgatgtgacccctagctgtaaacaacgcattagtctcaatatatgcatcgatatcaacattatcatatacttaataagtattgtagcagtaaacatggcagatgtaataatatgactgaagtgtgtcaaggtacaatatgctcttgatatctttaccttttaaagaatttttggattacttaagttgcttctctcgttaattcttaaaagcgattgatctaattgtatctatatttgtgttcatgttttagtaatgatccatgtactcggtattatataaattttatcatagcctctatattcatgcacatgtttctatcagctctagatgaaggatggacaaatactttagatactttcacctaccaatgcttggaagtcaccctgaaaacgtgtaatttctgattagtttatatgacttattcaaataaatttgtacgaattcaagaaaattaagtgtacaataaaagcctcattgatttctgtagctacacctaaactaccactatcatagcaaatcacttctattcctgaattctattgtgaattttctagttcaacctgcagaaataataaagcactttggtgtaaaactcctgcattttttaaattatgctcccttgtactagcttttgattttgtgaacctcgcatctcgacaaactacagcagtaaccgaggtaataaaagtttagttactgaacaagaacaaattcaggtcctatactgattagaaccttatcttctttaattagttctcaagtatgaaaaagttattatccaatcattaagttctcaagtgaacactaatcaattctaagtgtcgtctctaaattgcttatcttcttgtgagaattgcttattgctttggaagaatgccgctaaagaacaaatactatggcttatctacctacatgttacttgtaaatagtataacatgcaccagtgaagtggggaagaacgtactcaaaagtcaacaaatgcatgttcagatataggtagttaacttttcatactttttagattcttataatattttttgatttatttgccatacttagtgtggtaatctagagttaacatgatctgtgaacttgtttcagattttattttgtcacccatgctccttttatttttgaacaactaggttatttttatccaacatagcaaatgtctacataattagcaagaaaaaagatgtatattcttagctattttaggctcaattgcaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaagtttaatttgttgaataaaattgatggtgttatccggagtattgatccacgtaatgcatatcccaatatgtattctaatgttttagttgaattatcaaatatttggcaaatcataattcctacttttttgtgggatcccattgggtggttgtttataattcgtacttcttggctctttcagtacagaaacttgagggagattacgaatattttgaaggatacatagcatgaagctaagagagttggtgtgaattagcaattgctctccacgtgtgctttatagaccgcttatatatggtaacgatcatagtttatataccatttgtaaggatagtgaaattatatataacatattgcttaccggtgatttttatttgtcgatggcaaggtacttcatcaactgacattgaaggtggacaaggactaggatgagtttgaagacagagtagtttgaaggcattttgtatttttttagtattctatgtatatacaataaaaatgtaatgtgaagtattggataacttatttgtattagactttttagaaacaaaaagttcatgcaattctatttgataattgattgtttgttttttagttatctacactactaaaaattcgggcaaaaccgtccaaaagaaccaactaaagtgggtcggtaatggccaataaccgtccaaaacgcgactatttatacgtggacggtattttaaaggtcggaagggcataccgaccaaagttggtcggaaattaccgaccaactttggccggtcaattaaattttaaaaaaaaaacaattgccgaaaaaacgaccaaaattggtcgttttttttagcaccaaagtttgtcggtattttaattatataattaacaaatgcaccatctgggaatcgatcaggggtctgtactatggcaggatactattctaccactagaccattggtgcattttattttaagactgtcttttatttcatttatactctttaattgtattttcgcacgaaaataaccgaccaaagttggtcggttttattaaaaaataaaattaccgatcgaattcggtcggttttttaaaatgaaaggcggaattaaccgaccgatttcggtcggttttttttatattaattttaatttattttaaatgaaaaactgaccaaagttggtcggtttcttgaaaaataaatttcacaggactcaaaaatagtttcccgcttttttgcgccaaagaaaaccgaccaatgttggtcggtttcgtaaaaaaaaaccaaaaaaataaaatattttgaaaaaccgaccaactttagtcggttttttggccggttttttgaccgaccaaaattggtcggttgagcgtgatcggtttttgccgaatttctagtagtgctattggtatgttaatgggttagaggaaattatagatgtaactaatttatgaaaattaggttaacagtgggaatgtattagtatactggccatggagaaaaaatctgttttagtggcgactaaactttgtcacaagaacaaataaaatttgtggcaactaaagtcgcagttaaagctcatgcatttatggcgagtagagctgctgctgaagctacaatagtatttgtagcgataattgttgccactgaaaaacacattagtggcgaccagcccaaaaatcaattttgtgaaacttttttgtagcatatttatttacaatttgtggcgacaaaagtcattactaatgtgtagattctgtggcgactttcgatagtcatcgcaaaaaatattcagtaacggttgtgcttgcagcaacccaaatctcgctactatacacctttagtggcgactttcgtggaatttgtagcgactaaagtcgtgactagatacgaagcattcggaggccaattcgcaaggcaaaggcctattagaataaagaattgcacgatttgaggtaagtaacatttataaacttgtagctgagggtataaaccccgaaaatacgccttatatgatttgtttgggggtgacgcacatgctaggtgacgggcgtgtaggcgtgcaccgtagaaactgtgacgtaattgattcagtgaaattgtgtagttaaataatcttggcattgtccatgcactttcatgtgttaaggaaatcgagctgagaatcatgttaaaaatcatgttgaggctatatgccggtattactgagacccacagaggtcatgtttctattgaattatttgtttaaattgtaatttcgtactcagtcatatacattcattgcatatcatatctcagtctctgttgttatttattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagcccgagagactggagagattgatgactgagtgaggtcgagggcgtgattgtgaagataattatgggatcgggctgcacgccgcagcagaccatattggctttatatactttattattatatggatcgggcaatacgccgcagcaggccttatatgctttattattatgggatcaggctgcacgcctatcacgacccaaaatccactatatgccgtgatggcgcctaacgccgccgccaggcaagccaacagtgattcaccaaattaattactcattttagtatcttgaaatcaaaattttccttaattgaacagtataaaatagaatttacagagtgaataaaaatatttaaacgaacatcaataatggataacctgaaggaacccccaaaacttggtgtcataagtgcatgagcattttctaaagagtccaataatattacaacatctgtctcgaatgtaataagacagaataaaataaatactataatggagacttggtgtactgcgatgcgtagcttggaatgcaactcacatgaagtctccccaacaggtgtgcctacgcgccaaggtggtcatcagtgaacctgtcagatcctgcacatttggtgcagaagtgaagcatgagtacgtaaatcccagagaagtagtgacgaggggtcgacatcaacacttactagagatccaagaagataatatattaatctataacaggtatgaagtgcacatcaatagtgaagtaaatctgtatatctcaaaagttcccaattataatagagacttggtggactgcgatgcgtagcctggaatgcaactcacatgaagtctcccaaacaggtgcgcctacgcgccaaggtggtcatcagtgaacctgtcagatcctgcacatttggtgaagaagtgcagcatgagtacgtaaatcccagagaagtagtgatgaggggtcgatatcgacacttactagaggtccaagaagataatataataatctataacatgtatgaagtgcacatcaacagtgaagtaaatctataaatctcaaaagttcccaattatttcctttaaaatatgaatttctcaatcttgtattctatcttaatatctccgaaagttgtcaagtgccatcatcaaataaactcggagtaccatataaaatactgggcatccatagggaggttaactcatgaatattcgggctacaagcgatataacgcacgattctgccgaggtcgttcggcccgattcggaataatgtgtacactgccgagggtcgagcgacacgaaccatagatgcatctatatactgccgaggcattcggcccgatacacaagaaacaggaaggattacgagacacgtgtttacaatacaacacaaaatgaatttaacctttatcatttctcaaatagctcgtccacatctcaaagtgttaaggctcagcctagtgtacatatatttacttctaaataaatttcaattataacttcaattaattaagctagtagaatgagttcaaagaattcaaatattaaaggataagatcctaagtctacccggacataaatatgttatagctacgtacggactctcgtcacatcgtacgtacgtagaacccacaactagttgcacataacaataaatatcacctatggggtagtttctcccttacaaggttagagaggagacttacctcgctccgaagttccaaaaccggctccaaggcttctttaacacctcaatccaaagcctgtcgatccaaaactattcaaataatgtgcaaaccaataaaaaggatactctaatatccataattaatcaatttaaacaaattcccaactccgctcaaaaagtctataaaattaaccctcgggcccacatgcccgaattccgaaaagttttgaaggtaaactttacccataataccacgaacttaaatatataacttattccaaatttcatgttcaatttcgtagtcaaactccaaaaatgccaaattctaggttttctaccaaaccccccacaatttttactaatttctatgtttaaatacttatacaaatcatgtatttaaattgtaataggtgggaatcacttaccttgtgttgcttgatgaaaatctccccttgaagctctccaaaatctccccaaccaagtgaaaaatggaagaaaaatgggccaagtcccgtttttataaaaatattactgcccaacgactttccgcacatgcggaccaccagcagcacctgcagaatttccatcgcaggtgcggttctaactcagtctaggaacgtcggcagctgcagactcaaatgcgcatctgcgcttcctcttctacggccaaggtgcgcttctgcgcccacgctcctgcggacaatgtccacttctgcgatcaacatgcctcctaggcctttccacttttgcgttccttcctccgcagaagagactctgcttttgcggtcgatccgtcgcaggtgcagctccgcttctgcggtccacctgctcgcttctgcgaccccagtcccaatcatgtctggccgcttctgtgaccctctcggttgcttctatggctccgcacctgcggtcaaaacctcgcaggtgcggttacacaagatatgctgccaccagcattttcttaaggccaaaatcaattttttaaccatctggaaacctcccgaggccctcgggacctcgactaaatataccaaccagtcctaaaacatcatacgaacttagtcgagactttaaatcacaccaaacaacatcaaaactatgaatcaacgatcaaaaccctcctttaaactttcaaacctttaaacttggacgaacacgtccgaaccatatcaaaacatccgggaatgaaaccaaactttacatgtaagtcaaaaatcacgatatgagcctattccaaggcctggaacttcgaacggacctcaagaacaccaaaattcattccaaatcaaacttaagaatttattaaacttccaaaaatgccaaccttccataataggcgccgaaatgctcccgatttcgaggtcatttactcaaaagtcaagccttagtgaattcttccaacttaaagcttccgaaattagaattttctttccaaatcagtcccgaacttcccgaaattcatttccgaccacacgtataagtcgtaatacctgaagtgaagctactcaaggcctcaaaccgccgaacgacgcgctagggctcaaaacgaccggtcgggtcgttacattctcccccacttaaacatacgttcatcctcgaacgtgctaaggattgatttggtgttgtccaaagtcactgtgccataccttgtacacctacccgtgctaccacattccagttaaacacgttagctcgaaccagactgaaaatcctccctataaccttagctaacaagctttagaaccaagttccaacattcgaatttctttacaaggcctgattctaacacgagaacaccgtaccaatgaccacacactgtaccaaaacacgatcatacatctatgctgaaatcacaccatgcaccacacaagtcggttgtccataataacatcccctgaccacaatagctgaagtttcacgaatccgatgtatgcaatacatatcatgacacatataaatcctgttccaaatctcgcaatactgccacgacaaaaaagacgtgtagaaactcataaccacctaccaaatcaataattcatggagcctctcctcctgacaagaaccattacctcattctgaactgaataacgatattttctctctaaggtaccttatataaatctaattccactaatttcaggtctactaatctcgtctcacccagtacaagccgctgaagcaataaactgcctcaaacactgactcagatgtcatatgacgccatcaatgtgccgataagctacaactcgaatatgacacataaggaggaatgaactcttgaaaagaattatccatcctgcataacgaataaaacggccgaacagatgttatgaacccttcttagaggatgagaaacaaaatatgcaggaatagatatagggaaccgtactcaacgtggcactgttgcggcgtgcaacccgatctaaacaatgtaaccatggcggcgtgccacccgatccactcataaccataaataaggacatacccatcaagacataaggcttctacctacagaataccgaatatcggccacaagcatgctaagtgcaaaaatacaactctagggagacggatagcgccatacgccacaaaacccaagcacgactaatgtgcgataaatgacctgcatctcgagagccatcctgctcccataacaccacaagctacacgggacctcaacacgtgtgcgaataatcaatccgtctcaatccgggacaaactcccacagttcacaaccaaaggactatggcgcctttcaggcataaactctcacatttgctatattaccataacctccatacttggttttaattctttctaaatcaaatgactaagccacacttatacaaatctccccgtggggtatgctcccactaccttttcgcccaggtagcaaaatccgcacctccataccaccaatcgtactaattctgtaaggaaaatcacaatccgcaactcaacacacaatgcctcttccacagaacaccattctcaagagacactaaaataatgccagcttactctaaacatctgaattcttccctgctcatccgagctcgtgacatccttttcaacaccgaaccgtaacctcgatcgtaaactttcaaattcccatgccgctcactgcacctatcatgccgctatgcgagaataatagaattcatcataacccctgaattaccagtagaataaaacttaattggatagaaacttttcacttagctcatttcctaagagcccatgcaacacgtaactaaattcccaaaccgcagaaaacacaacctcaaaccatgatctaaaccttcataactcttccggaaatcaatttacacaacaaagccatttgaatcaaatacctcccaaatcaattaggtcacgatgtctatcaagccctcacgtacaaccataaaacacatgtataacttcacacccgaagaaactaatcattgccacaatcataccgatttgaccattactaaccgacccaacttctttcaatttactcttgacctgacgtagaaatataattgctccattcacaacataacgaactcaaatcacactcaccccgagtgacccgaatcgcgataccacattgtctcaatactcatgaaccatctcataccctccttatgtgctcaatagaatgtccgactggtacacctattctgcaagaccttccgtgaatccgaagctatttattcctttcctccaatactacactgcatacccgaggataacatagaatattcccagtcccattcacaatccactttgaagactcgatccttaaccacacatcggacccgaaatccttaggcactgcactttaattcttgaacccactaggaccattgctgagagtcatccactctgacccggtcccgaatatgaccaaaatccaacactctacaagaacatgaacaccctatcgaaaaagcagccgactgaactcttttccttgtacatcacatccacaaaagcataggctacgagtcttcccaaaaacctgaaaatacatcgataaagccgaatatagcacacttccatcaagtattttgctgaattacccatgatatttcctttccttggacataaataatccgccaacgcaccgataaccagaaatcgcacaagcagacaaccacgcgatccaatcataaatggtggggctcccccacttagctttaagctaccatcacataatgcagagcccacaactattcctccttctcaattaccatgatctcgcaccgttaacccgccagacttcttgaagtcttttgttaagcttttcatgaacattttgaatcgccagtcacaatcacatattcaacctcttactgggtagcaagtaatattcttcacagaaccttcatcaccaccacacaaccgctaaccttctcacaggagataatccacttgtggaattccttaccgacatcttccaatgacgctgcactgggtacaactaccacgtaatcagtaaattctcctgagcccatgctcgcccaccagctgtataagtatgctccttccctattgaaatcaattgaaagttcaacaataccttccgaactcaagtcatattgcacctaaaatgataatcagatcatcacacccctcttcatttcaaataaactcctttacgtcatattcaatcttccttcgtatggtaaccatcactccaaataaaatttgtagaccaaatcaccttccatcacgattccctaaccgttctacactttctcaaggcatgcaactatccttccacagaatccatatgctaatctgccgcttttacttcggttagaccatctcctttaaacaacttctcaacctctgcttttcatacttgacctactagtacttcaatcaccgcgaaacacttcccgccatgtattccctcatactttgctgcccaaatgttgcatcaaatcaaaatgcatctttgtggcacctggaccaataaaatgttaccgactctaagcctctttgaagctcatctttttcgagccatcaacattagaaataccaattcgattctgaaccgctgcatacaactatctctggcaaccacccctcatgcaccatttcacaacaccctgccctgaaggtaaaatccaagaagaccgtaacaccggcgaaccataatgcattcaaacaaggacagcgacaccgcatcactatgaaaattcctccacactcaaaaatattaagtctcgttactttatcaaccaagcatggacatctattgtccgattgcctatccttcactagaattaaatgctgaaccactaaatcatgcgctgagaaatcctcctttcgagtcatccactgccgcgatcgatacataagcactctaccattataccaacacgatgcgataacaactcatgaacaccataacaatccatgcatagcctcaaaaccgtaggaagtacagatactgaactgaaacgagagaacacacttcctcaaggcgacgataatagcctgcctgaacacgcagggaaaatcatcatgcactacgcctgtagtatcaataccactactcgacatccatttgacaaccaacgcttcacgtcacataagattgagtaggaaggaaataaagccacaagactcaatggaatccaactgcatgatgagaaaatcaagaagagaagtactcctaacaattctgtagcctctcgaagataggtacagacgtctccataccgatacgcaagactctactagactttctcattactcgtgagacctaagtaaacctaatgctctgatactaagctatcacgacccaaaatccgttataggtcatgatggcgcctaacgccgccgtcaggaaagccaacaatgattcaataaattaattactcattttagtatcttgaaatcaaaattttccttaattgaatagtataatatagaatttacagagtgaataaaaatatttacatgaaccttaataatggataacctaaaggaactcccaaaatccggtgtcacaagtgcatgagcattttctaaaaagtacaataatattacaacatctgtcccgaatgtaataagacagaataaaataaataatacaatggagactcggtggactgcgatgcgtagcttggattgtaactcccatgaagtctccccaacaggtgtgcctacgcgccaaggtggttatcagtgaacttgtcagatcctgcacatttggtgcagaagtgcagcatgagtacgtaaatcaatgcgtacctagtaagtatctagcctaaccccgaagaagtagtgacgaggggtcgacatcgacacttactagaggtccaagcagataatataataatccataacaagtataaagtgcacaacaatagtgaagttaatcggtaaatctcaaaagttcccaattatttcctttaaaatatgaatttcttaaccttgtattctatatgaatttcttaaccttgtattctatcttaatatctccgaaagttgtcatgtgtcatcatcaaataaactcggagtatcatataaaataccgggcatccgtagggaggttaactcatgaatatttaggctacaagcgatacaacacacgattctgccgaggtcgttcggcccgatccagaataatgtgtacactgccaagggtcgagcgacacgaaccatagatgcatctatatactgccgaggtgttcagcccgatccaaaagaaaagggaagtctacccggacataaacatgctataactacatacggactctcatcacctcgtgcgtacgtagcacccaaaactagttgcacataacaataaatatcacctagggggtagttttccccttacaaggttagacaggagacgtaccccgctctgaagttccaaaaccggctccaaggcctctctaacacctcaatccaaagtccgtcgatccaaaaatattcaaataatatgcaaaccaatcaaaaggatactctaattcccacaattaatcaatttaaacaaattcccaactccgctcgaaaagtctataaaatcaaccctcgggcccatgtgccaggattctgaaaatatttgaaggtaaactttacccataacaccatgaactaaaatatataaattattccaaattccatgtctagattcgcggtcaaactccaaaaatgcgaaatctaggttttctaccaaaaatcccataatttctactaatttccatgtttaaatccttatacaaaccttgtatttaacttgtaataggtgggaatcacttaccttgtgttgcttgatgaaaatctccctttgaagctctccaaaatcgccccaacaaagtgaagaatgaaaataaatgggccaaatcccgtttttataaaaaccttactgcccagaggctttccgcacctgcgaaacaccaaccggacctgcgaaatttccatcgcaagtgcggttctaactcagtccaggcacgttcgcatctgcgcttccgcttctgcacccatgctcctacggaccatgtctgcttctgtgaccaacaggcctcccaggcctttccgcttttgcgttccttcctccgtataagcgactctgcttctacggtcgatccgccgtaggtgcggatccgcttctgcgatccacctgctcgcttctgcgaccccagtcccaatcacgtctggacgcttctacaatcctcttggccgtttctgcggctccgcacctacgaccaaaacctcgcaggtacggttacaccagatatgctgccaccagcattttcataaggccaaaattaatccggaaaccacccgaggacgtcggaacctcgaccaaatataccaaccagtcctaaaacatcatacgtacttagtcgagcctttaaatcataccaaacaatatcaaaactacggatcaatgatcaaaatcctcctttaaactttcaaacctttaaacatcgacgaacgcatctgaaccatatcaaaacatcccggaatgacgccaaactttacttgcaagtcaaaaatcactatacaaacctattccaaggctcaaaacttcgaacagacctcgaatacaccaaaattcattccaaatcaaacttaagaatttcttaaacttccaaaaatgccaaccttccataataggcgccgaaatgctcccggaccacccgacactcaacccgaacatacgcccaagtacgaaatcatcatacgaacctattggaatccttcaaatcccgatttcaaggtcgtttactcaaaagacaaatcttagttaattatttcaacttaaagcttccgaaactagaattttctttccaaatcaatcccaaacttcccgaaattcaattctgaccacacgtacaagtcgtaatacctgaagtgaagttattcaaggcctcaaattgccgaacaatgtgctagggctcaaaatgatcggtcgggtcgttataacaccacaacagaccagatgtggcttattatagcgcttgggctgaaggagcccctccggagtgtgcaccccccacagtgagcgcaaatgacattatatttgggatggatttcccagggcatggagttgccttatttatttatgtttgggatggacttcccaggacatggaattgccttgtttatttatttatatttaggatggacttcccagggcatggagttgccttatttgtttatttatatttgggatggagttccctaggctggattagccctgtacagtactgagtgactgaatgttagttattatgtatatatatttgggatggatcttctcagggctggattggccatatacagtactgagtgactgtgtgcaagttgtcatttatatttgggctagatctgtcttgtacagtgccgagtgactgagtgtgcagaatattgagcgtgatgagtgaaaatgcgagacaatgagattgagtactctgtgagtatgggtacataagttcatcattatgttgcatggtattagacatgcatacttgatatgtaggcataaagaagtattttttctcacgccatctgataatgagatttctaatttgtcgttaaagtttttgagaaaaatcacaggtttcaaacttactcataattttggtaacttttggcatttgagttttactgttatattaaaaagaaatgtttattttatccgaaattttatacgaactgagcattttattattgagttattacttttgttgctttaaattatattgttatgagatgttattagttattggagttggactctgatccttgtcccagctcatcactagttgcaacctaaggttaggtttgttatttattgagtacatagggtcggttgtactcatactacacttctgcaccttgcgtgcagaatttggacgttgatgctgttatacatggcgagagctggcattggagatgtaactgcgttccggtcatagttgcctcttgaacttggtagctttagattaaaaaatctgttcatgtattttcaaacagatgatgtattttatttcacaccagctttgtaaattctgaatcttagaagctcatgatttgtactactagtccttgaggagtgtattatagtcagttaaatattaattgaatcagatatttgtaaattggcttacataacgggttaggttaggtgccatcacggctagttgaattttgggtcgtgacaagttggtatcagagctctaggttcataggttctacaagtgatgagcaagtgtctattagagtgttgaggatcggtatgatgacatccatacttatcttggagaggttacatagcatttaggataaacttcccatctttctttccttatcgtgtggaattgattcagcttgaaacataactctttgaattcctcccacgcattcgtgtgcgcatgtgagcgctcggtatcaattgtgtatcgccgacttgtgattccatgaacgaggttcaagatgagtattctgtgttttggtgatggttcagtctggaggacttgaggccagggttagaccgcggcttaagctcggtagcttcagttgtaatttgtacatttggacttatatatctggtagtgttcctatgggtggaatttgtggctcgataagcggtggaatgactgaataatgagtatgatgcgattgtgggatgagttcagatggtttgaatgtgacgcgaagagtttctcgagatgtaaaaagggacattgggtgcttgatttccgtcgtgatttgatatatagtctcgagttatgagtgtgttgaaggatctttcacgttgttaaattgtgggacaaattaaattctcatatcttgttaatgagtttacactcgggaagttaagtgatcgcgtagtgattgtggctgggaaagggtatatcaagatgccaattttaggctaagcatgtgggttatctcatgcagagtaatctacggaggtgtgctccttataatattgagtcgatttcctttctaccagcggggtgtacgtgctgagatttgaatttgaatctggttgaaaaagttgacttgactgtcaagaaaaataaatacgagcttagcgtataattgaggtattttatagttggggttggatgagcttgtgaagaatttagttgaatctcactgcagtatcatgacagtaatacggtatggggattgtgagttattgaatgtcgtggtctatagctttgagccaagtgggggagcctgttattgatggtttgatttcatggttatatgttaaattttagttttggtctgagacctacttgtggattagttatgacttgcagaggttgagatcgaggatgactcgagtaaggaaattcatgaatattagttatattgcactttatgagtatatgaacatcatgtgatgagtgagttgttatttatgaagtatgtagtgcgcacggagtatgaatttgatcgatggtattaaagcagggttacttctttgagtgttgttgtgctaatggggcatatgcttttggcccatttgggcggaataatttagatttgagcagaatggatgactctcgagaaggatctagtggattcaagaattatatatagcaattgagaatttttcaggatttgtatatggctagggtgtcgagactcacggtatttctatatcattatggattttacatttcggtatcagaaaggtggaggaaacgacttcagattcacataaggtctttttagagtgggtgtctcggttgtggtatttgtgagggataattatgatgtagtgaggctttacagatattttggtggcaatatttttgggtttggtgacctgcgtggcttagtcgagttagaggaattcagttctgatagcttggttatgtgcaaatgaattttaaagtgttcttgatggtttctaccattgtttgaatcggatattttctaccggtatgggaaacgtgttatgtatggtgattccctcctggaaggaagcaagaggaaggtctctaattgatcgagtatataatttgctggttacctagagttgataatgagattcttgtgcttgtcacatgatggcatgatagatgtggtgtgttatgcgggattaagatttacatgtacaaggtggcagttcattctttaagggaaggtcatgaattctggacagaatggtcagtttcagatatttagatgaatattataactgctcggtaatccctgaaaagggtgcgcattttagaaggcgcattgtgttttgatttacgaatgttcatcggtattgcggtactcacatggttgatagactgcggatattccaattattgctatatggcacggaagaattatggaagtattcctcgtgggatgattgtgcatgaaagatgtgttagtcattcgagtgctggagttgggacgagttacggtgattcatgtgttctatgtttttggagactaggagttcttagaagcatatcgtttcagggttgcggcctgtttgaggtgagcattttatttaaactcagtggaggcactcgttgcgttaatttcttgtgatagctaagcgctatgagtgcgtatatatgtgagatttgagcccatgtgcgggcattggggcaaatattcatactcgaaagaatgcttaggctatgatatgcctagagttaactgttaagtgtaaagttataacgtttctcgtattcgtacctttgttgagcactatctgggctatacttgaggttacaaagaggctaattccctgaataaactgggtagttactatttttgcgttaacttgccaaattgatttgtgatagcacgctttgcacatgcctactctatggcgtgttatttataccattccagcagcatgtgaatcttatttcatttatcatatacctgtatacttatttgattgctcttgtatgatatgcttggactagaagcctgtgactatgccaggcggattatgttattggcatgtgagttgtccgtgcagttgatgttaatgtgagctctaggggagctggttaccgttattagattcgtgtgtcttggttctactatatatgatgagctcatagcattgcggttgtggtggtgcttgttgaacctgcaatacggttctcttctttgagacatttcccatttttgggtacatggattgtgcagctgtggcttgagttatattggtgtggcatatatgtgggatagttgtgtttaataatataaggtcattggacctagaatgggtactatcaggtttgattacggtatattcaggaggatagtattgaaagtcggcttagaaagtgattatggttctggttggggcgagagagctccatgacttgttgatctgataaggggtcatgagattccatgcttttattatcatcagtaatgtatgaaggttttggaatgaggttttgtttgatatggggtttaatactagtaccgggttggttttgagtagttactatgatcgggaatggtgttgcgagtatgcgagttgtgtagtatgttatgtgattatatctaggattatggttatggcttgatacagcttgttcaaacttatacagtgtgtagatgtgagactcgggtcttgtgagaaattctggatgttggaaattgggttctaagttttacggactgaggttaaagtaatgatcttcaattatgttgtgttatcaggcctatatggaatagagtggcgtgggatcactcctgggtatgtgcgtggtaaggtggaacagtgatttaagggcttaggaacaactcttggaacattcgaggatgaacgtatgtttaagtgggggagaatgtaacgatccgacttgtcgttttgaacatttacactcctttcaactatttgaagtcttgagtagcttcatgtgatctattatgaccagtgtgtattgtcggctttcgttttcggatgattcgggattaaattgaaagaataatccttgcttagaagcttaaatgcaaagggttgatcggagtttgacttttgtgtaaatgactgcggaatggagttttgatggttccaatagctctgtatggtaattttggacttaggagtgtgtctggatatttattttgaagtccgtagttgaatttggcttgaaatggcgaaaataagaaattgaaggtttgaaagtttgaccggaagttgacttttatgatatcgagttcgaattgtgatttcggaaatttcagtaactttgttatgtcatttatgacttgtacgcaaaatttgagctcattccggattgatttgatatgtttcggcgcgaaatttgaaagttgaaagatttaaagttcattaagtttggattgaggtgcgattcgtcgtttcgacgtcgtttcttcaagcataagtagtatcatattaagcaaatgagctacaaattcagtgttgtttgaagcattagatccgtattgaaataacggagccatagcaaaaagaatcgtcgaattcagacatcgtatgagagagttatgccaatttccgtagaaatagaaaagatttctcatcaccaccgcccagggtagcgtggggcgctagccctggcgctgggatttttgaggttctggaaactaggccacatgtacctatggcgctcaaacattaatccctataaacgggggatttctccatttttgacataaacagagttggggaactcggtttgggcgattttcagaggcaaatttcgccacataacttggggtaagtgttcttgactcccttgttattatatttcatgaattaatcttcgttttcggcattagattattgatttttcaagagaaatcgtaggaattttctacaattccataaaacaaattttctagctttgaacaccgattcttagtcggatttgaatgaaattagtatggttggactcgtaattgaatgggttatcggattttgtgagtttcatcgggttctgagatatggaacccactgttgatgttttagttgaatttggtatttttattagaaaatttagcattttcatatggaattgattcctacacctcgtgttgattgtatcgaattaattgtaactagatacgaggtattcagaggccaattcgcgaggcaaaggcctattggaataaagaattgcacggtttgaggaaagtaacatttctaaactttgatctgagggtataaaccccgaaaatacatgttatatgattttttttgggtgtgacgcaaatgctaggtgacggacgtgtgggtgtgcaccatagaaacagtgacgtaattgattctgtggaattgtgtagtcaaataatcttggcattgtccatgtactttaatgtgttatggaaatcgagctgagaatcatgttaaaaaatcatgctgaggctatatgccggtattattgagccccacagaggtcatgttgctgttgaattatttgattaaattgtaattttgtactcagtcatatacattcattgcatatcatatctcagtctctgttgttatttattgatatatcatatcatcattttgggctagtttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattataagcccgagagactgagagattgatgactgagtgaggccgagggcttgattgtgaggataattatggaatcgggctgcacgccacaacagaccatattggctttatatattttattattatatggatcgggctgtacgccgcagcatgccttatatgctttattattgtgggatcaggctgcatgccgtagcaggccaaattggctttttatagcgcttgggctgaatgagcccatccagagtgtgcacccccccacagtgagcgcaaatgacattatatttgggatgtatttcctagggcatgtagttgccttatttatttatgtttgggatggacttcccaggacatggagttgccttatttatttatttatttatttaggtttgggatggacttcccagggtatagagttgccttatttgtttatttatatttgggatggagttccctggactggattggtcctgtacaatactgagtggctgaatgtcagttattatgtatatatatatttgggatggatctttcctgggctggattggccatatacagtactaagtgactatgtgcaagttgtcatttatatttgggctggatctgtcctgtacagtgccgagtgactaagtgtggagaatattgagcgtgatgagtgaaaatgcaagacagtgagattgagtactctgtaagtgtgagtacatgagttcatcattgtgcggcattgcattagacatgaatacttgatatgtaggcatagagaagtatttttcctcatgctatttgataatgagatttcttatctgtcgttaaagtttttgaaaaaaatcacaggtttcagacttactcatattttcggtgactttcggcaaaagatttgagttttactgttatattaaaaagaatgtttatttttttctggaattttatacgagctgagcattttattattgagttattacttgtgttgctttaaattgtattgttatgagatgctattagttattggagttggactctgatccttgtcccagctcgtcactactttcaacctaaggttaggtttgttacttattgactacatggggtcagttgtactcatactacacttctgtaccttgcgtgcagattttggacgttgatgctgctgtacatggcgagagctggcattggagatgtacttgcgttccggtcatagttgcctcttgaacttggtagctttagatttaaaaatttgttcatgtattttcaaacagatgatgtattttatttcacaccagctttgtaaattttgaatcatagaagctcataatttgtactaccagtccttgaggagtgtattagagtcagttaaatattaattaaatcggatatttgtaaattgacttacctaatgggttgagttaggtgccatcacggctagttggattttgggtcgtgacatctactccctactatttcttcccctctaacggttactttatagtgattagcgactaatgtttttcccaattttgctcaatgagcctatctattaacattttcggaccacccatccccaaaattctaatgccaccggaccccaacattaacagagatgcctcctcatctaaacattttccacctttgcaaagaagagcaatggaaacaacacaatacccaagcaatcgcagctagaatcttatgtaggagctcatggctacaaagttggaaatcgaacaggactaaaagtaagaatacccccaagagcacatgaagtgattgaaggcaaagcggtggttgttcttatcaaggaagaacatgaactccacatgctggtggaccatcatcggtaagtttcttcgaggcaaacctgccattgacaaaattagggttgattttgctcgattatttatctctaaaggagaaattaaaatttgtgcaaaagataaataccatgttttcatagatgttgaaaatgaagatgacttcaataacatttactcaaaggagtttattaatctctcgaaaaatatcagcatgaagattctgaaatggacagccaattttaagcctaacactgaaacatccctggcccctgacgggattaatctcccgaatgtaccttggcattactatgaatgggataccctatgcaggatatttggttccataggtaccccattggtcatggacggagttccccattggtcatggatggagttacaacaacaaaatctaggccaaccacaacaaaattgagagttcagattgatcttgccaagctctttttatctatagtaatagttgaagtaaaaaaccaacacggcaaaatgaaagcctttgactagaaaattgaatatgagtccatgcttgcctattgctctcacctcaaggcacaaggacactctattgaaatatgaaaattctcacaacttgctcaacaaaagaaaagaggtcaaacctccactactggaaaatggctgaattacgaccgtcaaaacggtcggaaatcacgaatttccgactattttccgatcaaaattggtcggtcgaaaaatagttgtcgaaaaacagcttccgacagaatccgtcggtgatttccgaccaaagtagtcggaaccttcaaaaggtcagacgaccaaattattttcaaatttccgaccaaagtggtcgaaattttacctaccgaatcagtcgtaataatataaataaaaataaatattaatttaaaattaaataataaaaatatataatttccgaccgaatcagtcggaaattaatcatttaaaaataaaatttatttaatatttgaatgaatccgttgaaaactgttaaaaattaattaatgatttttaatttccgatcgattcggtcggaaatctggatatttttggaaaaaattgggcagctgtccgaccgttttcgtcgaaaatcagtcggaagtttctgtaaaactgggcagaattctgctcaattttgagctacaccacctgccaaacaattacaatacaataacaccaataaccaatcaacaaatatatcatctaatccaaacaaatccaaccattaacacaatctaaaccaataaatccattaaacctaacaattttgagcataaaaatatccaaatagtagcccacattcaagtttaaaataaaacataaagttgtctctcacaatcaagtttatcaatcaaccagaacactacacctacactactacacatcacattcagtttgttcatcctcaccatcagatagatcatgccatgttttctcataaatttctacatcttaacaaatgttccgaattaggagtccaactgttgcttcaaatcacgaatttcttttttcatatcttccatctgttcttgattttgagaagaagaagaattggctaagagtgggtttggatgacctgtaggtcgacgtactccaagtccgtagactctgcctttgtttactcctgtcgctgcctctgtccataatgaagccatatcatcaggtgttggttgagttgaagtaggctgagtttgttgtcattcttccacccttttatgattatcttcctgaaatgaaaacataactattatgtaaacaaactaatattaataaaccataaataattatgaagttagtattttacatatgtgtctgacgcacccatttccacccagtgttctcttgtaccatccttcttctttttcttatgcgtctcctcgaagacctcagcgtgaatcatatctcgcactctttccttttccttcataacaaaaagtatgagttaggcattacaatcataaagttctatatgtaaaacgaagaaaaattttataagtaattaccaatcttagtttatgggccgcaaaactaatcgaacctcatgtgtgcaacgagccacctttattggaggcacgattttcctttgcttgttcactcttcttctttcattcttcggtattccatttctaaagaagtttatcccaaacatcttctcttaaccacccaggcattttaccagcatttcgagcagcgaacagagtatctttaatccgcttagcaaccttcttctagaaaatattatttatttcattttgatgttgaggatgccatgtacactttgtctgcaatataaaaaattaatattatatgaagacgataattattaaataaatataattaatttttaccctaaattgattccacatttgctatatgatgttgtacggtatctgtctccaagatatccacggctcatgataaatggcttcctagaatccacaaccaaatgtgtagattggaaggatggcaaaaacctgtattaaagttaacatatataattaataaatatcttaaagtttaaaaagttttaattataaataaatattccttaatgttaacatatctaaaagtacattcaaaacttaaaaaatagtatcagaaccttcttacctattctcgtaggggacgattatcaatcgattataactatcatattgtatgtcccctccaagattatgcctgtgtctactagatgatgtagaagcatcaccagatgtaactgggtgagagcctccaatatccaacctagatatgctgggaatggatgatgatgatggagaggaagatgatggagcaacaaaagacgaaccatcatgctgactaccatgaaagcttggggatgcagcagctggtgggctaccatgctgactaccatgaaagctcgggggtgcaacaactggtgagccagtatgctgactaccataaaagctcgggggtgcagcagctggtgagccaccatgctaactaccatgaaaccccactaaagaagaaggtgtgggtacaaagttaaaaatagtattactttgacttcctttggcaggcatagaataatactgaactaaattattagatggaggggtggatagtgaacatggtaaatggcaatgaagtcgattgaggaggatgaggaagaggatggcgaggaagaggaggactcatatttggcatacttgaggtagttggaacaaattattttttcttcttagatttcatcttttccttccccttagatgccatatctgtaatataatcataataaaatacaaaacaaaaaatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaaatacaaaataattattctacaaattaaatgactaaataaataaataaacaacctaataagtcataaaaatataaaataattttgcaacataatagataattaaaggaataacataaaaaccccaacatgtcataaaaaacatacaataattcttcaaatatattaaatgattgaaggaagaacaacataaaaaggaataacaagtcaatcctcatcgctatcttcatagtaatcatctaagtcttcattatcgcctgcttcactttcatctagtatttcttcctcatcacttgtttcatgttcaacacctctatcttcgtcctcattttaaggatcaaattcttcatatatcccttcattatgctgcaattcatctgctaattcatcatccactattgattcaacattttaaatgtcattctgatacgccacatctaatgcatcttcgacttccactctactcacagactttattttcaaaactacccgccatgcagacttattcttactcaaaggataaggagcataatacacttgtttcaccttttttgcaatgataaagggatcggtattgccccatgtgtttaattttaactattttgtactgagtgtgcacctttgtacctttattcggtgttggatcataccatttacattgaaagagtaccaactttttcttcggccaacctacagtatactctaattccaaaatctcttgaagcacgccataataatcaacatctccatcacctttcactcacaccccactattgttggttttcattctattagaccattcttgtgtatgaaacttgtacccattgaccaagtatttatacatcattctgactctagagttaggtccccaagctatatcacgtaaaaatgggccattaatgccattagctggatcatgaacctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacgatccgacctgttgttttgagctctagcgcgtcattcagcggtttgaaaccctgagtagcttcacttcaggtattatgacttgtgcgtatggtcggaattgaattttaggaagttcagagttagtttgggaagaaaattctaattttgaaagctttaagttggaagaattgactaagatttgactttttaagtaaacaacctcggaatcgggattggaaggttccaacaggttcgtatgatgattttggacttgggcgtatgtccggattgggttttggatgacccaggagcatttcagcgcctattatggaagttggcatttctggaagaatttcctaaatttgggttgaagtgcatttcaatgttattgatgtccgtttgggatttcgagtttggaaatagctccgtaaggtgattttagtattgggagcgcatctaggtatggatttggaggtccgtaggtcattttagggttatttggcgaaagttagaaatttgaaagtttttgagaagtttgaccgggagtggactttttgatatcggggtcggattccaattccggaagcttaagtaggtccgtaatgtcaattatgacttgtgtgcaaaatttgaggtcaatcgaacgtgatttgataggtttcggcatcgaaggtagaagtttgaagttctaaagttcattaagcttgaannnnnnnnnnnnnnnnnnnnnnnnnnnnnnnnnnnnnnnnnnnnnnnnnnnnnnnnnnnnnnnnnnnnnnnnnnnnnnnntttgatgttgtttgatgtgatttgaggcctcgatcaggtccgtgttatgttattggactgattggtgggatcagacggggtttcgggggcctcgggtgagtttcaaatacttaacggatcgatttttggactaagaaaaatgctaaggcagctggtatctggtgtaaccgcacctgcgaggttttggccgcaggtgcggagccgcataaatggctaggagggtcgtagaagcggttttgggtgagctgggcagtgcctgcaggtgcgagacttttccgcttctgcgatggcgcagatgcggcctcttggagcgcataagcagagtggagcgcaggagcgaggtgcatttgcgcacctgtgatgtcacaggagcgggacattgtccgcaggtgcgaaggggaggccttcagtgttttatgcagaagcggtcttgatgcgccagaagcgacgctgcagaagcggcctttggcttcgcaggtgcgaaagtcgcctgggcagaatgtataagttagccaaatcgggttttggctcatttcacctcttttctctcgttggagccggtcttgggtgcgatttagaagttccattttgtcatccttcatgaggtaaatgatttctactagttgtgagttacatataaggtttatacacggatatatgcatgaaaatttgtagaaatttaagattttgaaaaaaaaacctagaaattggtatttttagattttatccacgaaattggacatggaataaattatatattagagttcgtggtgtcatgggtaaagtttattttcaaaacgttcggaatccgggcacgtgggcccgagggttgctttatcgatttttttagcggagttaaaaattgttataaattgattaattatgggtattagagtatattttgattgggttgcgtcttatttgactagtttttgatcggcggtcactggtttgaggtattagggcggcgttggagccggttttggaacgtcggagtgaggtaaatctcctttctaaccttgtgagagggaattaatccaatatgtgaaataattcaatatgtgcttctatttgtgggggctacgtacgcacgaggtgacgagagtccgtgcgtagctactaatatacttatgtccgtgtagtctaggacccagatcatgttataattgcgatgcttgcatcctacttgttaatttaaattgcttaaatcatatcgaaacttggttactccattcttcttgactgtaaatgagaatttgtatttcttgaatagttgccttaataaaacttgaatttggttgttttaaattgtattttctcttttgtggagcgggccgaacgcctcggcagattaaatagatgcatttatggttcgcgtcgttcgaccctcggcagtgcacaatttaaatatttatgttggagcgggccgtacgacctcagcatgatttgcgcatgatatatctttggaattgataataattgatattgatttcattggccagaggtccaaaaaaaatgttaaatgacgaaaataaatttgaaaatttcttattaacaaaagaattgtttacttatttcatgatattgagcttacaaccgttctacgtaatccacgcttagttatatcattgatattttatttatagcccatagtaagtgtcgaagtcgacctctcgtcactacttcttcgaggttaggcgggatacttactaggtacgtgttgatttacgtactcatacaacacgtgctgcacatttttgtgcaggtacatatatgtctagtggccttgtgggcgcagaggcgcggttattgcgtggacttaggtgagctgcattctatactacgatccgcagccagcagagtctccttcagagtatttatattttccctatcccaatttgtatttcggacagatgttgtattttaatttacattcctagtttagtctcatgcactggtgacaccggattttggggtggttatgggttgtccggtattgaagttgttaaaaatattattatttattttgtaaatttcatcttttactatttaattgaaggaaatatgattttagaaatattaaaatgagaaccaaatttagtatttatttttggcttgcctgacagcggtgtccagtgccatcacgacctttaatgaattttgggtcgtgacaaatactttcaaattctttaaaccactctgaaaacttgggataaacaacatctttcccatatatacccacaaagtaactgccattataacttttattagttaaagcactggtagatctaatataaaagttcgcaatatataagaatatatacttacctataataaggttggacctcagtgcaattcaacaatacatgtgttgtagctgactttagctccatctcagacaaccttcgttttggactatttttttgacctcttttacctgattgattaaaaatgaaaaagggtggcacatcatgtcgatttggtctttttctcaaacatggcacatcatgttcaaaatagtatgaagagaaataagatatttctttagccacatattcctcgcatatcgaaccctcaattcttgatctagtttttatgctccgtttatatttgtcaatagtcctgcatagtgttatttttagacgaaacaatctttaaagcaaataaaaaaggtaaatgattaaatgtcattacttctcgaagggatacatccatctacattgaactggccttccaagtcgtgtctcttgtgcaaggtgaattagaagatgttccattacatcaaaaaaaccaagagggaatttttttgccagcttgtttaaagttaagataatgttactctccatataaattatgttctctaccctcaatgtgctagaacacaaatccttaaaaaagcaacttatctctgtaatcagtttccgtattcgatttgaacgcaataggcatcaatgcttccatgaaaatatgacaatcgtggcttttcattgacgccaacttcccttctttcatgtcaacacacctggataatttgatgcgtacccatcaggcatcctcaaattgttaacccaactacaaatctctcttctctcatgcaaggtgaacgtgtaactggctttgggcttctgaatcttattgttaaagtatgtcagataaaactcacttcgcctacaatattcctttatgtccatcatggccttcatgttatctttggtcttggtagtaacattcataacagtgttaaacaaattgtcaaaagaattcttctctatatgcgtggcgtccagattatgccgaagaagattgtgctttcaataaggtaattcccaaaatatgctctatttagtccagttatgtgtgacaccataacctggtatcttagatggtggagattctgttactttaggcagatcccttactctgttccaaatttcttctgaacacaagcaggccggtggctcctcaaaatcagttcggttcttcataaatgcatttgtatttcgcctaaattcatgattcataggcaagaatctacggtggcagtggaaccatgtatttttacctccatgtttcaaagtaaatgcttttttgtcttccatacaacaagggcaagctaactttcaagcagtcgaccacccagacaatattccacaagcagaaaaatcatttatagtccacatcaaaatattatgcaatctgaagttttgcttagttgatatatcatatgtttccacaccttgatgccataataattataactcatcaatcaaaggctgcaagtatacattaatcaaacttttcggatcgcgtggacctgggacaatacaagttaggaacagatatggacttgttatacacaactcggacggaagattatacggggtaacaaacactggccaacatgaatatggtgcagcagagacagaaaatggagtaaatccatctgtgataatcccaaccttatgtttcttggttcactagcaaactcggggaaaaccctatcaaaatgcttccactttctccatctgacggatggcatagaatactgggtggccttctatgttcatagtgtcatctcatatgaggaccaaagctcattgatacatacaacctctttaacctaggtataacaggtaagtaatgcatcactttaacttgaactttcttttttgtattggtatttgtgacttccttaaaacgaggctgattacaaaatttacagttttctagagatgtgtcatccttataaaataacatgcaatctttctcataataatcaattctctctgatgaaagacccaacttagaaaccaatttattagcagtgtaaaaatcttttggtaagtcaatgttactcggattaagttcattcataagcccaataatagaatccatgtcgcccacttgggaaatagaactatccgatttaatacctagcaatctaaccacaacaaacaacttggaaagcactgagccttcatacaatggacgactagcttcctctaactgttcatagaaacgcttagcctcatcatttggttcggattagaccccaggaaacatcccaaaagcatccctcatcatttcattgtatggagaattttacacattatgctctgcaatggggctaccctcaccaccaaaagaattatgaaagttaacagcatctaaaataacatgattctccccgtgaacagtctatatataataattttctacaaaccctttcttgtagagatgaactttaacttcgtctgttttcaataaattaacatacttacatttcacacaagggtgcctaatccttcctccaataggaaaattatcaagtgtttgagccttagcaataaattcagcaaccccttcaataaattcatccctcaagcccgcacgattaggatgcttcctattatacatccatctacgatgcaaaaattccatctacacaaataaaaatctagaaatgagatatttaaaataatttgatttattttaactggttacaaagttatactctttcaaaggtccgttttagatatatacgtatcattatgtcaaagcactttaattgatatattttattttttaaattaattttttttaacaatcgaaatctcacattaatccctattctaaataataaaagactttaactataataattaaatttgaatagcttcttaaatattcatataatccaaattaactaacgatttctcaaatttacaaattaatcttaatattgaaattgaaaaactttaaatttaatatcattctaatagtaaaactaacaagaaacaatgaacctagtacacaaactttacaccaaagctttaaactataactagttaatataattaccgttggaagtgaaagtgaaagttcatttttcttgtttcctatcattgttttctcaattactttttgccaacatgtcatttttttttatttcgagaataagtgaatcaatcactaaaattagatttaggatttcttaacatattcttgtttaacccaaaatttcaaccatacctaattcaacatattcttctctctttttgttttatattaagtatcattaaaaactaaaatccctaaaatttaaactatacctaattaaactatctaggatgttcatatatagaaaattgctacaaatttaacaataaaaataagatatatatgtcaacgaagtacttacctcgacgaaaaaaatgccggaaaagaaatgtgatgctgccgccgcgcgcggaaccattgctgaaaatggacaaaacaaaatttaaaaattaaggggaaaagggaggaggaaggagagggagaagggtggaggaaacgagagagagagagagagagagagagagagagagagagagagagagagagagagagagagcgaaaatacattacctataacgaggagtatggtgaagaaggacgagagggagagaggaggaggatgagagaagaaggaggaagaaaagaagtatttctgtttttggggaacggggatcggtaggattttaaaaaataattccgatcgattcggtcggaattttcattttaaatatttttttttaaaaaaacaaccaaccgaattggtcggaattgaagtcaaacgagtcaaactgacttttgcaccaaacatttcgaccgatttggttggaaatatggtcaaaaaaatttaaaattgtacagttgatatttttttgacaattccgacggattccgtcggaaatttctgacaatatttttcagtcggaaatttcaatttttctagtagtgatgaaaaggaaggagctactacacaaaccaaccatagtagcaatagaagacatgccaacctagataccaatatgcaaaggaacactacagaaaaacaaataccagatcgaaccagctacatgaagaaagaaaaagcccttaaaccaacaactttgaaggatggcagaatgtgaaaagaaaaaggggaaaaggaaatggaaatattatggcacaaaatggcaaaatcaggacaacaataatgataggaatactataccacagtctatagatcctaccttcaaggaaaatacacacaccaaaggaaaccaacaaataagagaaaccaacaattcattcagcatacttcaagcagaagatgggaaagaggaaatggacactacatcatgcctcaatgataatgacaaagattagtacactacaaaatccgttcagcatcagtcaagaagcacaagatggaacaaagcccaaataaaatattaaataaaaaataacaaacaaggctaaatgttagttgaacaaggagtggaaatgccaccaacaccaacatgagtgacactgaactacaagggaaaatgctcagcttggatatcattgacccataagatatcaatctctcacacaacaagaagaaaatatattataaacaagtagccattcctgaggaggttacacgtcaaggagaggcaagaaaaatcaatggtaacataaaaaataaggagattgatcaaactatcaactggccaacactcaaccttaaataagttactcaggaaaggtccattatcattgaggaagatgggagggaagtttgatatccaagctcatctagtaggaagagtgaccaagattttaccctcaacaaggatcttgaaccaccttattattgtgaacaaggagaaaggccaagggaggagtttaaagaagtttttcaagatatagacaacatgaaaacagaaatagacatagcctatagaaaggagagccaactatccaattcagatgatgaacccagcggtgacatcaactcaaaataccatgatactctcaacaataaaagtaaatgagtacaatagaatatcatcctcttcaataatttatctcctagaaaatgtcagatccctggtggtggttttgtccaaatacataaaagagcagaagagaacaaggaagagcaaatggaacctacctctaatgttcctaatgataaataaaatttcatgaaacttaaggatgattgtttctaaagaatctctagagagactccaaaccatcaaacaataattcaaattcctttaatctgtttacaggaacctatggtggacaataggaaaatggaaaaattcagaagaagacttggtatgcagcagggcttctataactgctcaaataagatctggatcctctagacaaaagaagtggatattactattattcaagacaaagggcaacatgtactgatcaatgttgcttacaataatagccctcctatctatattatagtgatgtacgctaaatgtactaaaaacagagaagagagctatggcaggatcttaaagatatgactaacaacatacaaggcccctgggaaaaattgaagactttaatattatcacttttaataaaaaacaagaaaggtggacgaagccttagaatagacgagaaccaagatttcattgagtgacttaatgagtatgggcttcaggatgcaagctttacaagttctatgtacacatagtgtgacaacagagaccaaccaactaccatctagaacagacttgatagacttatttacaacactacttagtttgactctatcaataacatctcagcaactcatttgtccagagcttgttcagaccatgcacctttactagttaaaatgagctttgagaccagctctttcataaggtatttcaaatttctaaacgtctggactgaacattctgaatatctgaaaacagttcaggaatactgggaagaagatgtctatggaaaccccctctacatactacatcagaagattaaaaaactttataaagagctgagcaactggtcaagacagactattggtgacatctatgaagaacccaaaaggttgaaagctgagatgacaactcttgaagataattgtgtgaatgacaattctcctgaaaacaaaagagaattatctagaagtagagatgaattgacaatgtacctaaagattcaagaaactatctttaaacaaaaatccagagccaaatggtttgaagaagtgatgctaatacatcatatttacatagaattataaaggaaataaggaggagaatgactattactaagatcatgaatgagcagaaccaatgaatagaagtaaacgatagcacaacagaagctgcaatcagacacatccgaaaaatgttctcacaggatactcaaaccaccaattttgaagctttggattgaattgagagatgtataactgagtaaaataacaacatgctcacaaccacacctactacgcaagaagtgaaagataatgtttttgctaatgacaaggacagtgcaccaggacccgatggcttaaatggcgatttttaccaaacttcctgggacatcatatgttatgatcttcttaaagctatggaatctttttttaatggtgcagagctctccaagttcttcactcacacttgattagtaatgatccccaaggttaaacacctaaagaaattcacagatcttaggcctataatcctgtgcaatgtgttcagtaagattatttttaaaattctcaacattagaatctctagtactctccctaagattatctataagaatcagtctggatttatcaaaggaagagctataactgagaatattctcctaaaccaggagattataaatgacattaggaagacctctaggggtgaaaatgttattattaagcttgatatggctaaagtagatgatagagtttattggacctttatatgtctggctctacggaaacttggcttctcagaatggtggattgatctcatttataacttcatatccaacaattggtacttcattattgtcaatgggggaaggcatggatttttttaaatttgaagaggtttgagacaacgagatctaatatctcctttttttgtttataatcagtgctgagatactatctagaatattaaacaatcttcatgaaagagaaggatacatggttttttatataaatatcaatggtccaaagattaatcacatttcttttgcagatgatactatcatattctgcaatggaagcaaacaatctctggagatggtattgaaaaccttgaaaagttatgagaaagtgtctggacagctcatcaacaaagataaagttgctttgtagtggctaataacactaaagcagccacaatcaacagactcggggccatcattggaatgaacaatcaccattttcctatcaagtatctaggattccctctcaccacaggaatgaggaagatatcatactactctgacattgtcaacaatatcataagcaaattcatgggttggcaaacaaaatccctctccacagaagaaagagctatcatgattagacatatccttctttccctccccatccatctatttgtagccaccatccatcctaaaggcactctggagcttattgagaagtatattgccagagtcttctggtcaggacaagacacaagtggtaaatatcactagactgcttggaacaactatgttacccatacaacgaaggaggagctaacttcacattccttgcagacacttgttgtcacgacccaaaacccactctaggccatgatagcgcccaacgtcgccgttaggcaaaccaacggtgaaccatctaattaattttttattttattactttcgaaatcataaattttattaagtaaagaaatttaagcatttaaaatcacaggtacatacataattagtaaggcataagaataagaggtgataataatatgcaaattcgtaaacatcaaatagaatatcccaaaatccggtgtcacaagtgcatgagtatttactaaggagtacaataataatacaacttctgtctggaatataaattagacaggataaagtaaataatacgatggagactttgtgggctgcgatacgtagcctggaatgcaactcaccataaagcctcctcagcatcggcgcctacgcgcaaagctgaccaccaaatgaacctgtcagatcctggacatttagtgcagaagtgtagcatgagcacttaaatcaacgtgtacctaataaatatctagcctaaccccagataactagtgacgaggggtcgacatcgacacttactaatggtccaataaattagtatgataaagcataaacagatatgaagcacaacagtaataatgaggtaaaacggtaactagcattatcctccaacattttttttaacgatataaatctctcaaatctcctatgctatctcaacaggtcagaaatatcaaatgcaatctccaacgaataaggaaaaccatataaatgccatgcctcaataaaaggggaatctcctaaatatccgaactgctagcggtatcacacacgattatgccgaggtcgtacgactcgatccagagtgatatgtacactgatgagggttgaccagtgtgaagtagagatgcatctcaatatattgttgaggcgttcggcccgatccacaagaaaagaaaaaacttatcaaactacgagtcacgtacgtacaacacaggtacagaggcataaagtaaacacgacttttaccgtttatcaaatatctcgccagacaactcaaggcgataaatctcggcctaatatattcccaaattaattttaattataaattcacttaattaagctagcaagatgagttcaaataatttaaatattacatgataaagtcctaaggctacccggacataaacatgcttttagctacgtaggggatctcgtcacctcgtgcgtacgtagaatccacaactagtagcacataacaattttaatacttatggggtagttttcccctcgcaaagttagacaggagacttacctccctccgaagttccataaccggctccaacgcctctctaacatctcaaaccgatgcccatcaatccgaaactagtcaaacaacatgaaaaccaataaaaatatacgccagcacccataattaatcaatttataatcgttcccaactccgcttgaaaactcaacaaagtcaaccctcgggcccacatgcctgaattttaaaattttttgaagataaacattatccataatactacgaactcgaatatataatttattcctaatctcacgtccaattttatggtcaaaatccaaaaataccaatttctaaatttctcccaaaatcccacaatttctacaaatgtttatgttaatatccatatataaccttatgtatatagattacaataagtgggaataatttacctcatgatagatgataaaaatctcctcctcaagagctccaaaaattgcccaaccaagtgaaaatgaaagaaaatgagccaaatcccatattaaaacaaatctgcccaggcccgctcttcttcgcgatcacagaaaaagcctcgcgatcgcgaaggctaactcatcccagctgcccagttaccctttgcgttcgcaacctcccgatcgcgttcgcgatgcccagccgtccctgcccttcgctttcgcattccacaccttttgttcgcgaaggccttcttcctcacagccatccccctcctagccttcatcgtgttcgcgatcaagcctatgcattagcgaagaagggccaggtccatctccgtgttcacgtgagcctcctcgcgtttgcgaagagaaaaacatgggcccttcaccttcttcgcgatcgcaggactactttcacgatcgcgaagcacaccagcaaaaacaaatcatcctaacttggtctgaaaccaccttgatactcacccaaggccccccgagaccccgtccaactacaccaaccagtcccaagatattacatgaacctgctcgaggcctcaaattacaccaaactatatccaaactacaaatcgacgatcaaaatccttcttttaactttcaaacactccaacttagacgaccacgtccgattcatacttaaacattccagaatgatgccaaacttttcgcacaaggcataaattatgatacgaacctattccaaagctcgaaatcccaaacggacatcgataacaccaaagtccactttaaacaaacttagaaaattctaaaactttcgaaatgacaactttccataataagcgctgaaatgatcccggactatccgatactcaacccgaacatacgcgcaattccaaaatcatcataggaacctattagaaccttcaaatctcgattctgaggtcgtctactaaaaagtcaaaccttagtcaactcttccaacttaaagcttttgaattgagaattttccttccgaatcaactctgaactttccgaaattcaattctggctatgcttacaagtcataaaatattatgtgaagctactcgagggctcaaaccatcgaatgacgtgctagagctcaaaataaccggtcagatcgttacacttgtcatgccttccaagccaaataatggcggatgttgagaactaccaactccctccggaaagaattcatggaagccaagcttttttaacaatgagcatccctctataactcaatggattagtggctaacctcaaagttggaaaacgttttgcaacattaaagaagatgtagaaagcaacaactttaaaatataggtgatggagaggtatctttttgatatgatgactggagtggcttgggtcctttacagcagttgcttcctggcatgactagctacaaccaaattaaggtcaaggatatcatcagtaatggctcatgaaattagaataggttccaaactcaactagatgatgaaacaaaggataagatcaaggctcttaatatcaaaatggacagaaaaagagagacagagccatttggacaccatctactactggaaattttctattggctcagcttgggacaccttcagatagagaaaaaatctagaatattttattaactttgtctgacataaggatatccccctcaagatctctttccttacctggagagccatacatgataaattatctacagaggaaacatgctttaggtttgggatccaagttaacaccattttccactgctgcaacaacaacaaccagaatcctacaattgagaacattgatcatatattctgtttaggggatcatgctaacaaaatttggagctattttgctggacctttggggattgactatagtagcaggaatctcaaagttcaactcctcacttggtggatttttaagaatcacaatcccattgccagactcctcacttcctttgatcatatgttgggagttatggaagtcaagatgcaccaaaaaatttgaaaacatcagaccatctttttataaaacgaaaactaatataatatcaactcttttacaagtactgaaaagcagatttggaagagctaatgtaagggacgatcgacacactatatgtcaagcatgtgaagctatactagagcaaaagactagcacaatggtcagaaggatcggaactaatgctcaaaagatgaagcttaacagtgatggaagttacatccaatgcatttgtggaggaggacttatcaggaataaccaaggaattgtcatttttgcctactcaattcccatggggcctggtactagcaatatggatgaagctgcagcaatgctatttggcctcaaatgctgtgctaataatggctttgaaatagccatggggaaattgactcattgctcatatccaagtgcattaaaagggaatggaaggtaccttggaagatcaccaacatcattagtgaaatctaggacctgctgataaattggcaaacttgagtcacagtcttgattcgatccatgtcttcgactcttttgctggactgcccaatcaagttaaaggcctagttaacatggactgttggaaccttccatctttcataatcaaaagaagcaagccttctcacattatatatatatatatatatatatatatatatatatatatatatatatatatatatatatgaccccccctaatcaccttgtatattagacttttggttagaactaacagcagaagtctcttctcaatgatcatgtataaagtttggaaagccaaactcaaattgtaactttttgcacatcaataataattggaggccaatttaaataatactccctccgtttcaatttatgtgaacccatctgactgggcacgaagtttaagaaaagagagaagacttttgaacttgcggtggaaaatgaggcacatatattttgtatggctataaattattgcataaaaggtaaattatttccaaataaggaaatgggtcattctttttggcatggactaaaaagaaaataagttcacataaattgaaacaaagggagtaataaataaaagccataacactaggggtgaagatggatgttttatattagaaaagcactgatcattcgcgctagtgttaagtttggtataaaattaaaacatgtaacaattgataatcgtacaaggagtagtatatggtataaggatcgtgtttcaatgatattgtgtatttaccctcaaaatcggataacaattaaatttataagtgattttaaggatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagattaatttgatacaaaacgataaattgagatagattgaacaaataaacatatagtaaattcaaaccacgtgaggaggatgattccaaccttagtgaannnnnnnnnnnnnnnnnnnnnnnnnnnnnnnnnnnnnnnnnnnnnnnnnnatattcaccctcgatccgggctcacaatggccaatactaatgaaaaagaagaagagctatgaataacactgaaaataatagtgtattgctttaggatgcatcttacaatgtgtctaatgaatggtcagaccccctttatatatatatatatatatagtaggagaatcctactctaagtgcaattctgtaaaaggtaaaaatctcatgtttaactgatttctggttctccatcgatacgtgccgagatccatgccgtgatatccagccgctcgcagatattatggccttctgttggtcgtgcttggttgcctgacaatgctctccgaagtcttttgggatgtggaccgatcccgaattacgaccccgatattctatagggcaggtgtcatgcccccagactctaactcggtgagacccttatctcgattttggtgcctcgtcattatatctcgagctttgtttaccctatcggaaattagggtgctccatgagcccgattttacccgtatacagatagtcccctcgtttctcggagagtaattttgacgagacacgacatgagctctcagattccttcctcaatacgctgtgacagaagcgacaagaaacccgaaacgtctcgtcagtcatgtcattatgacttcaaatgtgtgacactcgtcggttggcggttcctggatgcgaagcgttgcgaggcccctataaatattccctcctttgttcattttttactttacatccaaacctctaccctcgtgcctttagaaattcagtaccctcttttatactctagcattttacccccattactcaagatttcacagtacgttgcaagatttttactaattttctactcaagccaacatatctgggctttcaaccttcaacctttcccttatcgttttcaagcatttccaggtaacaatggacaaaacatccaaatccgttcctcaaaaagatgctccttcttcttcgcggccgaccactgaggccgaggagaccgcccctgatgtggtcgtcctcgagaagtctactccgggtgaggccgctgatgaactggcacccgagcccccttgagaatgttcatctccgggggatgttcggtcaatgatgactcaaggttgaaaaaccttcttcagttcaaggccagtgcgaggtggtgtctcggtacgtctgcttcatcagtgaggccgttctccttacggttcgaaaggactgcggctggacggataaggacgtagtgattctcaggcccaatgacgatatcacttcatatgttgaggaatatctaagtgtttacacttatccctttacattgggcccggtagacccggtcatcttggacttttgcacgaggtacgatgtgtgcctcggccaaattcacccatctcattggaggatcgtgatcctcctccgattctttgtgaataaaatcgattcatgcacgttcaccatcgatcacctactcagcttatacggtccccaaatcttctaggggaggactgataaagcttgtacgtcgggccagcaaagccccattctcaagcatcgacgaggaccgggatcgaggttggtaaatacgctatgtccgggtaaagaccgtcgatctgatacccactgagaagtggaacgtattaggtaagtacacctccttcctaatgtcgattatatgttttatcttcctttttcttaccggcatttgttatggtgcaacccttgctcgagttccaaatgctatccctcggctcaaggagtggatcaatggcatttgttcgcagatgacctatgccgaacgctcatggcgcaagctcttgaagggctggtagaaagcccgttctcatggtaagatctttctctccgaataaacagttctagatgttccttttcagcacttatgtcctcattgactatactctctttgcaagcttgaccaagaccatcgagctcaggcccttggtaggaggcgaggatcagcccactgatccttctactttggggcagcctagagccaccgcaagggagaaggaaaggaagagggccccgagttccccgagctcggagaaaaagaaactgagaaggaggctggttcgtaagccaaagaaaacctccagctcccgagtgcttaactcggactcacttctccggctcaggtacaagcccgaggaggataaaatctttgtggcccatgagccatctgtccccgtggaacagatggtagccgagaaggaaacaatgaaagctaatccccctcaggttcgtgaggctgatgccgaagtgagggccgagaactctcgagacaccggtcttgccccgcccggtgttatagatatttcgggattaccttcattcacagaatcaatgttcgatgaagcccgaacgacgtaggagcgatctaataagggggtccatggagcggatgatccccttcgaggcttctttgacggtgtagactcatccgccctggaggacgtcaccggattgggtgacttagaggagtagaggaaaggtccatcctcggaggtcggcaggacgaactggagcccaaggttgatcaaccgatttcctactccgagcacggatcctggccgaagcgatcaatcgttatcaccgtcccgtagcatgcccgggttctttcagcccccgtcggggctacctccggtgcctagtaaacgatgaggaccaggaaaaaatgaacgaggtagatgcgccatgcctgttcaacgaagcacaacaggcgctgaaccgggtaaggtgttaccaaaccttttttatttttcaactttagttcttgatgattctaatatctcttctcacatttgcaggcctcggtgctccaccatgaaaccttcctccggtatcgggatgagttgagataacttgaggtcgaagtcaaagagcttgcttagaagagagacatatgtaagcttctcagtgagcaccatgaaggagaagtcaagagccttcgagccgagttggacgcggctcagaaagaacacgccgacctggtggaaaaggtaaaagtctttgaagttagtaatgacgagctagacactctgactaacagtcagaatctgcaggtccagcagaaggtcgatcgggtcgaccagctcccggccgagatggacgaggtcaagtccatggctgaagagtggaagggaaaaatagaccgattggcttcgaaaaatgagactgcccaggagaagcgcccaacttcgagcggtgagggagaaagttgaggcccgatcccaaaaaatcaaagacctctagtctcaactgtgctcggctgttaccgcaggggataccctcgccaaggagcttgaagcatccaagtcagttgcgaaaataaccagggccgatgctgaagagatagtggcccagtacaaagctgatgcccagacaacccaagaccgattgaaatccattgtcgagtatgtaaagtggcagtcctgaagggaggctctcgaggaagttcatgctcggggattcgatttatcggccgagatcgaaaatgctaagaggctcgaggctaaggccaagaagttggcatagcccaaggacaagtaagactctgagggttcgagcggattcgaggacggagaagaccctgatggccccggtgatgaggcaggctcaggtgaagatcaggcttcttaggtgacttgtagaattttcttcatttttgtacttttgtatttttgttgaggccgtttgccctttgtaaagatttatgtatatgtacaaggttcttttttcccttcgacaattttcaattttgttcctttttgctttttctttacgattgcaaatatctcgaatgccttagcacgcaataataaggtcttgttcggatgttcgaaccacgctcattttttatgtaattttggttaagattcgcgggggcttgaaattatcggaagctttgcccatagttcttacttagaatgttttaggttacaattttgtcgagggtagcctttgaaccgttttagaaattttgaaggccttatgttttggttacggatctcggacgtctccgagccattcttggatggccgtagccttttaagtttgggtgttgcccaataggattattgccccgggcttcgatagcctgagtcgtccgagcttgccttggacgacagtccccgaatggggatggtcgtaacctttaaagttcgggcattgcctaatagatgttgtgcccccgagcttcgatagcccgagccgtccgagcttgccttggatgacagtccccgagtaagggtgatcttttggatccggataggggtagcccttgggctcgatgtcattaaggaacagaaatgtagtagcttttaagagacaaaatatttatctgcaaggtagaaactttcttttatttctgtgcgcaacatacaaggttgcaaatgtgtacaagcctcatgctatggcttgagtggtctatatgggcacggttcatttgaccaattggcccgtacaataaatcgtatccaccgagcccagattgtttgagcataaagtttctttccttgctaaaatcattatccaagggtgatggcccccaagtattcgaggccgattattgagaaggctcggatactgtcgatgtaatcctcgactccggtccatagccggtattcaattctaagttagcagtatccactaatgcctcattaaaaaccttgttggaaaacccatttgggacaaaaccggtccaagggaaaaagagtgtaacatgtgctttcaggcgtaaacgttatatcattccttgaccgttacctacaagtgttagtccaattcgtaatgtatgtaaagaaaagaaatgaatgggatcataccttagcagtagtatcgtttcaagtgggttacgttctagttgttcggtagtcgctcaccattcattgcttcaagtttgtatgatcctttgccggtgatctcgataattcgatatggtccggtcccaattccgtcattcaggtttcaggtattcagtgtcaccttcctcaacaccaagtccctgatattgaaatgtcggaggttggctcttcgattataataccttcgatccgttatttttgggcggccaaccgaacgagggcggcctcacgcctcttgtctaacagttccaggctcgtaatcatggcctcgtcgtttgaccctttgatcgcatatcagaacctgagacttggttctcctacatcaaccggtattagagcttcggacttgtaggccaacgagaacggggtagctccagtgctggattttgaggtcgtatgatatgcccataggacttcgggcaaaatttccttccattttcctttggtgtcggtcaacctctttttgaggttttggagtatggttttgttcgtggactccactttcgcgttcctactagggtgatagggtgttgataggatccttttgatcttatgatcctcgaaaaacttgctcactttgctgccgatgaactgcttcccattgtcgcacacgatcttggtcggcattccgaactggcatattatgtgtcccaaattaaatcaataatttccttctccctgactttctcaaatgcctgggtttccacccatttagaaaaatagtcagtcataaataatataaattgagccttatcgggtgtccatggcaggggggacgacgatgtccattccctatttcatgaatggccagggtaacaagaccaaatgcagcagttccccgggctgatgaatcatcagagtatgcctctgacatccgtcgcatttttgcacgaactccttcgcattttttccatgtcgatcttgtagtagccgtatctgactatatttcgaaccaacgattcggtgcccaaatgattttcgcaggtgcctttgtggacttccctcaacacatactcgctatctcccggtcctagacatatggcgagtgggccatcgaatgttctcctgaatagggtaccgtcttcagacaagctgaactgggccccctttgtacgtagagctctcgattctttaggatcctagggctatttttggtcttcaagtaatatatatatttgcttctccagtcccaggttaagcttgtcgaatttatctcggcgtggccttcttccactactgatttcatgagttgtacgatcattcccgagttgaattcatcatcgtcgaccgatgatcctaagttagcacgagcatcggccttgctgttttgatcccgaggtatatgttgcaaggtccattccttgaaccgatgtaacgtcacctatagattatccaagtaccttcgcatccgttgttctttgacttcgaacgttccattgacctagttcaccatgaggagggaatcgcacttagcttcgatcacctcggcccacaggcttttagccaattcaagacctgcaatcatggactcatactcagcctcgttgttagtcaattttatagttctaatagattttctaactacattacccatcggtggcttcaacacgatgccaagcccagaccgctttacgttcgaggcaccgtctgtaaagagggtccaaattctggatgaggtccccgagttcaacaagaactccttcttgacctcagaaattatggccggagtgaagtcggccacaaagtctgccaaaatttgagatttgatggcggttcggggtcgatattcgatatcgtacccactgatttccacagcccatttggctaatcgtcctaagagttcgggcttatacattatgttcctcaatgggtaagtagtcgcgacacatatgggatggcattgaaaatatggttttaacttcctagaggcgcttagcaaagcgagtgccaatttttacaggtgaggatacctagtttcggcctcacctagagtcctgctaacatagtagataggaaattgcataccttcctctttccgtactaggactccacttaccgctatctcgaataccgccaggtacaggtacaactgttcatctgcctttagagtatggagcaaaggcgggcttgaaaggtagttcttgagttcttccaaggcttgttgacactccggggtccaccagaaattattcttcttcttcaataaagagaagaatccatggctcttgtcggaggacctcgaaatgaaccggcccagtacgactatgcacccggttagtctttgaacgtccttgacattgtccaccatggtaatgtcctctatgtccttgattttatcggtattgatctcgattccccgattagacaccataaatccgagaaatttcccgaatccgaatccgaatgcgcattaatcggggttcaacttcataatgtatttcttcaatatgttgaagttttcctgcaaatgcttcaaatggtcatctgctcgcaaggatttaactaacatatcatcaatgtaaacctccattgattttcctatttgatcttcgaacattcgatctactaggcgttggtaagtggcaccaatattttttagtccgaatggcattatgttatagcagtaggtatcgtactttgtgatgaaggaagtttttttcctggtcgctcgggtccatccgaatttggttgtacctggagtaggcatcgagaaagttgaggatctcgtgcccggccgtcatatcggtcatgcgatcgatgtttggcaaagggaaagagtccttagggcatgccttattcaagtctttgtaatctacacacattcttaatttattcccttttttagggactaccactatgtttgctaactaatccgggtacttaacctcccggatggaccctattttaaggagtttagatacctcgtctttgatgaatggatacttgacttcggactggggcctccttttctgtttgaccgggtggaacttcaagtccaggctcatcttatgagtagttatctccggcggaatccctgtcatatcgaggtgggaccaagcgaaacaatctatgttagctataaggaatttaatgagtttttttctgagctcgagacttaaccccgtgcccaggtataccttatgatcgggcagttgctcaatcaatatgacttgctccagttcttcgaccattgatttggtggcgtcggaatcatcaggggctatgtaagacctgggaactccgtagtcgtcgtcctcacccgtcccctacttcttcggtcggggcggggccggtgtcggtaattgctatttggtttctcccttggtgattgaacctagattttttggtgttgaaagtgcggatatcgggaccacttcgtcgatcaacatctcctttgtggccggttgttctccgtaaattattttaatccctcctagcgttaggaatttcaacacccggtgcagcatcaagggcactaccctcatgttgtgaatccatggcctcccgaacagagaattgtacctcatatctccttcgatcacgtagaaatttgtttcctgaatggttccggtggtgttcaccggtaatgttatctctcctttagtgatctcgcatgccatgttcaatccatttagaactcggactgcaggtacgatttggtcttgtagacctagttgctccacgaccctcgatctgatgatattggtcgagctacctggatcaattaacacatgcttaactcgagatttatttatgagtatagatattactagtgcatcattgtggggctacacgacgccttcaacgtcctcatcgttgaaagataaggttccttctggcacgtaatctcgagtccatttttcccttgtgatggatattttggtgcattttaacattggtccctggggtatgtcgaccccactgatgatcatgttgatgacgtgctgaggttcctcctgctctagagtccttgttcctgaaatgggttttggctcaatcgctcaaaaattctcggagatgtctgttgttgaacaaccgggctacttcctctctcaatcgtcggcagtcttccgtcctatgaccgtgagtgccatggtatttacacattaggttgggtcctttagactggatcagactatagaggtcgaggccacatggtgtctttgatgcgtccaatggcagatacgatggcaacaacatcgacgttaaagttgtactccggtaaccttggcgcttccctgggcccgacggaactgtcgaaactgtttttgctcatgagtccccgattattttgacctcgatcactccttctttcatttctcacgaggttccgcccagaccccttacatcttcggtctccattgtatgattgataccgatccctattcgatcttggttcacgatcaatgtctcccttggatctgtcgatatgcctgacgggataaacggaccccaaaggggccacaagctgatcaccttcaaccctaaaatttgattgataccagctatgtacgtcggcccaagttacgaccgggtattctatcagattttgcttcaacagttgtgaagccaacgagcttcgagtattgagtctctgggtgaaggcttgaacgacctaatcatccgtgactggaggcaagtccattcgttccatttgaaatcgggacacgaattccctaagcatctcattatctctctgtttcactttgaaaaggtccgactttctggtttcgaccttgatagccccagcgtgtgctttcacgaaggagtctgcaagcacatcaaacgagttaatagaattagggggtaagttgtgatactatatcatagctccctttgacaaagttttcccaaattgtttcaacaggatagacttgatctcatcatcctccaagtcgttacctttgatggcgcacgtgtaggaggtcacatgctcatttaggtcggttgttccgttgtacttagaaatttcgggcatgtgtaacttctttggcattgtcttcggagctgcgctcgggggggaaggtttctaaacaaacttcttggaatccaggcccttcgatatcggtggcgctcctgggatctggtcgactctggaattgtaagtttccacctttttgtcattggcttcgattttcttttctcccgattctactcgttttgtcaattccttgaccatttttaggatttcggggttagtaccgggttcagcttcactcggcctctccgtgattggttcatttttgcgagtgatttcccggaccggctcaggctcaattctgctgggagcacgactttggttctgcagctgggctatcgctgcctattgagcctgtagcatttcgaagatcactcgcaagttgatcccatctcctccaatgtcgtgtgtattttgggctgtcgaccggactccacttcggacgctgttctcaggatcggtaggcagattcgtattgttggcaatatgtgagttagcgtcacttaggtccgcgaccggaattccgatgagatcaacaagtggaacctccccactgggtaccatactgttgttctcgccgtggtgaccggactcagcgtccatgtttagaggtgcagactgggcgttcgtcattttgaactttgtcctgaaactaaaaacacttcaaagaacaagtgtaaaatagggtgcgttatagaaatttatatcaaattgccactatcatccttagccccacggtgggcgccaaactgtttatccttaaaatcggattataattaaatttataagtggttttaaggatatgcggattaatttgatacaaaatgataaattgagttagattggacaaataaagatatagtaaattcaaaccatgtgaggaggatgattccagccttagtaaaatattcaccctcgatccgggctcacaatggccaatactgatgaacaagaagaagagctatgaataacagtgaaaataatactgtattgctttgggatgcgtgttacaacgtgtctaatgaatagtcagaccatctcctccatatatagtagaggaatctctaggtacaattctataaaaggtaaacaaatatcatgtttaactgattgtcggttctccatcgatacgtgtcgagatccatgccgtgaattctggccggtcacagatattacggccttctgttggtcgtgcttggttgcgtgacaatgctctccgaagtcttttgggatgtggaccgatcttggattacgatcccgatattctcgagtgcaggcatcatgcccccgaactctaactcggtgagacccttgcctcaattctggtgcctcgtcattacgtctcgagctttgtttaccctatcggaagctggggtgcgcgatgagcccgattttacctgtatacattggcatctagaagaatgtatagatgttgattgagctaagtgatatgaatttttaaaaaaataaaataaaataacgattggaagacgtatagaggggaaatttccactcatcaatgatgatccctttaggtgaaacgattaaaaaagatttcatcaacaaaaacatttttaaataatattttactcttgttaaacacaaataagtccctcagtcccattttgttggcattatttccttattagttcgttcctaaaaaaataatatattatcttaatgataaatttttatagttaatcacacaaatattatatcatgtttaagtcaaaagattttacaaataatacaatgacatgtttataattacaagttttagaaatcctttttttttcatttttaaatttcgtgcgaagtcaaacaacccaaaataaattgaaatagagggattatattatttttcatttaatatttttctttttgcctccctcttcttatcaatcgagagcttcttacatgccaggcaccaaaaatctataagattctttccacattgtcataaagaaaatcattaatttaatttgttgatatttcatttcccaaaaaacatagaaagagaagaatccaaagtaaaaatgtagttaggcaatatttaccttcttcaactaaaattgagcagaaaaaagacagaagtagccaccactctatgggtactatcttcacgtttctgagaatgtattggacctttatttcttaaaatagaaatatagtacactcttttcttgcatttgacagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtacacatatgctaggcgtgttcttcatatagattaaatatatttccattaagaaaggatctcaaatgactgaaattttcagaacggaaaatggtcaatatacccctgtactatgagatataatttaaatatacacctagtcaggggcggatttagtgcattagttacgggttccgtgaacccagtaatttttatctagattcggtatttgtattgaaaaatacattaaatatataagaatatttaacttggaatccaatcattattgtatattaacttataatttctgtatgaacccataaatttaaatttttagatccgcctctgcccctcgttatactttgggtccaaatatacccctatcgtaatactattggttcaaatatacccctcttccgttaagtttgtccaaaatggatgtcaaatcctacgtgacactaatatttgatgaggtagatggcacatagcatgccacctcagcgcccctaacccattttacctctcccctctatttatttttccactattaaaattttattcccctccaccactaaaaaagtagcaggatgagtttttggaccaatataaccttaaaacaagctgctcataatcattaatcagatagttgttattactaggtggaaaacctttgcttgagggctttgaaattgacttttggacatgtcttacccagaaatgaactaagcttgtgtatacggtcgaaatcgggcatacctgatttcgttagcaagggagttgcctcgagggtaacctcataatagatcgggctcgagcttgaagatagaacatcgcgcctgagaaatcgaagtgttcattgagatcgaggccggcaataatcgagataaaacatgactgacttcgagtaaggcaataacagaatggcgagatatcagtaaccggtcaaaaatcccggcggaaatcccggaacatatcaaatcaaagcgattattagtgccaatcatgggatttacttcctttactagagttgtaccttttttaggattcctctattatataaagagggaccccattcacctgtaaagaaagagaatcattatacactgataagaatatacacatatgctattttcttttacttactgttcatcgttgtttgttccatcctctactgttcttattaacctcgagactatctagaatcaaggtcgaggtattgttgacagaccggtttgatttattttattgtccaatttatatatttaattcggtgcttatcaattggtgctggtctaaatcacatatccttaaaaccacaatataagtttaattgttactcaattttaagggtaaacagtttggcgcccaccgtggggctaaggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttattgttcagtactgattctggtaaaacacaccattttacgcttgttcttgtcaagtatctttgctttcaggttaaaacaagtcaaactcaagaaatgcatccatacacggtgataatggcctcatattccacggtgaaaacggaaatgtgattgctccaagagtcgaggtgccacaggctaatcttgggggagcaccggttgccaacccagtcgatgtcagttcgcacattgctctaaatgcggacctaggcgcaggtctcgatgggagtgtacgcacagaaggctgatctagtgaccaaggaacacaaggaagaggagacgaaggagtcagtctccaagtgatattcgagatgcttcagcctcagcaagccgctattgctcagttacaaaatcaatatagagctccgaatagggtcgagccgaaaattactcaccgtaccgagccagtaccagaaaggttgagtggtaacgaatcggggactgatcttccagtaatgaaaacattcgaggagatcaccaaaagaattgaatcaggggagaagagaaacgaagccaacgataaaaaagtagagacatacaactctcgagttgaccagataccgggggcaccgccaatcttgaaagggatggattccaaagaagtttcgtatgccggacatacccaaatataatggggccaccaatctcaacgagcatgttacttcatatacatacgccatcaagggtaacgatttaaaagatgatgaaatcgaatctgtgctgttgaaaaaattcggagagaccctttcgaaaggagcaatgatttggtatcataacctgccacaaaattccattgactcatttgccatgttagcagattctttcacaaaggcacacgccggggccataaggtcgcaaccaggaaatcagatcttttcaaggtaagacaaagggataatgaaatgatgagggagttcgtgtcccgatttcaaatggaacgcatggagttgccactggtcacagatgattgggccattcaagctttcacccaagggttgaccgagtggagttcgacagcattacgtcagttgaaacaaaatttgattgagtatccagctgtaacttgggcagatgtgcacaatcgatatcaatcgaagatcagggtcgaggacgaccaattaggagccccttccgggtcagtacatccacacaggtcggcagttaaaaaccaaagggacgttgacatggagccaaggtcgaacaaagaacaatatcaaccatatactacagatcgaaagaacaaaggacgcaattccacctggaaagatctaagaagtgatcgaggacagaattatgggggacttatgagcaaaagtggttttggcaagtatgtcgatcccacagaggcatctcggttatcagaatataactttagcattgatgcatcgggcatttgtatcggcaattggaaggatcaaagatactaggtggcccagacccacacaaaccgatccttcccaaagaaacccaaattttatgtgcaagtatcatggaacgcgtggtcacaagatcgaggattgcagtaaattaagggaggaggtagcccgtctattcaatgagggccacctttgagagttcctcagcgattaagccaagaatcatttcagagagagggatgccaataagaaaaatgaacaggaagaatcccaacatgtcattcatatgatcgtcggtagggtcgacatcccacagggacccacattcaaacgcactaaggtatcaatcactagggaaaaatgaacccgagattatgtgcccgaaggcactttatcattcaacaacaaagaagtagaaggcatttctcagccccacaatgatgctctggtaatttctatcttattaaataaagttcaagttaagcgtgttttagtggatccaggtagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatcattcgatcgagggttgtggagcagctcggcctacaaaatcaaatcttgcccccaactcgggtcttaaacggattcaatatggccagtgaaacagctaaaggggagattattctactggtgaacgtggccggaaccattcaagataccaagttccacgtaatcgagggcgatatgaggacaataccttactcggaaagtcttggatccacaatatgagggcagtcccttcgactctccaccaaatgatgaaattcccgacatcggccggtgtaaaaatagtatacggggagcagcatgctgcaaaggaaatgtttacggtcgatgaggtaacgtcgatatcgacgctatcaacctcggaaaggtcgagcatcaaaggtaaacaggaagtcaaataacaatcacaaccaccagcctcgaccgagtcagggaagcaagagatagaaaaagaagaggaggatttctgacccctcgaactgttattgttatcaaagattttgacgccaccaaatcaacgattgaaaagctggaacaggttatactgatcgagtacctgcccgagcgaaaggtatacctgggaacgggattaacccccaaactcaggaaaaagcttattcaatttcttattgataacatagattgttttgcttggtcccatttagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctaagcctggaccctaggttcaaatcggtgaagcaaaagagaagaccccggaggaccgagaaacgacttcatttatcaccaagtatggaacatattgttataatgtaatgcccttcgggctaaaaaatgcaggagctacttannnnnnnnnnnnnnnnnnnnnnnnnnnnnnnnnnnnnnnnnnnnnnnnnnnnnnnnnnnnnnnnnnnnnnnnnnnntattcgaagaacaaataagtaaatcaatggaagtttatattgatgacattctagttaagtcactgtgcatagaggaccatttggctcatttgcaagaaacgttcgagattttaaggaaatacaacatgaatctcaacctcgagaaatgtgctttcggggtcagttcgggtaagttccttggcttcatggtatccaatcgggggaccgagatcaaccccgataaactcataacaatcgaagacatcaccatcgtggacagtgtaaaatccatgcagaggctaattggacagatagctaccttaggccgattcgtttcgaggtcgtcggatcgaagccacagatttttctctctgctcaaaaagaagaacgattttgcctggaccctggaatgccaacaggcattagaggaattgaagcgatacctatcgagcccaccactgcttcacactccaaaggcagatgagaaactttacttgtacttggcagtatcgaaatcgcagtaagtaatgtcctagttcgagaagatcaaggtacgcaatttcccgtttattatgtaagtcgaaccttaggagaagcagaaactagatatccacatttggagaaattgtcacttgcactgataaacgcctctagaaagttaagaccatactttcaatgtcaccccatatgcgtattaaccacttacacacttcataatattttgcacaagcccaggtctcgaactagctaaaagcttaggagcagaagtcattgaagccaagtgtgattctttactggtggtgaagtaaacaaaaccttcgaagttcgagaggatagaatgcaaaggtatttggacaaactgcaggtaactttgcaccgtttcaaggaatgcactttgcagcatgtacctcgagaacaaaacagtgaggctgatgcacttgcaaatttggggtcatcgatcgaggaaagtgagattagctcggggactgtcgttcaactctcgagatccatgatcgaggaaggtcatgccgagataaactctacaagcttaacctgggattggaggaataaatatattgaatacttgaagaacggaaagctcccatcagaccctaaagagtcgagggtcctacgaaccaaagctgctcgattcacattggctgaagatggaacattatacagaaggacattcgatggaccattggcagcatgcttaggaccaggagacactgattatgttttacgagaggtccacgaaggcacttgtgggaaccactccggcgccgaatcactgattcacaaaatcattatagcaggatactattggatagcatggaaaaagacactaaggagtttgttcgaaaatgtgataaatgtcagaggtttgcaccggtgatccatcagcccagagaacaacttcattcagtcctatccccatggccattcatgaaataggggatggatatcgtcggccatctgccatcggccccaggtaaagctaagttcattttatttatgactaattatttctctaaatgggttgaagcacaggcgttcgagaaagtaagagagaaagaggttataaactttatctgggatcacatcgtatgtcgattcgggatactcgccgaaatagtgtgtgataatggaaaataatttatcggcagcaaagtgacgaaattccttaaagaccacaaaataaaaaggatattatcaacaccatatcaccccagttggaacggataggccgaatcaacgaacaaaactatcattcaaaacctaaagaagaggctgaacgacactaaaggaaaatggagagaaatcctacccgaagtcctttgggcatatcgaacaacgtcaaaatctagtacggggcaaccccattctccttagtatatagctctgaagccttgattccaatcgaagtcggggaactcagtgccaggtttcgacatacaacagaagagtcaaatcatgaggttatgaatactagcctcgaattattggataaaaagcgagaagccacactcgttcgaatggctgcacaaaagcaacaaatcgaaagatactacaataggagaaccaacctttaccactttggagtcggggacttagtcctgagaaaattcaccattaacactcgagatcctaatgaaggaaagcttggccaaaattaggaaggactctaccaagtcctcgacatcgtcgaaaaagatcttataagctcgacacgatggacggcggacaacttgtatacggtcgaaatagatttcagccttcgtacgtctgatcgagttcgaaagataagcgatcgaagtgagacatcaagatgggttacgaagatggtacaaacaagcttcgaacccgaggggtcgatcaatgtcaagttcgatatcattatcaagctcgaatccaaatcgaactatgatgcaaagtaaagctatcaagcttatgatccagagaccgaccaacattgnnnnnnnnnnnnnnnnnnnnnnnnnnnnnnnnnnnnnnnnnnnnnnnnnnnnnnnnnnnnnnnnnnnnnntaattcaagggtccgagtcagaatcaagcttaagccaagatcgagagctcgagtctgaatcgagctcaagccaaaattgagagctcgagtcaagatcgaactcacagacaaaagccattgcaattccactagaggagagaatcttgacagaaattgtggaaaagttgatttatcaaggacctcccactgagtatttttaattatatttaaagtaaggtctctctactataaaggtggagggttatcatttctgtaagggcagtttttggatagatctcacattgtaattcaagcaccatatcctcttatattcaagagttactcttttaagcctaaaaatcttattcatcttgcttagtcctaaaaatcgtcttctttaaaactttgtttattttacattctttgctgtccatatttgatatttccttttatccttacgatttgtattatgttatatcacatatccttagaactacatataaattcaactctatccgtttttcgggtaaacagtttggcgcccaccatggggctaaggataacagtggttatttgatacgaatctgaaaaaatacgccattgtgttttgcgcttgtttccgaaaatattttgaatttcggattagcaatgactaaccaccaatcaaatggcttcaccaatcgacaacggagccggccttcaagacgaaaacaacaaattgacacctagtactgaaagaccacttgtaaacgtcgttgaagctcaaatcggagcgccaatagatatcaattcgcatgtagccattgaggcgaacctacatgctgaacccgagaatagcatccatggtggtactcggtctgtagctcgagatacccataatgtcgaggaaaacggcgttagcttgcctatgattttcgaaatgttgcaagcccaacaggcagcaatagctcagttgtagagccaaacccagctacaaagcaggccggagcccaatccacctcgataaatcacccacagaatggagccagccatagcgaagtcaaatgagcaagaatcggggactactcctgaaattgctaaattgctcgaggaactcacaaaacgagtcaaagtcaacgataaaaaagtagaaacttatatctctaggtcgatcagatcccgggagatccaccaatgataaaagggttggattcgaaacaatttgtgcaaaaaccttttccctcaagcgcaacctcgaaaccaatccccaaaaaattccgtatgcccaaaatttccaaatataacagaacgaccgatcccaatgagcacgtcacttcttacacatgtgccatcaagggaaatgattttgaagacgatgaaatcgaatctgtattgttaaaaaaaatcggagagaccctctcgaagggggcaatgatttggtatcacaacctaccaccaaattccatcgactcgttagcagattcttttatgaaagcacatgccggcaccataaaaattgcaacaaggaaatcagaactcttcaaggtaagacaaaaggataacgagatgctgagggagttcgtatctcgttttcaaatggagcgaatggacttgccaccattcacacacgattgggctattcaggctttcactcaaggtttgaacgaacgaagttcgacggcttcatggcgattaaagcataacctgatcgaatacccagccatcatgtgggccgacatgcacaatcggtaccaatcaaaaattagggtcgaagatgatcaattggggtctgaacccgctgttcgaagggatactaatcgagaacgaggttcgatcagggatccataccaaccgtacaacggaagccacatagtcagtgaatcgagacataacctcgggaaaaataaaaaaagaagtgatcgaggtcaagggtcccgggggctgatgaacagaagtaggttcgataggcctgtcggatctaaggaagcacctcggttatatcaatataacttcagcatcgatgcatctgacatcatttcagctatcggacgcatcaaagatactaaatggcctcgacccatgcagaccgatcctacctagaggaatcccaatcaaatgtgcgaatatcatggcacccatggccacagaacggaagattgcaagcaactaagagaggaagtagcccggttattcaacaaagggcaccttcgaaaatatttgagagatagggcaaagaaccattttaaaaacagggatttcggcaagcaaaacgaacaagaagaaccacatcatgtcattcacatgatcatcgatgatgctaatatccctcagggaccagtgcttaaacgcactaagacatcgattgtgagagaaaagcgatctcgaactcaagattacacaccataggaaccttgtccttcaatgatgaagatgcagaaggagtcatacaacctcataatgatgcactggtaatatatgtactcatgaataaaactaaagttaagcgtgtgttgattgatccaggttgctcggccaacatcatcacattgaaggtcatagaacagctcggcctacaggaccagatcgtacccgcaaccctggtgctaaacgaattcaatatggcatgtgaaaccaccaaaggcgagataattctaccaataaacgtggccggaaccatccaggaaatgaagttccacgtgatcgaaggcgacatgagatacaacgcccttttcggaaggccatgaatccacaatatgagagctgtacctttgaccctacaccaggtcctcaaattttaacatcgagaggagtcataacagtgtacggagaacaaccagccacaagagaaatattcatcgtcgaggaagcgaaaccaatatcctcgccttcgccagtaaagggatctggatcagaaagggaacgagataccaaatagcaatcacatacatcagctttgacccaagaagataacccgaagatcaaagaatatgatgatcagaggatccctcgatccttcgtgattcccgatgactccgacgccaccaaatcaacgattgaggaactggagcaaatcacactaatcgagcactggcccgaacaaaaggtatacttggggacgaggttgagccccgaactcaggaagaaacttattcaatttcttatcgataacattgattgcttttcctggtcccatttagatataacagggatcccaccggacataacgacacatcggctaagcttggaccctaggttcaaatcggtgaagcaaaagagaagaccccagtctgaggtaaagcacgcattcataaaggacgaggtaaccaaacttctcaagatagggtccattcgggaggtgaaatatcccgaatggttagccaatgtagttgtagtgcctaaaaaagggaacaaacttagaatgtgtgtggactataaggatttgaacaaagcatgccccaaagattcctttccgctgcccaacatcgatcgcatgatcgatgccacggccggccacgagatcctcacttttctcgatgcctattccgggtataatcaaatccagatgaacccagaggaccaggaaaagacttcatttgtcatcaaatatggaacatattgttataatgtgatggccttcgggctaaaaaatgcaggggctacttaccaatgcctagtaaataaaatgttcgaagaacaataggtaaatcaatggaagtttatattgatgacatgctagttaagtccctgcacatagaggaccatttgacccatttgcaggaaacgttcgatattttgaggaaatacaacatgaagctcaaccccgaaaaatgtgcttttggggtcggttcaggaaagttcctcggcttcatggtgtcaaatcggggagtcaagattaaccccgataaaatcaaggccatcgaagacatcaccatcgtggacaacgtgaaatttgtacaaaggctaacgggacggattgcagccttaggccgattcatttcgaggtcatcagatcgaagtcacaaatatttctctctactcaaaaagaagaacgatttcacttggaccccggaatgccagcatgcattagaggaactaaaacgatatctatcgagcccactactacttcacactccaaaaacagacgaaaaactttgcttgtacttggcagtatcggaaattgcagtaagcagtgtcctagtttgagaagagcaatgtcacgacccaaaccgatgggccgtgatgggcacccggttctttactcaaccgagtatcaatgtaacgtatcttttgtatcatactaccataggtaaatgagccggagaggctgccgtgagataagtagaataaaacataaggaaatactcaatatagggtgacccaacttgatataccgacttataaatatcacgtactggcctataaggccataccagtatctgcatacatgacatctatctacaagcctctaagagtacataaatatcataaaggccgggacagagtcctgccataccaatcaatactcatttaaatcatactgaccaaataggcaactccggagcaagtggagtgcacaaacaccttctgcttagctgatagcctactaggagaaatctcaacctgtctatcgggacctgcaggcatgaaacacagcgtccccgggcaaaagggacgtcagtacaaataatgtaccgagtatgtaaggaatgaaaatcagtaaacaatagacatgagaaaaatatagagtaaaagactagacatgtatgccttaataactctacgaatcattaatatttacaatgtcatgcatatgcgtataaatatcataccatgtttaggtatatgcgttcataacatcatcaagcctcggagggcatcccatcatatcatctcggccactgtgggcaaatcagcaacgtataccagctgatcaggtggtggtgcgtatataacgctataaccttttcccatatcccatatacatataatatacgcatatataatgccatctgttcatgggtcaatgtacatatataaatgcatgaaatgcataagaaatacgttaataagatttctcggaatatcataaaatcaatatgcctttcggataaactttatcaaatacgtatttttctgagacccattaacaaaggatataataataattcacctggggaatcaagaatatagacaaccctagtatttcaatgaataaagtcatttaagaaagttgcgtattttgctcgtttcgtttgtatcatttggatcatgccaaaaagaaagaagggatagccttaatatgcccggagtagggaaaaattcgtatgatattcttgagaaagattgcattgtactcccttagaatcgcaaaatctcattgctattataatatggagtctagtatgaatttccaaattccctcaccttcgttcttggctttgcctttatgtataactcccttaccaaatgaatttgttgaagatgctaaaattctcacgttacatgtatatacatgttcttgtatgaactggctgaagcaaactcatgttattttatctcactttgtaaaagagtcaaatgaatcttgttttagattttccatccgtaagtgtctcacttatagtcatatgaaagtcctttacaattaagatttgtgggccccatttgcataatgactaagccacccaaaattcacctaactttgtcattttgcaacataattcatgagtcattaattatagtgatgggctgccacgtaaacggttataaggcttatccaaaaattattcacttaattccttaatcaattaattaatcccccactaatccaataattaactaattatccatataattaagaattatctcaaattacttataatactactcacttttaacacactttatacatcttgctatcatgttcatgtggtaccttgtatggcactagtccataaatacagagtattgtagcttggaccgtattttatcccaaaatgtcaaactttgacaaaattcattttcttcaaattgcttaccctctcaccttcaggaatttagtcatcacttgtttgaaatagcataatgcttatagtctcaaaataatcctattcccgaacttacgtcgattaacttacgacgaaactttaacgtacgaaaatgcaggatgtaatatattattttcgagctttcatcaatttacttatggcgtatttttatgtacaaaaacatggggtgtaacatcttcccccctttggaacatttgtcctcgaatgttgattgatgcacttatcattctcataacttatagctcttgcgaatactttaatactcttcttgccatttaggcaactgttctttgaataaatccaaaggccagtgcatttccccctttaggcctctttctcacaccacggtctatgttcggaatacttccaacctcgtaactcttgctaccttctgtcgtgcagcctgtacgactttttccttgtatgtaagcctatgcgactctctctcctttttcctccagtgttttttagccaatctctaggcctcactttgtaagcatatacagagcttgataagatatctctctagcatctataggtatactaatgttctttgctcgatactttgttgaacttacaaatattgctatatcttatttcatagatccgtttatccatccgtatgactttactaccataactcttactttgatttattgttactgaggtctgctaccaaactccaagttactctcgtttcctttcatcttaagaatgatggtctaatctcatctcatactttgtaacttttatacatccattgttgattcacctcaatgttgatctacaatttactattgataacttgaaacctcttacgtaatacattaccactagggcttacgttgcatcgaggaacatttgaagtgattttcctgatccacctgggggcgataccatacttccataaccgtatttcatagcatcccaatgtgattcaccttacgtgggtattttaatcctgtaaattcatgaaatcattactcaatcgaaggcccaaacgtcatcctttatctatcacaattacacccttattctctcttttgagttcattcaggctatactgagatttctataacttagagaaataatcagctctcttgttttcatgggcttagtcccgaggacttatccattctcgtcaccttttcactcgccctttcttatgcttactcctgtcttcctaaaacctttcgctttaccatactttagcttgcggcctacacatatctatttatactactcgcaaccttccttcaatttacttgcatcatagatttccttatgtcatcctggaacatcaagcgagatatcacatcgtttctaactcttctttattcttttaactagacnnnnnnnnnnnnnnnnnnnnnnnnnnnnnnnnnnnnnnnnnnnnnnnnnnnnnnnnnncttttgatacatagaaactataggccagaaaatatgcaactgacaatgccgttatcattcctggatactgagtctcagcgtttctgtccttctatctgaagtatggactattcacaaccttcttctttgagtatctcgtacgttgttcacctttaccttacttaccttaaaatctcgcatcacatcttctatctctttcatgacctcccttacacacaggtataattcacatccacagcttgaagctctattataatacttgcacctctggtgcatacacaatccggtgagagcgtcatactgactttttatgaggatggtactcttctaactggctatgtcgtatagtcgtaatagagtatggctgttgtactatctctcttgtacctatgatattaagtgtgattatgcaatgctctcaatcatgatgtctaaaattttctaggtccaataatcagactcctaattttcttcgttgatgtaactctttagtttcctcttccttctgaccagcctttgtgaaggcttaagctatcttccgatttgtggctcatggtatttgttattactttagcctttcattgacgctatggaatatccatgacacaatcttctaataattcaatcatttgtttatgacctaagctcaattctttcttttaacttataccggagttttctacggttgtatgattgttaacatatatgttgcatggataatactccaaaatcttaggtgcattcataatgtaattaactctagatcactgatcgaataattcctttcgttccttctcaactttctttaaatgtaagcaattacttttcctggccgttttcccacttgttgcatgcatacttagcttatcttagttcccacgcatgccgaaattttcgtgcaactcatatgatctcgaatattacttttgatttttttcccattccttagccacggtaggggccactttctcatggaatgcatacaatgttgtagtgaaactatttttacatgaccatttcctctttaggtcattgtgcttaggttaaagccttcttccttatttcctcagctagtctttcgttgtagtacttagggaagaccttctgactcttgtaaagctgcgagcttattacatcgtatgcggaattttttttttgatgttcttcctcgcatataattaaccgtagttacttatttctactcccttatgcttgttgggtagctcctgaactgaagttttgactgtcttcccagtgagactatcttttatttccataacattcatacagtaccttttactacctcaactcttatttgaatatttctcaagggtcatagtgtcgtgtctgcgagactgaattcccatgttggggttcactatggttatcttgcacgatttgttgatttgtatgtaacctcttgtctagacataactagactctttctcaatcaactactaacagctcgtcggtccattatcatatctgtattccgcgtaatccctcttggattattccatttgtcttaacttacgtctcgcactggctccttatttatcaataacatctcgggtaggatcctttccttgacatcgtgtttgcataatattatggaatcatagaatatctataggatttgaatcagtgcaatctcattcctttttcatttttatcgcattcttcctttaccattccatagttactagaactacttaattctgacttaatgccacatcacaccatattccccctttaggggagcactaagatttagtgctacgatgatctatatatagatgttttacctcttcatctttggcatcttttcacatcatcgatgatccttactcgcctcgcagtaatccttctgtaccaatgataacaaatttccttactcgcgagggtgacacttagtataactggcacatacagtcccttaagcttaactttgctcacattgcttgctttnnnnnnnnnnnnnnnnnnnnnnnnnnnnnnnnnnnnnnnnnnnnnnnnnnnnnnnnnnnnnnnnnnnnnnnnnnntcattctctgaatttctcatgtatcttcttcaagacttccagtgcctatccttgtagtactcatatctagttgtactattttagagtgtaccatctgcgtgtctcataaggagatctattatcacattggcaatatcctttggaaacgttaactaacacaaacaatccattcaccattttgggttactctaacccctgtcggatcctgatatcttgtcattctcttaaaccatatatgttagtttccatagggcatagctgagatgggtgtggctaattatacatacctctgttactgttgaaggtaactcaaaatgcttatatttttctgcctgaattgtaaataccgataatcttcatcaactgggtacctcgtacccttgtcaccttgctccttttacttgttgaaacttgtatctaccttctgaatttctcgttgccttttaccatatgggtggatagatattcatgccttaggctccttttccagaagctcacacgtcttagtacacatatgatctgctcgagaccttacatttactcagcataagcatgatgcaaaatcgagttcctctgactcaactcttccacaaccgcctttcttgatgaaggttacgtcgtattatgaataagataagagtttagggaattgagttcttacaactaagatctaccacacgatctagagtaagaagaaagagtgacaaccctaaattccatgtagcctccttcttataagtgtggtacacaacacacccataaacaagactctactagacacgacttgtagactccctaggacataactgctctgatacaacttttgtcatgacccaaaccgatgggccgcgatgggaacccggtactttactcaaccgagtaccaatgtaacgtatctttcgtatcatactatcataggtaaatgagccggagaggctgccgtgggataagtagaataaaacatgaggaaatactcaatatagggtgacccaacttgatataccgacttataaatatgacgtactggcctataaggccataccagtatctgtatacatgacatatgtctacaagcctctaagagtacataaatatcataaaggtcaggacagagccctgccataccaatcaatacatatttaaatcatactaaccaaataggcaactccggagcaagtggagtacacaaccatcttttgctgagctgatagcctactaggagaactctcaacctgtctatcgggacctgcgggcatgaaacacagtgtccccaggcaaaaggggcgtcagtacaaataatataccgagtatgtaaggaatgaaaatcagtaaacaatagacatgagaaaaacatggagtaaaggactcgacatgtatgcctgaataactctacgaatcattaatatttacaatgtcatgcatatgcgtataaatatcataccatgtttaggtatatgcgttcgtatcatcatcaagcctctgagggcatcccatcatatcctctcggccactgtggacaaatcattaacgtataccagctgatcaggtggtggtgcgtatataacgccataaccttttcccatatcccatatacatataatatacacgtatataacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatgtataaaatacgtatttttctgagacccgcgaacaaaggatataataataattcacacggggaatcaagaatatagacacccctagtatttctatgaataaattcatttatgaaagttgtgtattttgctcgtttcgtttgtatcatgccaaaaagaaagaagggatagcattaacatacatggagtagggaaaaatccgtatgatattcttgagaaagattgcatcgtactcccttagaatcgcaaaatctcgtttctattataatatggagtctagtatgaatttccaaattccctcaccttcgttcttggcttttcctttctgtataactcccttaccaaatgaatttgttgaagatgctaaaattctcacgttacatgtatatacatgttcttgtatgaacttgctgaagcaaactcgcgttactttatctcactttgtaaaagagtcaaatgaatcttgttttagattttccatctgtaagtgtctcacttaaagtcatatgaaagtcctttacaattaagatttgtgggccccatttgcataatgactaagccacccaaaattcacctaactttatcattttgcaacataattcatgagtcactaattatagtgatcggctaccacgtaaatggttataaggcttatccaaaaatcatccacttaattccttaatcaattcattaatcccccactaattcaataattaaccaattatccacataattaagaattatctccaattacttataatactactcacttttaacacactttatacatcttgctatcatggtcatatggtaccttatatggcactagtccataaatacggagtattgtaacttggaccgtattttatcccaaaatgtcaaacttcgacgaaattcattttcttcaaattgcttactctctcaccttcacgaatttactcatcacttatttgaaatagcataatgcttataatctcaaaataatcccattcccgaacttacgtcgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggatgtaatatattattttcgagctttcatcaatttatttatggcatatttttacgtacgaaaatatgggatgtaacaagcaaggtacgcaatttcccatttattatataagacggaccttgggagaagcagaaactagatatccgcacctagaaacattggcacttgcactgataagcgcctctagaaagttaagatcgtactttcaatgtcaccccatatgcatattaaccacttacccgcttcgtaatattttgcacaagcctgaactcagtgggtacgatgtcgaatatcaaccccatatgaccatcaagtctcaaattttagcagacttcgtggccattttcatgccaaccctcgtacccgaagtcgaaaaagaattcctattgaaatcgggtacgtcatcgggggtatggactttttttacggatggggcttcgaacgtgaaggggtccgggctaggcatagttttaaagacacccacgggaaacactattaggcaatctattaaaactagcaggttgactaacaacgaggccgagtatgaagccatgattgcaagtctcgagctagctaaaaacttggaagtagaagtcattgaagccaaatatgactctttgctggtggtaagtcaagtaaacaaaaccttcgaagttcgacaagatagaatgcaaaggtatttggacaaactacatgtcactttgcaccatttcaaataatggactttacagcatgttccataagagcaaaacagtgaggccgatgcacttgcaaatttgggttcatcggtcgaggaaggtgacttgagctcggggactatcgttcaactctcgagatccttgattgaagaacgtcatgtcgagataaattctacgagcttaatctcggattggagaaataagtatattgaatacttaaagaacggaaagctcccatcggaccctaaagattcaagggccctacggactaaagctgcacgattcacgttggcttcagatggaacgctataccgaaggacattcgatagaccattggaagtatgcttgggtccaggagatatcgattacatcctacatgaggtgcacgggggtacttgtgggaatcactccggtgcagatccactagtccgcaaaaataatcagggcagggtattaggatcgatatgggcaaagttgcgaaggaatttgttcgaaaatgtgacaaatgttaaaggtttgcaccaatgatccattaacccggggagcaacttcactcagtcctatacccatggccattcatgaaatggggaatgtatatcgtcggccctctaccatcgaccccaggtaaagttaaattcattttatttatttatgactatttctctaaatgggttgaagcacaggcattcgagaaagtaagagagagagaggttatagactttatctgggatcatatcgcatgtcgattcgggatacccgttgaaatagtatgtgacaatgggaaacaatttgttggcagcaaagtgatgaaattcttcaaagatcacaaaataagaaggatattatcaacaccgtatcaccctagtgggaacggacatgctgaatcaacgaacaaaactatcattcaaaacctaaagaagaggctgaacctaaaggaaaatggagagaaatcctacccgaagtcctttgggcatatcaaacaacgtcaaaatctagtacgggggaaaccccgttctccttagtatatgagtccgaagccttgatacctatcgaagtcggcgaacccagtgccagattttgatacacaacagaagaatcaaataacgaggctatgaacactagctcgaattatcggacgaaaaacgagaagctgctctgtccaattggccgcccaaaaccaacgaatcgaaagatactataatcgaagaaccaagctccgccattttaagcccggggacttagttctaagaaacatcaccctcaatacccgaaatccgaacgaaggaaaactaggaccgaactgggaaggaccatatcaggttctcaagaacgtcggaaagggatcatacaagctcgacattataaacggcaaacaaatatgaagcaattggaatgtgacacatctaaaacgatactactgctaaggtacgaccctcccatattcatttacatttcaaaactaacccctgcagaagtccgatcaggagctaatatggatccttcaatacgaagccttaggtctgaaagcacgcgttgcactcctttttccttagaccagttttatcccaaatgggtttttcggcaaggtttttaatgaggaaaccaataatcgtgctacacttacaatagtatccgaggcctctttacaattgacctcgaatactaaggggcattagccctcaaatatatcaagttctgatgcaagaaagttatttcgcaacaacggggttccaataggaaaagttgtaagagccaaatggtcaaaacgaaccatgctcatatagttggcccgaacccagacgcgaaacatgaacacatgtataatgacttgaaaagaaagttctcctctttaccgatatcttatatccaagaaatattcctctatttggagatttattatgcaaatagaattaagataaactcgaccactaagcctacgggctacttttattttgagttcgagcaaacactcactcgaccattacacctacgggctacattacttcgagtttgaatcattcactcgactaagcctacgagctacttttatttcgagtttgagcaagcactcactcgactattacgcctacgggctacattactttgagttcgaatcattcactcgactaagcctatgagctacttttatttcgagttcgagcaagcactcactcaactattacgcctacgggctacattacttcgagttcaaatcattcactcgactactaagcctacgggatacatttatttcaagttaaagcaagcactcacttgaccattatgcctacgggctacattactatgagttcgagttcgagcaaacactcactcgaccattacacctatgggctacattacttcgagttcgaatcattcactcgactactaagcctacgggctacttttattttgagttcgaacaagcactcactcgaccattatgcctacaggctacattacttcgagttcgaatcattcactcgactaagcctacaggctacttttatttcgagttcgagcaagcactcactcgaccattacgcctacgggctacattacttcgagttcgaatcattcactcgactactaagcctacgggctacttttatttcgagttcgagcaagcactcactcgaccattacacctatgggctatatttcttggagctcgaatcattgactcaactaataagcctaagggctacatcacttcaagtttgagtaagcgctctctcagttataaaggctacgaagtccaaatttgattaagttgtttaaatccttgcgaaaacattcataaggcgtgaataaagtcttcacaagacaggaaacaaaatagaagcaagttggcaaaaaaggggatatttttatatacaaaattgtttacatgattgattacagcgtaaatattaaggactaagcttcctgatcatccccgggagtagtctcttctctatcagtctcccccctattctcggattcgctcttactctcatcgtcatcatcattttcatcatcatcgtcattgaaaaccaaggcttcagcatcggcttcgggttctttggccctttttatctcttcagcgagatcgaaaccacgagcatggatctcctcgagggtttccctccgagatcggcacttagcaagnnnnnnnnnnnnnnnnnnnnnnnnnnnnnnnnnnnnnnnnnnnnnnnnnnnnnnttcagcgaccgaatgtgctcgagtatcgacagtctcggatgcctctcttgcttggagctgggaaactttagcatcggtccgatagacgaccacgagtgcatccgcatcggcctttgccttttcggccttagcaagtacagaggccaaccgagcctcgagctcctctattcttcctgcttgaactaggcctttttccttcattctctgaagttgggtttcggccgatgataactgggctcgagtagtttcttctctgcagcaaagaggtccataccttctttccactgcaaagactccgcttttatcacatcgacctcctcacaaagcttcccaatcatctcaattttttgctgcaactgtgagaccgaaaaattagccatcgtttcggtatcaagaccataggcttttgaaagtatcattacctacttagacagatcggtctgatctcggtaagccttggccaactcagctcggaggtcttttatttcctcttccctttgccctaagagatgttttagggagttcctctcctcagtaacccgttgaaggtcggcctcgtatcgacgcagctcgttttgggaccgaaaacatgcttctcgatgaattgctgctgcctgcaaagaaacaagaaacgaagttagaaacgaaaagtaaacataaaggtagtaccgacaaaataattttaagtcttacatgattcaaagcctgatgcaccccgtgaaaaagatctgattcatcactagtaccggcaacgtcctcgatatcggtaaacaggtcacgaaagggatcctctccatcatgaggcctgtctagatcaagggcccccaaatcatgggcttatcgaatcacccctgcggaaaatgcggggaaggtggacgaatcttcgattgctgctgccccaaatgaatcacttggagcattctcttcggttcgaagggattcaagaggggccccttcagacatatcccccatccgttggttccgatgggatgcgtctttgatctctgataattcaggaattccgcccgaatctttctccggtatatcctcagttcgaggtggagcctcatgaagcatcatcgatctagctgccgatggggcatcggtggttctcttcgttcgggccgccagcgcagacccatcattttcttcttcatcttcatcccttagacgcagaactgattccacggtcaaaggaatggcattattgttcggcttacgagccatcctcttcttcggttttggatcttcgggaacggaggctcttttccttttattttccttcaccggctttgggacggaggccaaagtttcttcctcgttggacaagggcctcaaattcgcatctttgcccaaacctgcatatgtaaaattttattaaaatatttggaaagcatctcgtttgaattatcaaagagtacgagaaagaggcttaccatgatttttggcctcccatcgaccctttgacaaatcatgccatgaacgctcgacgtatgtggaggttgaaacaagagctcgtacccagtttttgagatcgggaactgctccgagcatccagggaaccgctgcatcacaaaaagaagagtattgatgagaaaataaatgaaagaacaaaatagaaggaagtaacagcaggatcacacttacgtttcatattccagtcctcgggaaaggcatcttttcggtcggaatcaggtctgaagtcctcactctaacaaacctggccatcgagccccgatccttttcctcgtcaatgctagagaacagagccttggtagcccgacactgaagttttattaaccctcctcgaaaaagtcaagtacggtacaatcggataagatggtcgagggtgaacgtcatcccctcgattttgttcacaaagtatcggatcaagataacgatccgccaaaaagaaggatggacctagactagggttatttggtattgacaatagaagtcaataataacggaatcgaggggacctaacgtgaaaaggttagtatacacattcaaaaaccctttcacgtaagaggtgatatcttcgatagaagtaggaattattatttcttttttatcccaattgcaatatttctttagctgtttgaggtgtttctcggttatcgaacacatgtacctcgatactggctcacatcggccagggaccgatgagcctttatcgaccttaaaagcagaagtaagaacacacgccccgggaacgtactcctcaggccgtggttctgccggtgtctcatcggcggcacactgtgaagatgaagccttctctttctgaggaatggtttgtgatgttttcgccattttcgagatcaaaggtgaagaatagaagaaagtgacgaagatttggtaaaattgaagagggccgttttgcaaagagaaatcacagatttgcgggcaagttagagaatacgaaaagagacttgggaaatttggaagattgaagatgtaaaagtggtaaatgatgaaaggaagggttatttataggtttaagcgatggcggttcagtatcagcggtggctgaccatcgtctgacatgcattaaattccttgaaagactaaatcaacgggacagctatcacgtgcatcatgatcgagctcgatggaaacgtcagtttataatccgatcgagtcgttgaaaaattatatcgtttatcaccacattcttcctgagaaacgaggggactatctatatacggtcgaaataaattttggccttcgtacgtctgatcgagtttgaaagataagcgatcgaagtgagacttctagatgggttccgaagatggtataaacaagcttcgaacccgaggggctgatcaatgtcgagttcgatatcattatcaagctcgaatccgaattgaactatgatgcaaagtaaagctatcaagcttatgatctagagaccaaccaacattgacctcgaattaattcaagggtccgagtcagaatcgagcttaagccaagatcgagagctcaagtctgaatcgagctcaatccaagatcgagagctcgagtcaagatcgagctcacagacaaaagtcgttgcaatcccactagaggagagaatcttggcaggaattatggaaaagttgatttatcatggacctctcactgagtatttttaattatatttaaagtaagatccctctactataaaggtggagggttatcatttttgtaagggcagtttttggatagagctcacattgtaattcaagcaccatatcctcttatattcaagagttacttttttaagcctataaacttgattcatcttgcttagtcctaaaaatcattttctttacaaatatgtttattttacattctttgcagtccatatttgatatttccttttatccttacgatttgtattaagctatatcacatatccttataactacgtataaattcaactctatccgtttttcgggtaaacacaactgcctaataattggagcatatcgcttctcaaacggtattactgctaagacatcgagacctcaggttttaaaacacgcgttgcactctttttcccttagattggtttttgtcccaagtgggtttttccggtgaggtttttaacgaggcaaaaattatgtgctacctgaggacaattcaacagtatccaaggcttctttacaatcaacctcgaatattggggggacatcaccctcagattttacactttcaaggaaaacacttcgtgtcagagggtctcgatagagaaactttgtaatgggccaaacggccgaatgaaccgtgtttgtatagattagtcgagctccaatggaaaaacatgcacgtataaattatacaaaaaagcattttttctatatcaaacatcttgtgtctaaaagaaacgtttctactatacaagctccatacttatgagtttgtgagaaatggctcaaggtccaagtacaaatatacctcgtacactcggggactgccatcgacaatcgacatattcgagtaatctaaactcaaattcataagacctcaaagaggcacacctcaatctataggccaagaacatcactctcggggactaacacttcaaacaagtttgaagtgttattgggaaataagcccaagaggcatacccaaaggctacggccaaattaaggcggctcagagacgtccgaatcccacaataaaaataggccttcgaattctttgaaaaaatggtttaaaaagtctaccctcggcaagtaatcaaaagtgtttcgatgaaatcagccctcgaaaaaccttaagaggtatcaaattatcttaacacaaacatgctaaggcacaaaaatcaaaggggtttcaatgggtaaagaatgcgtgttaaggcataaagaaattttttactaagtcttctaagccgaaaaaggggaaaaaatagccatcttttaaaggccatatcggcccaatctaaagtgcctaagggccaatacacttagagttcgagattttattctcactcaattcagatctaagggttccactattccgagcccaaataaaactgacttgaatatagctcgagaattcttcattatttgatataaaaccttaaggagtctgttactgtgagttcaaaacttactcgaactcggctataaaaatagtataattatggcttcgaccaagccatccgaaatcaaaatcccgaacatattgttgagctcggggactcgcctttgcttaactaaaaatcctaagggtttcttctactctgagttcgagctattgctcactcgattatagaggctatagcaacccgattgcaacaaagtcttcataaggcaaaggcaaaatagaatttatcataaatcaaaaatcggagacgaaacggaaagaaaagaaatctttcatatatgcaaagtatttacaaagaccacacatggccttacacaaaaaaaaaaggataaaaaatcttaagtgcctagtccgccttggaagttgcatcttcgggagcttcatcttcatttcctccgctctcggatccactcgcagagtcttcatcatcgaaaagaaaatctttgtcttcgtcctccaaaacctttgcactctcgatatcagccatgaggttgaagccacgagtatgaccctcctcaagagtctctcttcgagattggcacctagcatgctcggcaacacgggataatctaacctcagcagtgtcagaaatttcctttgccagagtgttagcggcttcagcgtcggctcggtaggaggccatgagcgcctctacctcggatgtggtccttgcaagttcagcagccaaccgagtctcgagctcttcagccttctgggcttaggccaagttctcaaccttcaaactttggagttgacactcaatcgaagaccgttgggcccgaaccgcatctttctccgaggcgagttggtccatgctatgcttccaccccaaagtttctgcctctttcatcttggcctcctcacgaagttgctcaaccaatttggctcgaatgcttatgatctccttttctttttgcacatagaggagtttgatggcgtctctctcccccgtaagctttttgagatcagcctcacatcgggccagttcaactcggtatttggaggatgcttctcgatggagcgccgtagcctttacaggaagaaaggaaatcagacttagagaaataagaacaaacgcaagcatggtaacatcatcgaccacaagtaaaacttacttggttcagaagccactgagcctcatcaaaaaggagtgatgcgtccaggtcggaaacatcatcgacccccgcgaagcaacacgaaatatatcatccccttcgggggccgtccccacattgggtgtccccatggaccgggcatctcgaaactgcccctcagagaatgtgggatcgggcggcaaatcatcaatattaattgccccaagcaagtcacttggggctctttggagggcctcagaactagacccttcgagcacacccaccggttgctcatcataataggaggcatcctcaagacccgatgactcggggactctgctcggaccttccatcgagatcacctcggtctgcggctaaacctcctcgaccgtcaccgacttagcagttctcgaaactttgatgcccccctcttctgagccaccagcaggaagtcgatagtttctccctcctcgtcttcatctcgtagcgtttggagtacatcggcaggcagaacgtcgagattagtcttcgactttcgagccctatttttcttgggctttggggtatctggtggcgaagcccttctcattttcttatctttgatcggcttctggacctcctattccccgaggggaggcggcctcataatgacattatctccaagacctgtatgagaagaaatcaagttaaaaagaagtatttaacaggaaagcatcaaatgcggacatgggaacttaccatgatttttggcctcctatcgacccttggccaaatcacactacgagcgctcagcatacgaagaggttgaaaccagttgtcgaacccaacctgcaaggttcgggactgcaccaggaaagcaggggaaagctgcaccataaagaagaatatagatgagaagaggtaaaggaaacataacaagtaatcaaatgttaccggtgaagttctacttacgcttcatgttccattctttggggaatggcatcttctcgacggggattaaatcggaggtcctgactcggacaaaccagcacatctatcctcgatccttgtcctcgtctatgctcgagaatagcaccttcatgacccgtcgctgaagccttatcagtctgccccaataaagacgggggctgtatagcctaatgagattatcgagggtgaaagacatcccctcgatcttgctcgagaagaatctgagcaaaatgacaatgcgccaaaaagaggggtagatctggcctagggttacctggtattggcggtagaagtcgattatgacgggatcgacggaagctagtgtgaaagggtaagtatacgcacttaagaaccctttcacatgagtggtgatgtcctcttcgagggtaggaattaccacctctttattctcccagtggcagtcctttttcacctgctcgagatcgccttcggatatcgaacagatgtatctagacatgggctcgcatcggccaggaaccgaagagggtttttcgactttaaagtcggaagtaagttcacatagcccagggatgcactcttcgatacgtggctcgaccggtgttttatcaccggcctgccgcgatgagaaggccttttcttcttgaggaacggtatttgatgtttttgccattgctatatgaggtttaaggaagaagaaggcggaatttgcgttttaataagagattggcaaacggaaaccgacaaagttgatggacatgaagagaatataagagcttttgaagattagaaaaagtttgaaagtaaagtttgaaaagattatgaaggtggtctatttataataaccactttgacggtttggaagcactggtagccgactatcaactggcgttaattaatgaccttgggaattgcgcagacgcgacgcttcaatcgcttctgtcgcttacgtcacgatgttgacatcataattgatcgaggtagtaaatcgaagtctcaaattcctttcttcttgttacactccaaaaaatgaggggactatctgtatacggtcgaaatcgggcatactcaatttcgttggtaggggagttgcctcgagggtaatctcataatagatcaggctcgagcttgaaaatagaacatcgcgcgtgagagatcgaagtgttcattgagattgagtccggcaacaatcgagatcaaacatgactgacttcgagtaaggcaataacagaatggcgagatatcagtaaccagtcgaagatcccggcggaaatcccggaacagatcaaatcaaagcggttattagtgccaatcatgggatctacttccgttattagagttataccttatttaggattcctctattatataaagagggatcccattcacttgtaaagaaagagaatcattattcactgataagaatatacacatacgcggctttcttttacttactgttcatcgttgtttgttccatcctctactgttcctattaacctcgagactatctcgaatcgaggtcgaggcattgttgacagaccagtttgatttattttattgtccaatttatctatttaatccgttgcttatcaattggtgctggtctaaatcacatatccttaaaaccacaatataagtttaattgttactcaatttttagggtaaacaatttgcttatgaacaacaccttcgactggctttgtttgtttccattagggtgttccttgttttctgctactttgtttttctttgaatcttttacaacacaaacaaaatgcaataccttttgccttggccttgaaggacaagcaactaattatattataacgtgaaatttgtccgtcttttcacgctggtgtttctgtgatgttgtgtaactttcctcatctttgaattttgcagttaatatggcagaaaaagaagaaaggtatttcatgttatcaaaactgtcacttttatcattttctttcaatgaggagactatgtttgaatttccacatttaaaggggaggggtaaaatgggtaggcgcggggtggcatgtcatgtggcatccacctcatcaagtattagtgccaaataggatttgatatccactttagacaaacttaacggaagagggtatatttgaaccaatagtattacggcaggaatatatttgtactcaaagtataactaggagtatatttaaactatatctcataatatatgaatatatttggcccttttccgttttcagaaatgaacgtgacttcagttctcgtgatatatcatttctttaattgatgaagatcagtacattatttaatttatcatcaaacattattagaataataaatataaaaaaacagaacatacacgtgcttaaaattgaaccttcacggaaattccaaaaagaaaataaaggtactgcagagtctagagctacaatttgaagggcaagcgtataaatagacgtacgcaataagtcctagtaagaacaagttcaagaaactattcatccaaaacctaattagggcaacaaaaagaaatgaatccagctgataatgcaaccttctctttctctgaccttgattttcttgactctattgaccaccatcttctgattaattccgatttttcgaacagtttttcgccgatgagttcgagcaacgtcgcaactcctaatagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagttcaagttttggcagctgccttttggatgaaaacattgaagaaacaacaactctcgaatctcaatccgagaccgaggagcaaacgcagggcggaaaggcggcgcgtgagagaaacacgaagcaagattggaggcggtacataggagtgagatggcggccgtggggaaagtttgcggcggaaataagggaccccgacaggagaggtgccagactgtggctaggaacttatgagaccccagaggatgcagcgttggcttacgatcaagccgctttcaaaatccgcggttcgagagctcggctcaattttcctcacttaattggctcaaacatgcctgagccggctagagtaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagttgtcacaattcatgctcactggagccatcgtcttcttcctccaccccattatcggaaaatgggacaaggaaaagaaatatagatgtaataaattctattgccaaagccaaatcggttggtcatatccgcaatctacacatgttactataactattcggaaggaagagttttcagttcttttttcaaatgcagtaacattaccgcataaataattactgttcaatcatgttattttcattcgtacgttcgttatttatgttttctacgtagtaattaatgctcgttaaattagcataattttctcaaagacactatgcataatgcagagaaggaatacccgatcgaataagcaaagttctaagaaaccgtctgatcaagagtttctagagaactttctaagaaaattatgcaaaaatgtcttttagaaacttgttaaaagatttatatttggatatccgctgtttaaaaaacgtctttttatgaaaacatatgctgcttaattaattaggtatatgttctctaagaagctgaaaatattaactctaattctttactttataaagctatcaataatttcaactcattacaagtaaatctccattctgtaaacgtttaaccatgtcaatgaaggagtataaagtattcaatgtttaattatttgcaaactgatattcggcaatcagttccggtttgtaatgatccacattagtttctcatttcaataatatccggtcttctttaggaaaaaagaaaaataagaagaagaaaaaaagtagttaaagtagacttgacccgggtaggcttcctcttcactcctgcaattttgagaaacaaaaaaaaaccataatcatatggaatcttctctaatattgcacatgcgtgtttgacaaatttcaattattgaatactttttaattcccaacactgtatcattaagtacgaatcattaagtacgaagggtgatgtcgtgccattttttatatattattgtgtgttcatggcacgaagagtattttcgtgtaggcgaggacaagagaatgcattatattgctgtacttgaaactatataataatcaaggttccttatgtaacctatcacaacttgtatttcattacacaaactacatatattcatttctcaattaaatttataatggcttcttttcaacgaatgaattgtacttttaatttaccattgcattagtactgctaatagttacgaatactcaactagctaatacttttctctctacaacgactagtttatctcccctgtcctaaagcgtacggctcacgctccactagatggagccgccgggaggcatcccaccggtgcgtacggcagcttagtcactcccaacaggcgaaatggctcttagagatgattctaaacagggaaaaccaacctatgcaaacaccatcaccgctcctctacatcctctcagatgctcaatccaaattccaattgataggataaagaaaaagtgatagcaagacatacgactcacaatggcatgccagcagtgatatttaaagctaaagactactacggcataatggtggattcttgtaagtacacaattgtgggaagatttcttcgaccacgcccccaaattgaccgaattaggtcaagatttaaggaaattataccattaaaggggacagtcagaataggggtttatgacaatcacaacgtcttcattgatctcttcaatgaggatgactggaaatcagtatggttaagaagagtaatcgaaatcgacggaatgcaaatgtggctacaaaagtagtcaccggacttcaaaccagaggaggatttgccagtcgctccggcctgggttcttctgccagctcttcctttttatattcatgattggcactacataaaataattattgagctctgtaggtacgccccttgctctagatgctgctactatgggtagaacaaggcctagtatggccaagattagagtggaggtggacctattaaagcctttgccagatagtctttttgtgggacaggaatatgacgaatcgccgttaaaatgttatacccaaaaattagaatataaatgtgttccgaaatattgtaaacattgtcgaaaattgggccattacatagtcaattacagggcactagaaaagaaaaaagctaatcaagtgaaggaggagggagatggagatgagattaccaaaaatgaggacgatgctcaatctatgaacaagacgatggataataacaatgttggcaaggatgacaaaattcaagttgattcttatagtgttgacattggtaaaaagcaacatgaagatggggatgacaacactaagatcattaacaataaggaggagaaaagcatgaagaaaagaactaagaagaagaaagccaagaagatgccgaagaagaaaagcaaggtaaagttcaaacctgtccaaaacaataacaagaagaatgttgtatctacatcgacgagcaaacaaaatgatcaatctattgcagagattagggacaacatatagaatcaagatgatcaggatgtgcaagatgacgagaagcagtgcagtactaatgaaaactgtaggaaagaagggcaagagaaggaggaagctcctaatatacaaatggaagatggaaacagagggtctgataataaggagaatagcaattaggatgaggaaagcaaggcagaagagaagcacaagcacaccccttgtgattctaatacctctattgtcccaacagaaataagaaatttacctggaataaacttagttgtcaacttagattgcaaagagtgggaacaagaagtgaataagagtagtactaacataatcaataagaactccataagaggtagtgaaactgagaatgaagacatagaggaggttacagaaagtcaggaagatgataatcaatacattgtcaaaagagggataagtgaaacaagaaaaagtagcaaaaaagccaaagaaacagaacacacccttcacaaagaaggaaacaaagagaggataacaccccaaattgttcttatgattagtgcaatcttctggaatataaggggagtgaggtccaaaaaagccattcacaggcttaagaggctgattgacatcaacaacactcattttgtggcggtctttgaaccttttatttcgaaaaaaaaggtagatggttacaggagattcttaggctaccaacattgtaattcgaatggtaatgatcaaatttggtacttctggaactcttacaacaacaaaatgatattctcggaaagtgatcaatatattacaatcaagttggagaaggctattagtaatcaagatatccttattacggctgtttatgctaaatgtaaatcagaagatagaaagctcctttggtcatctttgcaatatgatagtaatctggtgaatgctccttggtgtatcgagggtgattttaatatgatccttgatccaaacaaaaaattagagggtaaacctcatagaatgtacaaaagcattgattttcagaattgtatggatagttgcgatgttacagatattggttactctggaccaaattttacttggtacaataacaggagacccaggaagaggattcagaaaagattggatagagtcttcgtgaatgacctatgggacaatctgttccaaagatgctcaattaggcatatggaaaggactggttctgatcatagacctttattcatgaagaatctatatgctaatcacaattgcattagatatttcagattcctcaactgttggattaatctgcctggcttttataatattgtcaaggaaagttggaattcaaatgttacgggtaatcctatgtggatcttgcaaacaaaactaaaggctctcagtaagagattaaatcaatggtccagggaatacatcagcgacataaatgaagccattaccaattgggaggagaaacttcaatactttgaggataaagatatcgaagacaacacaaaattgagcagagaagaagtgaacaaagcacacgccgaatacattagatggctgagtatccaagactccctcctcaagcagaagtctaggataaaatggtttaaagatggcgacaagaataccaggtattttcactgcattctcatggaaaaaaggaggaagcaacaggtaagtagaattaagaatcataaaggtaaatggattatgggggacaagaaaatctctaaagcagcaatcaagcatttcaatgtccagttcaatttacctactccaaacctcaacccctctattttagagtgtattcctaaatgtattacggagcagaataattcaattctcagtaagatgccagatgaagaggaaattaaaaatgcagtactgagcctaagtggtgctagcacaactagtccagatggttataatggtgcctttttccacaactgctgggatattttcaaagaggatgtcgttgcttttgtgctagaggtcttcaaatggaaagttttaactaaattcttctctcatacttgtttagttatgattctcaaaattgattctcctgctagttttttagagtttagaccaattagtttgtctaacttctctaacaaaattatctctaaaattctctcattaaggcttaaccccttgttgcataaattactttctcctaatcaaagtagttttgtgaaggatagactaatctacgaaaatgttttattagcacaagagactattcacaatatttctgacaagaacaagggtggtaatgttgtcattaagcttgatatggctaaggcctatgatagaatatcatggccctttctttactctgtgttaagtaaatttggcttctctaaacattggatagagatggttcataatttgatttcaaatgtgtggtactcgatcattattaatggatctagacaaggttttttctcttcttctcaaggtattaaacagggtgatcccctttccccttccctttttattatagctgctgaagttctctccaggtctcttaataacttgtacaatcaccctgattttattccttttgctatgcataataaggttcctaaagttaatcatttagcctatgcagatgatattgttattttctgtagtggtaatcctaactctattaagcttgttatgaagcaaattggtaactatgaggaaagctctggtcaattggttaacagagacgagttttttcctcattgttcctaagccagcaacagatatgattaatagaattaggaatttctctggctttatggataagaattttcctcttaattaccttggttgtcctctttgtgtgggtagaaaaaagactgaatattttaacatcttgcttagtaaaataatgaaaaggctcaacggttggcaaggcaaactcttgtcatatggtgatattcaaaaatattttgctaactttttctggggtaactcatatatatggctacagcctacaggctacttctctcttttactactcatcttttgtttaagatgtaattaatgcttaaatacaatattactttgttgacgaggtggacataatcttatatatctttgttgcacatggctcgcgagaagctctcaaaagagtgaggggagaacattatcaacagataaagaattgaactgtatcccatgtgtgtttggtacaatatgttaccgatttttataaccaatcaaacgctagcaaatgatccagaaaatgcttttatgatgcaaagcacaatccgcagaatacattttttgaggaaaatgtttttcacccagcaaaatgcacaaggaaaaaacgatgtttttgcactatatgtattctattatctgactttttttagttccgaatgtagatgaattgcaattgatttctccttcttatttgaagaattaacagttatagtaacaactggaggttccaaacatgacaaaccgatttggctttggctatggaatttatcacatctattttcctttttcttgtcacattttctgatgatgaagttgatgaagacgacgatggcttgggtgagcgcgtaagaccacgcctcgctgttactctagccggcttaggcatgtttgatccaattaagtgaggaaaattgagctgagctctcgagccgcggattttgaaagcggcttgatcgtaagccaatgctgcatcttctggggtctcataagttcctagccacaatctcgcacctcttctctcagggtcccttatctccgccgcaaactttccccacggtcgccgtctcactcctatgtaccgcctccaatcttgcggcgcgtttttctcacgcgccaccacaagcccctttctttcctcctcagactcggacttttcttcgagattttgtattgtgtcctcaaagttttcatcccaaagggaggtgttcaagttattttctgctgaaggggagctgccaaaacttgagataggactactaggcgatgcgttatttgaactcatcggcgaaagaatatcaaaaaaatctgaatcattcagaagctgttgctttatggattcgcagattaaaatcagagaaagagaaggttacatgtgctggattcattttcttttctctagagttttggaataaagttttcttgcactcacttactacaacaacaacaacaacccagtataatcccactagtggggtctgggaagggtagtgtgtacgcagaccttacccctaccttgggatagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgtttccaatagaccctcggcatccttccttccaagaactccccaccttgcactcacttactagggtttattaattgtggatggacggtaagggttcatatcctacgtctatttatacgcttggcatataattgtagctctagtccctaccttaatttattttcttctggaatttctatgaaagtaccattttaagcacatgtatggtatgctttttagtttttattatcctaacatttgcgtggaataaaataatgtactgatcttcaatttcaagaaatgatatacaatatattccttcttgagatatggaagatgtttgcgcataactagtcatgacattcggtatagggtaaaattgacttatattaagtgatcgattcgtagcgtgacacgtgtaaccgaaaacatgtaaaaagaaaatcgaataattacccgtatcgggaacaacaaatgcagttgacatcggataaaccccgaagggagcatcaacgtgaggatatcgaatatttgtcatcagatatcatttaatgaagaatatttcctggcattaaatggggagcaattgcagagaatatttacgttcatagctcgccattacatattcatcaatgacccatatattatcatttaataagagcttgatcctaggatttattttcctaggtctagctatgaatagtaggcttaacagccattataacacacaaaattctgggcaaaacttatgctacgttccattctcaagctcaataagataattttatttgttattttatattgttcttatttttgtccttggagacaccgctcccgaaaccaaacatgccattttcttcgatttaaccgctaagtcttatttttaatcttatttatttatcattttggatcaaattagttctcttgtctataaactacataacaaatttaattgtactgttttacgggtaaacagtttggcgcccaccatatggcttagacagtagcgtaattgagttgatccttgcgtttattactaacttgtttgattctttattccttagcaagaaatcgaaaatggcagctaacgatgtcaacatcgcacacaacattgaggcacatgagaatctgcctcaacatgaggattcaatcagtgagacccacaacgagggggacgaggtaacccccgtccacggagaacgatacctccgacatgtacgggtgccgactcccgatgatgtgaaagatgaacatgttgcggacacagtaaggatcctaagagaacaatagaaagccatcatgggccacctctcaaggtaggatcaagtcatgacggtacgcttctaacaacacaaacggaatgagtctggttcttttcggtgctcccgcaaatcaaacggttcaaagagttaaaaacaataccccgatgggtgaggtcgatttcgatggtgctagggggaccgatagcggatttggtaatgataacagcaatgatccatttaaaatcgagctcatgaggtttatgagggaaatgaatgagcatgtggataaaaacataaaggagtttcacgcccgaatagaccatatttcgggtgcacccccagttttgaagggtccgtattcgaaaaaagtatactccgatgtcgttcaaatcgagcgcagcactagagttaactccgaagagtttcaagataccggacataccaaagtacgatgggaattcaaacccttaggatcatatcacaacttatataatgacggtgaaatggaatgatttggatcagcatgagatcgagtcgattctgctgaaaaggtttggagaaaccctcatgaagggggccttgacatggtattcactcttacccgagcattcaacagattcttttgaaatgctcgcagattcgttcattaaggcccatgccggagccagaaaggtccaggccaagaagggagacatattcgggatcgcataaggtgagtttgaattgctgcaggaattcatgatcagattccagaaagagaggatgctgctactggccctaccagacgagtgggcagcagaggcattcaccaaaggtttgaatccgaggagctttgacgcctcccgaaagaagaagaaaagcgtgctcgaattccagacgactacatgggcagatgttcataaccgctatgagtcgaaaataaggatagaagatgatcatctcgggttcccgatatcaaccaaggggcgggaccgagacaagaacaaggataagttcaaaggtgagtttgatatagaccagagatcttctaaaggtcgtttcatgccatttgagagaattgaaggacacaacaacaaagggttccagtactcagacaggctggttcctgacagaagaactgaccgaggttggaataatagatcgttgcaggaaaaataggtatcggggacccgagattcctcatatcccaggttgtcgaattacaatttcaacattagtgtagtggagttggtatcgacgatgaggaatatcaaggaggcgcggttcctgaagccaattagatctgaccccaaccagagggatcataatcaagatcaccttattcgaagtggtaggcggtgatatgggctataatataatcctcaaaaggccatggttgcatgagatgaatgttgtgccctcattatatcatcaactattgaaattctcgaccccgaaaggaatcaagcaaataagaggagatcaactggtggcaagagaaatgaacgcaatgttgatttccagtagtaaagggaaggaacctagcaaatagaaattaccgaaatcgacgccttctcccctgaccaatgaagatgagtgcgaggagtcgtcggaatcccaccgggtgctgcgatattttcaagtgctggaggagacggatacaacaaaattcactgcagaagaactcgagcaagtggcgttattcgagaatttattggaaaggaagttccacctaagaacatggctcaatcccgaactcaggtctggatttattaatttccttaaagctaacattgattgttttgcatggtcgcactcagatataacaggtatcctattagaggtggtcgtgcacaagcaaagcctggacctgaactttccactagtaaggtaaaggcaatgcccaatagtcgaggttaggaataggtttgttaaagaggaggtaacccgactacttgacatcggttcaatctgggaggtaaagtatcccgaatggttagctaacatagttgtggttccaaagaaaaataaaacatttttagaatgtgcgtagattacaagaacttgaacaaggcgtgccttaaagactcgttcccaatgttgaacattgatcaaatgattgatgcaacgaccgggcacgagttaatgagttttctcgatgcatactcggggtacaatcaaatcaagatgaacctggaggtggacttgattttactaaagatgatgagaacgtgaactcacaaccatttatgcattggagagatcgttaaatctcgataaaatcaaagacatcgatgacatctcggaccatctaacaagcgtaaaggaagtacagaggctaaccaaaagattggccgttctaagcaggttcatctctcggtcctcacaaaggtatcatcacttcttctcacttctgaagaagaagaacaatttcaaattgtcacgacccaaaatctcaacctgtcgtgatagcacctaacacattagtagacaagtcgacaatcacataacaactatgcatttaaattaaaaacatgatttaataggttcaatagtgaaaagtctcatctacaacaatcccaaaatcttggtgtaatcgagtacatgagctactagaacaatactaaaataaaataaaagaaaagagagtcaaggtctacgggcatcaaagcatctaccttgaagtctatgaacatatactatgaccactccaacaatcatcgcatctagatgtacttggatctgcacatgaagtgcagagtataacatgagtacaaccgacccaatgtactctataagtaacaagactaaccttgggctgaatgaagtgacgaggtcataaagatatagtatgaatcaaaataatgacaacacatatataacaaaataatgacagtaataactcaaagaaacttccatattcagctggtacacagtacagagatttaggcatgctttcaagttcaatagtttaagctcaacaatgataaaatatgccaagtacaactagcaagagaaatgttacatctctattcctacatgtcaaatatgtatgtcaaatataatgtatcacagtgataatgtaacaacccgacttgtcattttgaacatctacgctcctttcaacaatttgaagtcttgaacagcttcgtaatgtgtattatgacttgtgtgaattgtcgtctttggttttcggatgattcagaattaaattgaaagaacaatccttttttagaagcttaaatgaaaagagttgaccgatttgactttttgtgcaaacaactccggaatggagttttgatggttccaatagattcgtattgtgattttggacttagcactgtgtccggatattcattttgaagtccgtagttaaatttggcttgaaatggcgaaaatagaaaatttaaagtttggaagtatgaccggggagttgactttttgatatcggggtcagaatcacattctggaaattgtaatatcttcgttatgtcatttatgacttgtacataaaatttgaattcattccggatttatctgatatgtttcggcgcgaggtttgaaagttgaaagatttaaagttcattaagtttcaattggggtgtgattcatgtttttagtattgtttgatgtgatttgaggcatagactaagttcttatgatgttttaggacttgttgatatatttggttgaggtcccgagggcctcgggtggatttcggatggttaacgaaatttaatttggatatttatagaatgtttcgacgtcgattcttcaagaatatgcggtatcatagtaataaaattagctccaaattcggttttgaatgaagcattagatccatattgaaattacggagccatagcaaaaagaatcgtcgaattcagacatcgtatgagaaagttgtgcccatttccatgtcgagaaaaaacaaaattccgtcaccaacgcccagggtagcatgaggcgctagccctggcactgggatgttttagaggttctggaaacagtgccacaggcagcgccccacgccacctgtggcgctcaaagataaaaaaatccatataaacgggaggttttgccatttttgacaaaaatagagttggggagctcgattttgggcgatgcttagaggcaaatttcaccacacaacttgggataagtgttcttgactcccttgtgattacatttcatgaattaatctttgtttcagcgttagattattgatttttcaagagaaatcagagaaattttctacaattccagaaaatgaatttgggagatttgaacatcgattcggagttggatttgagtaaaattagtatggttggaatcgtaattgaataggttatcggattttgtgagtttcatcggatttcgagactgggccccactgtaaatttttcgagtggagttggaaatttttgtaaaatgttaaattgtaagcattggagtaaattgtgattaatttgcacgttgtttgaattgatacgagtcgtttggcttgaattgaggagataggaaggcgtatggaggttgatacacgcggaatgtaatttatggagtattgtacagcttgctcggtattggatttgacttgttcgaggtaagtaacacttctaaacttggtgctgagggtatgaaccttgaatatgcgtgttatgtgtttggtgttaaggtaacacacatgctaggtgatgggcgtgtgggcgtgcaccgtgtgaattgtaactctgttacttctgtggtactgtgtagttacctgatcttatttgtagccatgaaatctctacttactagagccattgagctgtgatccatgttaaaaaccatgtctaggctacatgtttatttagttgagacccactgaggtcatttctgctattgagttatctgcttacattggatttacatactcagtcatacacattcatatgcatatcatatctcagtctttgctactatttattgatacatcacatcattatttttgggctgattcttctcatgacattgagagcctgagagactggagagattgatgactgagtgaggccgagggccttatggtgaggatgtttatgggatcgggtttcacgccgcaatatattttattaatttatgccatgattggcttgttatagtgcttgggctgaaggagcccctacggagtctgtatatacccccagtgagcacatgtacctattaagtgtgagtgccgagcgattggaaggattgagtgactgtgaggactgagtgagtgggaggactgagtgaaatgacactttgagagtatgcatatggttatattactgagttgcattgtattgacatacacacttgacatacatgcatagagatgcatttttcctcatgttgtacgatattgcgtcattcatgacttcacatactcgttgatatgtaggcatatagatgtattttcctcatgccttttgaaaatgaaacatcctatttgttgttgaaaagtttttgggaaaatcataattttagaaaacatactcatattttggtgattttggtaaacgaattgggttttcgctgatatatttaaaaagcaggcctatttttctggaactgtgaacgagctgaccattttatctctgagctacttattttattacttccattatgttgttatgattttttgttagctattggtgttggaccccgatctatgttccagctcgtcactactttcaacctagggttaggtttgttacttattgagtacttgggatcggctgtactcatactagacttctgcaccttgcgtgcagatataggatgttgatgttactgtgatcgaagatagctggatttgaagacgtacccgctttccggttgtagctgcctcttgtttatggtagccttagatttataaaaatctgtttatgtacgtttcgaacagataatgtatttatttcataccacctttgtaaattctaatcttagaagctcacgatttgtactaccagtccttggggagtatattagagttagttaattattaattgaatcgcattgttgttatttggcttacctagcgggtgaagttaggtgccatcacgtctagttggattttgggtcgtgacagataatcccaagtactcacactctcaaagtactcaatatgtctaactcatttctcactcaacacacataatcactcaacactgtacaggtacttgaatcaatgcccctcaccaaagcacgtgtatataaatcattgtacctacgctcactgctggtatgtcatactccagaggggcagatcccgcccaagcgctaatataaagcttataaggcttgctgcggcgtacatccctatccacaacaatgaataagccaataaggcatgttgcagcttacaaccggattcataataataataataataacaataataataataataataataataataataataataataataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataagaataataataataataataataataataataataataataataataataataataataataataataataatagatataaaaccaatatggcatattgtggcatgcagtccgatccaccatatcactcacaatacgactttcgggccccaactcagtcatcaatctctctagtctcacaggctcacaaatcgcatttcactcagcccaaacaatgataacataatgcaacagtaatgataaacatagactgatatatgatatgcagatgaataaacatgaccgagtatataattgcagtttaagcaaataactcaatagtagaaataacctcagtgggtcccaacataataagaacatagcctaaacatggtttttaacatgaatcgcaactcaattactctaacacgtaggaatgacacagataaaactcgactagataacaacaaagtactatagaatcaatcgagtcataattaccacggtgcacaccgatacacccgtcacctcgcatgtgcgtcacctgaaaaccaaccatataacatatattccagggattcataccctcagggtgtatgggtgtgcaccgtgtaaccaaccatataacacgtatttaagggattcatacccttaactaccaagtttataagtgttacttacctcaaagtgcgcaagtcaatgatccaacaaacccttgcttcgcgaatcggcctccgaatgactcgaatctagtcacaaacaacttaatataatcaatacaagctatagggatcgatcccgaacgataatgctacgttctttaaaccaaattcaaaaagtcaacctaaaatttcaaccataggcccatgcctcagtatccgacaaacttcacaaaattcgaacacccattcaataacgagtccaaccatacctaaatcattcaattctaactaaaactcgaccatcaaatccccaaatcttactttccaatacctagtccaaactttctaaactttcacctcaaaaacacacgatctaggtgggaatatcaatgggtattcaataataatggacaaaagtgatcaaaagtcacttacctcttgagttatagtgaaatccctctcaaacatcacccctagccgagctccacaactctccaaataagaaaaaccacgataccctttgaaatataacacttccagtcaatccacacctgcggtcacttaaccgcaactgcggcactagaccttctagtccacttccgcttttgtggtcaaatatgttcttttacgcacgtgcacctgcgccaaaatgtccgttttttgcgaaaaccatgaccatactacactccgcttctgcgctccacttcccgcatctacgagctcacagatgcggactaaccttggcacatgcgcatcccccatccccccagcattttctgtacctgcgatagcctgaccacttatgtggtctcgcacctgcgaccaaatcctcccaggtgcatttgcaccacttgcaaatctttagcatttcctcaattcaaaacatcaatccaatttcaatctgaatcattcccaaggcctgcgggaccccatccaatcataccaactcatcctgaaacatcataagaacttagtcaaagactcaaatcacatcaaacaatattgaaaacacgaatcacaccccaattcaagcctaataaaactaatgtatttccaacttccaaaactaatgccgaaacctatcaaaccaattccgaataacctacattttttcacacaagtcataaataacacaataagcctattctaacttcctaaatctaaatccaagcccgataccgacaaagtcaactctcaatcaaacttctcaactttccaacttttgccaattcaagccaaaacgacctacggacctccaaatcaatatctagacatactcctaagtccaaaatcaacatataaagctatcgaaaccatcaaaattgcattatggattcatttactcataagtcaacatcgggttaattctttcaacttaagcttccaactttgggactaagtgtcccaactttggaagagggctcaacttgcccttcttcccgaacctcatagcactcttcatgggtgaaactctaagtaataccttctctcccaccatataggcaacatcacaagccttatgatcgatgtaacacttctatctagaatgtaccgtgcgaagctgatcctaaatcagcttgaccttttccaaggcatcttgaaccagatccgtgcttaacaacctagcctcccctggctcaaaccacccaactggagatcgatatcgccttccatataatgcctcataaggagccatctgaatactttattggtagttgttgttgtaagcaaactctataagctgtagaaaatgatcccaagaacctccgaaatctataacacaaacacgtagcatatcccccaatatctaaagggtgcgctcggactatccgtccgtctgagggtggaatgttgtactcaactcaactcgtgtgcccaaatctcattgcactgctctccaaaactgcgatgtgaattgcgtgccctgatcagaaataatggacaccgacacactgtgaaggcgaacaatctcacggatatagatctcagctaacctctccgaagaataggtagtcatgtccggaatgaaatgtgcggacttagtcatccagttcacaatcacccaaatagcatcaaatttcttcaaagtccgtgggagcctaaaaatgaagtccatagtgagacgctcccatttcctctcaggaatatcaagcctctaaaaaaaactgcccagcctctgatgctagtatttcacctgctgacaattcaagcaccgagccacatactccactatatctttattcattcttctccaccaatattgctgcgtcagtcctgatacatctttgcgtcacccgaatgaatggaataccgtgaattgtgggcctcctcaagaatcaactcacataacccatccacattgggcacacaaatccgaccttgcatttgcaacaccccatcatatctaatagaaacctccttggcatcaccgtgttgtaccgttccctgaaggacaaacaaatgggggtcgtcatactaacgctctctaatgcgctcaaataagaaagaccgagaaaccacgcaagctagaacccgactaggctcctaaacatctaacctgatgaactgatttgccaaggcctgaacatctgatgcaagcgatctcttaccaacaggaatatatgcaaggctacccatactcaccgcttttctactcaaggcatcgaccaccacattggccttcccgggatgatataaaatggtaatatcatagtcttttaacagctccaaccatctttattgtctcaaatttagatccttttacttgaaaaagtgttgtagactccgatgatatgttaatatctcacaagacatgtcgtagaggtactgtcaccaaatcttcaatgcatgaacaatgactgctaactttaaattatgaacagggcagttcttctcatggggcttaaactggcgtgaaacataagtaatcaccctaccctcctacatcaagaaacactcaataccaatccgagaagcatcacaatacacctgatatgaacctgattctgaaggtaaaattagaactggagctgtggtcaaggtagtattgatcttctggaagctctcctcacacttataagaccacctgaatggggaacccttctcggtcaatctagcaaaggtgcataaatggacaagaaaccctccacaaaacgacgataatatccggccaagccaagaaaactccgaatctcagtagctaaagacggtctgggccaaatctgaattgcctcaatcttcttcggatctaccttgatcctctcactagacatcacatgtcccaagaatgccacttaatcgatctagaactcacacttggtgaatttagcataaaacgtcttttccctcaacgtttgtagtacaatcatcaaatgttgcacatgctcctcttggctacgtgagcacaccatgatatcatcaataaatactatgacaaaagaatcatgatatgactggaatacattattcatcatatgcataaatgttgttggggcattaatcaacacaaaagacatcataaggaactcatagtggccatagcgggtcctgaatgctgtcttcaagatatcagaatctcgaatcttcaactagtgatacctagacctcaaatcaatcttagagaacactctagctccctgaagctggtcaaataagtcatcaatatgcgataatggatatttgttcttaattgtaactttgttcaacttcctttaatcaatgcacatctgtatagtactatccatcttcttcacaaacaaacccggtgcaccccaaggcgacacactaggcctaatgaaccccttatcaagaagctcctgaagtttcattttcaattccttcaactctagtggtgccatatgatacagaggaatataaatgggctgagtgcccggtactaagtcataaccaaaatcaatgtccctgtcgggtggcatgcccaacaggtctgtaggaaacacatctagaaagtctcgcactatcggaatagaataaatggtaggagtatcagtaccaacatccctcacaaaggccaaatatgcctaacaccccttcccaaccatccgttgggccttcaaatatgaaatcactctactgggaacatagtccaaagagcctatccactacatcctatgcaaccctagcatcgcaacgtcatagtcttagcgtgataatccaaaatagcatgacatggggacaaccaatccatgcctagaatcacgtcaaaatccatcatactaagaagtaaaagataaaatctcatctccaatcccctaatggtcaccacaaatgactgatacacacaatccacaacaatatactcacccaccagcgtagatacaagaacaagcgtaactaaggactcacggggcatatccaaataatgagcaaaatatgatgatacatatgaatttgtggaaccagggttaaataatatggaaacatcctcgtggcttactgaaacaatacccatgatcactgcgttcgaagcaacgacctatagcctatcaagaaaagcatagcatcgagccttaccaccacgtgatcggcctccccatctagggcggcctctagctgcctaagccccatcttgtgttggctgagtgggtggtgatgtaactggtacaaaagtcatagctcgacctctttactgaactgtacatcccataagacaaggacaatgcctccttaaatgccctaaatctccacactcaaagaaactctgatctgtcaatggcagtagggactaaatcggacaccgagaatcaaaataaccactagatggatctggtacagataaaccctgaactaatggagaacaggatgaactctgagctgggagggcattgatgactaactaggacgagcattgtatgaaccatggctagctaatgcaccacgatgaacatgacgagtcatcttagtgggcctatagggatgacccctgttgtagtgggactgtcctccatatgagacactgctaaaactacccaaaccacgaggcctcttggactctctctccttacgctcctgactacgaacctgctctaggcatctagcaatatcaaccacctcgtcaagcatcgcatccaatgcaatctctcgagtcatggtgaagtgtagtccataattgaggccagcaatgaacctcttaatcctctccctctctatgggaacttaccataccgcaggatgagccaactctaaaaatcgcatcttatactggggaactgacataccctcttagcatagctgatcaaactgcctctgcaactcttctttgcgagtctgtggaacaaacttctctaagaagagaactgagaactcatgccacgtaagtggtgcagcgtggctggcctgctcaactcacaggcctcccaccatctgtaggctatccctatcaactgaaaaatagtgaataaaaccccactagtctccaaaatacctaccgtgcgtaggattaactagcatctgtctataaaatcctgagcatcctctggctcggacccactgaactctggaggctcaagcctcccaaactgctctagtctcttcttctcctcatcactcataggtgggccaacctaggcccaagagaatgaaatcgattagctggtagtacccccggtgtctggagtccttaatctaccttctctggagtacgggcggcgggagtctaagcacctcccctggcctaagaagtagctagtgcggtcggaactgaaactgcttgagcaaggcaagtgcatacaatcaatatctgggccaaagccttttgaatgccttgagtcataatgggcataactggtgcatgagttgctcccaccggctcgaccacatctggtacctactcctaagatggagcaattggtgggtccacatatgctgctctagctgcagtacgagctggaccttggcctctaccatgaacccggtcttttgcggccctagatggtagtattggtggctatctgcctgatctagtctaacatgtcctcactatctgtaagagaatagaataatagaaatttagtttccgaaattaacaaacccgcacgacaagaatacaagaaaatgaagtttcccaatgattcggtagcctctcgaagataagtacagacgtctccataccgatccgcgagactctactaaacgtgctcatgactcgtgagacctaagtaacctagtgctctaataccaacttgtcttgacccaaaatctcaacatgtcgtgatggtacataacacattactaggtaagccgacaatcacataacgactatgcatttgaattaaaaacatgatttaataggttcaatagtgaaaagtctcatatataactgataaaaacaactacaactcagctacaacatacctaaaatcctggtgtcaccgagtacatgagctactaagtgtcaacatagtctgaaactctagtacaacaatctgagaaaaatagaacaatactgaaataaattggaagtaaggagagtcaaggtgtgcgggcgtcataacagctacctctaagtctccgaatatgtactatcaccactctagcaatcaccgtgtctagatgtacctggatctgcacacaaagtgcagagtgtagtatgagtacaaccgacccaatgtactcaataagtaataggactaaccttgggctgaaagcagtgacgagctcagaaagatatagtccggatcaaaataatgacaacacatatataataagataataatggtaataactcaaagaaacttccacattaagctcgtacatagtacatagatttaggcatgctttcaagttcaccaagttaagcttaacactaataaaaaatatgccaagtacaactatcatgaggaatgttacatctctatgcctacatgttaaatatgcatatcaaatgtatgtatcacattgataatcctaagtactcacactctcagagtactcaatctgtctaactcatttcctactcatcacccacaaacactcaacattgtacgggtgcctggcattaatgcccctggagaggaggatccttcccaagcgctaactgctatgtcagactctggagaggaggatccttcccaagcgctaatataaagactataaggcctactgtggcgtgcaactcaatcaaaaataatcaataagctaataaggcctgttgtggcttgcaccccgatccataataataatagatataaagccaatatgacatgctgcggcgtgtagcccgatccaccatatcacttataatccggctcttaggccccaactcagtcatcaatctctctagtgtcatgggctcacaaatctcatgtccatcagcccaaacaatgataacatgatgtaacagtaatgataatagagactgagatatgatatgaaaatgaataaacatgaccgagtaaataattgtagtttaagaaaatagctcaacagtagaaataacctcccaacagaataagcacatagcctaaacatggtttctaaattgaatcacaactcagttactctcacacgtaggaattacatggataacacaaaactagatagctacacagtaccacagaatcaatcgagtcatacttaccacggtgcacgcccacacgcccttcacctatcatatgcgtcacctcaacaccaaccatataacacatattccagggatttataccctacgtataacttttagaagtgttacttacctcaaagtcgtaattcaatgctcaaacaaaccattgcctcgtaaatcgacctcagaacgactcgaatctagtcacaaacaaattaatataatcaatacaaattataggaatcaatcccatatgataaagctatgttctttaaccaaattcaaaatgtcaaacccaggcgcacacctcgaatcccgacaatccaaaaattcgaacactcattcaataacgagtccaaccataccaaaaccattcaattccaaccacaaatcgaccctcaaatccccaaatcttactctccaatacctagtccacaattccccaaatttcacctaataaacacacaatctaggtgggaatatcaatgggtattcaatattaatggacaaaagtgatcaaaagtcacttacctcttgagttgtagcgaaatccctctcaaacatcgcccctagccgagctccacaactctccaaatgagaaaaaccaccaaacccttcgaaatataacactgccagtcaatccgcacttgtggtcattttatcgcatcttggccctagaccttctagtccacttccgcttatgtggcccatgactatactgcgctccactataaggcctaatgcagcgtacatctcaatccacaataatcaataagctaataaggcctgctgctgctcgcagcccaattaataataataataataacaatacatataaagccaatatgacatgttgcggtgtgcagcccgatccaccatatcacttataatccgtctctcaggccccaactcagtcatcaatctctctagtctcacgggctcacaaatctcatgtctatcaacccaaacaatgataacatgatgtaaccgtaatgataaccgaaactgagatatgatatgcaaatgaataaacatgaccgagtacataattgcagtttaggaaaatagctcaacagtagaaataaccttagtgggtcccaacagaataagcacatagcctaaacatggtttctaaattggatcacaactcagttactctaacacgtaggaattacatggataaaacaaaactagatagctacatagtaccacaaaatcaatcgagtcataattaccacggtgcacgcccacacgcccttcacctatcatatgcgtcacctcaacaccaaccatataacacatattccagggatttataccctccgtacaacttttagaagtgttacttagctcaaagtgcgcaattcaatgttcaagcaaacccttgccgcgcgaattggcctcagaacgactcgaatctagtcacaaacaacttaatataatcaatacaaattataggaatcaatcccatatgataaagctatgttctttacccaaatttaaattgtcaaacccaggcgcacgcctcgaatcccgcaatcaaaaaatcggaacacccattcaataacgagtccaaccgtaccaaaaccgctcaattccaaccacaaatcgaccctcaaatccccaaatcttactctctaatacctagtccaaaatttcctaaatttcacctaataaacacataatctaggtgggaatatcaatgggtattcaatattaatggacaaaagtgatcaaaagtcacttacctcttgagttgtagcgaaattcctttcaattatcgcccctagacgagctccataactctccaaatgagaaaaaccatgaaacccttcaaaatataacactgccagtcaatccgcacttgcggtcatttaatcgcatcttggccctagaccttctagtccactcccgcttatgtggcccatgactatactgtactccgcttctgcgctccacttccagcatctgcgagctcgaagatgcggactaaccttttcacctgtgcatcccccagcccccagcattttctgcacctgcgatatcctgaccgcttctacggtctcgcacatgcgaccaaatacacacaggtgcgattgcaccagacttgcaaatcttcaacatttcctcaagtccaaacatcaatccaatttcaatatgaatcacttccgaggactcggggaccccatccaatcatacaacacatcataaaacatcatacgaacttagtgaaaaccttaaatcacatcaaacaataaagaaaacatgaatcacacctcaattcaagcctattaaaactaatggatttccaacttctaaaaccaatgccgaaacctatcaaaccaattccgattgacctaaaattttacgcacaagtcataaatgacataacagacatattccaatttctgaaaccaaacttcgggcctagtatcaacaaagtcaactctcgatcaaacttctcaactttccaaaccttcaactttccaactttcgccaattcaagccaaaacgacatacgaaccctgaaatcaatatccatacatactcctaagcccaaaatcaccatacgaagctatcataaccattaaaactctattttggagttgtttactcataagtcaatatccggtcaaccctttcatcttaagcttccaacattgggactaagtgtcaatttattccaaaatatccccgaaaccaaaccaaccatcctagaaagacaaataactataattgaacataggatgagtaataaatgggggaacgatgctacaatactcaaaatgacttgctgggtcattacacgaatagactccaaaatgtcagcaggccttaaaagacctgaaacgttatctatcaagccctccactactatcaaactaggggaaggtgaacaattactgataaatctgatggtctcagaagtagtggtaaatgtcgttttagtccaagaagataaaggtatacaatttcctatctattatgttagtaaaattttctcaggagcatagactcgctattcgaaccacaaaaagttgaccttagctctcgtagtcgcctctcgaaagcttaggccttattttcagtgtcacccaatagccgttatgataacttttcccttgtggaatgttcttcacaagcctgagttgtcaggccgattggctaaataggcaatcgagattagtgagtttgacattgagtattaacccaagactgtaataaagttacaggttctgcccaacttcgtggctgatttctatcccgggttaatgcttctagctgctaaagagggagtgttggtgtgagaaatgaaattaggactttggaccttcttcatagatagagcttccaatgtgaaaggatccaggcttggggtggttctaatcatgccctcagggaaaccctgagacaggcaattaaaattgttctgttaactaacaatgaaaccgagtatgaggcttttgttgcaagactcaaactggcccagggacttggctctgagcttatatagatcaaatgtgattcccagctggtagtaaaccaagtgtatgggagtttcgacctaaaggaggaatgcatgcaacaggatgtgattaaaagacattgctcacacgattaagggagtggtcgatcacacacatcccaagagaagagaacgtagaagtagatgcattggccaatttggggtcatctatggagatggaaggatctaactccggtactgtcattcaacttatgcactcggtgctagatatagctggctattgtgaattaaatacaaccaacctagtctaggactggagaaataagttcatcgagtatcatcagcatggcaagttgcccgaagacccgaaagtgtcccgatcactacacacaaaagcggctcgttactgccttttgagagggaaattgaataggagatcataccaaggtccgttggcctgatgtctaggagccccgagagcggactacttgatgagagacgtccatgaaaggatttgtgggaagcattctgctgcagattcgttggcactaaactggttagggtaggatatgactggccatgaatggaacaggatgcaaaagcgttcatttagaaatgcgacaaatgccagtgctatgcacagttggttcatgaaccgaaagaactcttgcaatcggtattttccccatggcagttcatgaaatgggggatatatatatagttagtcagcttccaccgaatcccacaaaagtaagattccttttaattttaaccgattacttcactaaatgggttgaagtaggtcctttccaaaagatcggtaagcgtgaagtgatcgacttcctatgggaacacataatttgctggtttggaataccaaaagagatttcctgtaataacggaccatagttcataggctcaaaagtcacaaaatttctcgaagatctaaaaatcaaaagaattacctcctcaccataccattcgagcgctaatggacagtttgagtcaaccaataaggtgattatctaaaacctaaaaaagaggtttgaagctgctaaaggaaagtaggccaaagaattaccgaaagtgctatgggcataccagacaacataaaagtcaagcaggggagagacgcctttctctctcgtatatggcacggaagctttaattttggtggaagtaggggaacaaaccttatggttgtcccgagaaaatgaagaaataaataacgagacatcgttggcgaaactggatctgcttgatgaacccagggacttggcacacgtgaagatagtggctcagaagcaaaggatggaaagatactattatcagagagccaatcttcattacttcaaaatcaggagttggttttaaggaaattgacccagaacactcaggaaatcaacgttggtaagctaggtctaatctgggatggtccctaccggattttggctatcaccgataaaggatcgtataagatggaaaatcaagatatagtcaaattgcccagcaattggaacgtaactcatctcaaaagatattactactaatggatgctatcaaaactgaaagtatgtgctgtacttgtttttccttcgatgagtttttatcccaatcgggtttttctggcaaggtttttaatgaggcaacaacgaaacacatactatgagaggagcaacatcggcaaagacctttaaatgacaaggcattgaaacaataaaccactatgggatggttaaataatctttggctcgatggaaagttccaaatggtaagctaagtttgccatcgaacaagattgccatgagaaccaggaactacgagaaccgggaacaataatgtctcatcggcaccagaaattacatggccagccccgaagaaataacttgtacaagttagccaaatgtattggcattttactagcaaacgaatgcttatatacttttgaagacaaaaggaataaaataaagtccttttattttaatcttgtttcttgtccaaacgatgagttgattttatcatttgaaagttaacaagaaaatttcaatacttatgccggaatgaacaagagacgccctcttcaagagcaccttaaacataagagggccctctcttatgaaaccctcatagtaaagggttgatttcggaagaatttatgcctagaacaaaaagttattagacgaaaatacactcgaagccttatctaaattcgacacaaaaagaataaactttgcgcaatacaacaacaacccagtaaaatctcactaaatcaaaagccttctttatttatcaaaatgccaaacgacataagtacaaaaatacaaaagaaaacaacaaaagaaaagaagaaaaaatctacatattaccgccgccagaactcggggggagagaggcatctacgtccctgggggaagtgggcagatcaaccaccggttcaggtcctgggctgtcacgacccggaatccctacctcggggtcatgatggctcctaacatctacttgttaggcaagtcagaatgaaaacgatataagtatgaagtatagtaaaataatactgaacaacgaagtcttaccatagcctagaagttggtgtcacgagtacatgaacatctagagtgctacaaatatggtctgagtaaaatccactattttgaaactcagaaaacaataaatgtaggagggaaggggacttcagtgctacggacgccatatagatttaccttaagtctctgttagagactgaatccgagcaaaagctactgaacaccgctaggagaaactactgtatttgtacaagaagtgaatagtatagtatgagtacatccgaccacatgtactctgtaagtaccaagcctaacctcgacgaagtagtgacgaggctaaagcgggccacttacaataatctatacgcagtaataataataataacagggaaggaaagcaggaaatggaagtaaagcaattaatttgcgaaaaatgaactcggacctcactattagaaagcctaaaataacaagtcccttaatctcatatcaaaatgctgaaatagatacaacgacaacaagtacaacacacacaattcgttgcggtgcgtaacccgatcctaccatatcattctttatcaatatcaattaccatgtatacaatccgttacggtgcgcaaacccatcccaccatatcatcatttatcaacatcaagtatccgtataaaattcattgggacgcacatcccgatcccaccatatcatcatttatcaacatcaagtatcctcccttattccactgtttcaattcattatctttcaatttccgttgcggcgtgcaacccgatccccgaacaatttcaaataacataaataatccaataactcaatttacaagaatttctacatcaaagagtaaaactgcaaggtaataaaggaccacgtaataatcaagaatccttaaaattcaaagtttctactttgcaagtttatcggtgtctaacacactcaacgattcacgcaaatgaaactacatcttagaatgcaacaagtattacaaagataatagtacaagtaaagcatgtgacaattaaggcgtgcaagcaaaataattaaggcaattagcaaatatgcacagagtcatggaagggacgaacaatttaatacaataataattaaatgacaaataacaattatggcatagaagtcaaataatgcatgtaagaattaaggcatggaataagataatttaagaaataagagaaaacatggaaacacttatcacctcgcatatacaccattttctcacataatccacacaacacatagttcaaaaatttctaattccctcaagtcaaggttagatccaagcctcactccgcaatcaactcaaagctcaaccagggtatttcttctaaaattcgcctccaaaccaatcaaatcaaatcaaatatagttcaaacaattcaaattaagctttagaaactatgcacgagtgaaaaatattcaatttttaagacctcgagcagctttgtaatacgtattatgacttacgtgtgtggtcaagtttggttttcggaggattcaggatcaaattagagaacaattcttatttaagaagcttaaaaataaagagttgaccggtgagttggcttttgagcaaacgactccgaaatggaattttgatggttccaatagtttcgtatggtgattttgaacttaggagtgtatccggatagttatttggaagtccatagttgattttggcttgaaatggtgaaagttacaaatggaaggtttggaagtttgatcgagagttgacgttggtgatatcggggtcgtaatttgatcccgagagttgtattagctctgttatgtcaattggaatttgcatgaaaaattttacgtcattccgagttaatttgatatatttcggcacgtgttttggaagttggaagatttaaaaattcatgagttccatttgtggtgcgtttcgtagtttcgacattgtttgatatggtttgaggcctcgagaaagttctcgttatgttttagtacttgttggtgtgtttggttgaggtctcgggagcctcgggtgtgtttcagggcgagttttgaacatgtttgggaattttggcactctcatgatcttctgggaacagttggagtgtgggggcacattttggagagctgaagcaaagcctcatgtgcggaccaaagaggaaatatgcggaccgtagatttcctcttacggccgcagataggggattctgcaggttcgatggtatcactttggaagcttgtatctttaaatttacaaggaatttgtagatgcgccaaaaactaaagttgtagtcctttgagtctggttttcgaaaaggtaaaccaatcatcatttggacatttgtacccaaagttatggtcaatttactgaagcctgctagtgtagtggctgttaaagtgcgactgcataatttggattgcgaccgcacaatttggattgtggccgcagaacttggaatatgcggtcaacactttaggagatcagatagttaccatataaataagggtttcatctcatttttcatttttggactttgggagctcggtttgtggcgattgttcttggccttttcaagaaattcatcggggtaagtgattctaactcggatttggttaatatacatgaatatatcattgttttcaatatttaattagtattttgagatgcaattgggggaaattatttaaatttcattaaacaaatttttggaatttgaaaggcgatctgatgtcggaattcgattatttttgtatggttgaacacatatcggaatgggtgttctgattccgtgaatttttctctagttccgaaatatgggccctacattgacttttggttgacttagcattattatccgaattttttttctatgaatcgtaactaatgtataaaaatattttgattagattggagctgtccgaacgacgtttcgcgcaagaaggctattttgggatatcggcctaactccgttaaggtaagtgtcttgtctaattttgtgtggttgaaaccaccccttaggatttgagatgattgtgtcattcgtgttatgtgaaggtcgtgtaggcgagttgacgagtgggtacacgacctatatgtggtatttgaccggtttggaccgttaggcttcttttatacaattgattgtaaatatcgttttatgattatatcttttgttgttagaattgtttgtacgtgctttacttgaaattgttagcacatgttccatccttgttgtcaagttcacccttgtatgctaatatttgattgtaatcactcgttgaattcatgctttacctgctacatgccttaattgtcaattgatgcccataaattgtgccttggcttatggattgtcatttccttgctatttcatttcgtgagctatcgtgtatcatttttcattagttgcgacttctttgtgtagcctcgttatttcttttgattttgtggtataccgcaatagatattatttaataatgagagggatcaggttgtatgccgcaacagatatgatttattattgtgagggatcgggttgcacgccgcaacaaatatgatttaatattgagagtgatcgagtttcacgccgcaatagatatgatttattattgtgagggatcgggttgcacgccgcaatagatatgatttaatattgagagggatcgggttgcacgccgcaacatatatgatttattattgtgagggatcgggttgcacgccgcaacatatatgatttattattgtgagggatctggttgcacgcggtaacagatatgattattattatgtgggatcgggttgcatgccgcaacatatatgatttattattatatgggatcgggtttcacgccgcaataaatgtacaaatatgaaattattgtgatattaaagttaattttgattttgattcttacgatgcatttcatgctaggacggttactacgatttcttaaatcacctcattgtattttgattataattaattaaccgtcaatatattaaaaatggaaaaatatggacttcttgtgtgagtcatgcatcatatgtgatatgttaagttgttttgaatttaggagaggtaaatgaaagaattttcaagttgttccacttgtgtgtctttcaaaaataaaactaatatcttattcgaagatctactaatttaaatggtgattatatttttactctaattgatacctcaacttcctcattatcttattgtcgtgtaatttatgtgaaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattacgttttactttaataaatcccatatttatatcgttaaaatttgattgaatgtcttaatttgtataaatgtaatattatattggatctcatatatttctaaactaaactcatttgatattctatttgcacaacctctccactattttaccttatttaaatcctaaattggcttaataactcatttgatgctttactatgttcaagttggaattgttcttaattgtgtttaaattattcatcatttcatggtaaggacgagagtaaaagcacgaagggtgatgctatgatatttttatattatatttgtactctaactgtgttgttacttaaatgcttgattgtttgctcgatgccatccgtgttctcattattttcattgttaatttgtattgaaaattcttctacgattggccttacattgatactcattccttgttatcttcatgtaacatattgtacaactttatatgtctggtatgtgtcttgacatggcctcgtcactactctaccgaggtaaggcttgatacttactgggtactgttgtggggtactcatgctacacttctgcacatctttttgtgcagaaccaggtacccctagagttattgatattcttgttagttgatcgagcattgtggtggagactcaaggtatactcgttgtctcattcgcaggctttggagtaacgtgtgagctttaaacacacactaaaatatgctcgctagtcgagtatagtataatataatatcgtatccatagggattggagttaaatagtattatcgcagtttgtagcgatattgctatctaagataatcaacagtttagaattatgtgattaaaaattaaaattaactaagaatctaaagctatttgacaaatgacaatcgaaacaaaattaagcaaagaagatatcaatgggagaaaatatgggttgattggataggtgcaagataaatgtctgggatttaactctagttgattcacttctaacgttaagtgagttcgaattcactcaataattagttcaaacgtttagtagaaactactctctcgattaagtctcaacctcacaatgtgaaccaatttaagctcgatgaagatatgcaagagttagtagtggattggcatttaggagaacctctatcgattatcctcctaattaggtctaaaaaataattctactagcctcatccgattactaagaagaattaatgaattcaaccaacaagataatgcaaagatatcataagtatgcctctattgattacatgaacatgtgtatatatatgcaacaattaaaacacccaaaacgattcaatacattaaaaaaaactagagttaatatccacaaacaaatatcaatacaccaaatccatcaatccctaaagaagaactactccatagatatggagtaattcatcacaaatataaagataaacataaagcgagccaaactcttgtcttgagtgaggattgaatgatgaatccctttttgcttttgcttttccacctcctcattagcttccttaggtctaagatgtgtcaaaagtcccaaaattaatgttttccatgtatttatactaagtagggtcgggcccggacgaaaataccttttcctacacaaatttcaaaaatactctgtaaaacatgtacaggcacgccgcattgggcgacgcgctaggcggggcggttgtgggaaaatcgagatagctgatttttccactttgcagaaattttgcactagcgctatgaggcccgcggggcggtagtgtaattttctaagagtgaattcattttctcatttttttgatgttcagagttggttttcgacccccgaacgcgatcccggcttaatcccttggacttttactcagacttcaaagctccaaatcacttgaattagctccataacattcacatagctcgaaatcctcctacaaggcacaaaatacaaaattagtgcgaaacataagtgattaaaactcaatctcaattaaagtgcagtaagttagagtgtaataggcgactaaaacacaagattataacctaccatcaacacaccacacttaaaccattactcgtcctcgagcaatcaaactacactttatatagacacgaccttattaaacaactctcctaactcatcacaccaagaataattaaaatagaataagcacaatagtgtaacatcttcacctccatatttgactaacaagtaccacgcattattaataacctgctcacttactctaacacagagatcaatgacattacctttccttcatgaatcaagtgccctcacaacaatagaaagtaattccacacacaataaactttaagaacaattaggaactcaagatagaaagaattcactcactctcagaaacaacattcatatgccacaaaagatgaaccataggcttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattaatcaagctcattcagtcaaggatcaagtaggactttaattggttgtaatgtagttgcgggacgggtatgatacatttagatgtaagagtgactaaacctccctaagcacttcaatacttacaattccattgttcaaaaccccacacttatgtcaaaccataactccaccttcacattaatatacattaactcccaacttcaagatttaccactatcatggaatattttgcacaacaatacaattattttttctttctctttcaattaaagtggctcttactttttcaaaacattgcacctttctccttatttcattatttccgctcaaaagccaaaccaaacaccccatacttcaacttttacaaagttcataaaatatttaagtgctcgtgagaggtacaaggttaaaatagatgatcaattcaatcaaatgggtagggcttgtaatgtggttgccaaagaaataggattacaagctcaaaggggttaactaagatacataacaattagctggataatagcatataactggctcaacaaagaaacgcctatatcacgtccaagagtgaataaaactactatttcgcgttgcaaacacacggggtaagttctagacatcaaatgcaatgcatagaatacaccaaaacccttacacacatggcacataactcactcaagattggactatcaaggtactctagtcaaagaaattaagcaaagctaaacttatacaatttaaggtacttatacaagagtcaaaaactgagcctaaccgtcaaaactaaagcactcactattctcaaggtataataaagttaagagatattgccttcaattcaaactgtagcacaaggtttcctactactaataaaaataaaaactaactacacccggttcaaacaaaacccttgaaaaagaaccacgacccaaagaaaaatcaaggaggaattattacactatctaacaaaataaaatctttttatcttttcctttcgactttagtccctcaagaaacccgtcgaatgatattcatcgtcaggaaaagtcgcaaattttaaatttttatggttttgtttttcattttacttatctctaactactaaaacaacaaaaataaattactaacatatatagatacatataattttcccccaccccacactttacgttgtggcatgtacccatgacacacaattaagaagcgcaaggtaaaggaaacttccctgaatttttagtcgggtctgaatcgaagtcgagctccattccacgtgcctgaactagtgcacacatccacacagacaacttcttctcagccttcttgaggtataccccacagttatctttctcactcgatgtagtcttctcttttgaactcttaactttccactcaatacttgtagccggtttctcctttttcacccccgtctctacattcatctcgaacattacagtatcctcacccactctaagcatgagttttctatcatgtatatctaaaattgctctacccgttgctaagaatgatcttcctaaaatgagagggacctccttgttctcctccatatttaccactacaaagtctaccggaaacacgaacttatatacccgcactagaacatcttccactatcccctcggatattatagttgtttggtctggtaactgcaaagatattggtgcagaccttatctatctaagcttattctccagttttctgtaaatagacaaaggcattaaattaattgaggcaccagaatcacacaaagacttatcaaatttaatagagcctaaagagcaaggtatagtaaaattacctggatctccacatttttatgggagtgttttttgcaagattacattgcaatgctctgtgagcttgactactaatgtctcttcgattttccttttctttgtaaggatctccttcaagaattttgcataagctgacatttgggagagcacctctgtgaatggaaaatttacattatcctgtctcaacatatctaggaacctctcaaattgtttatctagattctctctataaagcttttggggaaaagttaaagcaggcatgtgcttgctctcttcattagattcctcccttctcgaagtttcctccttcttctttttctctactcccttcttacttttcttcttcttaccatcttcaattttcagctccttcccactttcttttacaagtatcacctctttttggattggagtgagatctttcaacacttgtccgcttctcaatgtcatagcatttatagtttcgttgggattcttttcagtatcagctggcaaagtagctgggattctctcagataatatagttgcaatttgtcccacttgtctctctaagttacgcaatcctgtaccatgttctttgatagacgcaccttgagcatctaacctctcatctgtcttgataataaatgacttcattagatcttctaacccatactgaattggctgttgaggctaaaactgcggtctcggctgattcccaaaactaggagctccttgaaatctggagttattttgatgtcatgcatttgatgtacccccaggtgaactccatgaaaaactggggtgcttctgacccattgcattgaagttattattacccacaacattaacttcctcagttaaggcttgacactcatgagtagggtgtcctcttccacatatatcacaccctgcatgaggctcattgcgtattgaggctaaggtcagcttccttatttctttggccatggcatcaatctgtacctacactgatgtgttggcatcaacttggtgaacaccagttgctcttcttctttcagcaatttcagagggccactgatttgtatcttcagataactcatctagaattgtgactatctactctggagtcttcttcatcaacggacctctagctgcattgttcaacgttctgtgtgaggtcggtgtcaatccatcccaaaagtcctggagttgcatctagagttcaattctactatgttcacactttcgcactatctccttgaacctctcccaaacttcaaacacagtttcattatcgttctgatagaaattatggatttctcttctaaacttgcctgttttagctgaggagaaatatttagcaagaaatgttctggtcatctcctcccatgttctaatcgatccatggggcaagcttcaaagccagtgctttgcatcatctttaagtgtgaaggggaatacccttaggtaaactacatcttgtgactcaccattgtattgaaaggggttcattaactcctcgaagtccatcagataattgttttgatcttcgttcatctttcctctgaagagacaattgttttaaagtatttggagaaacccttgcttcagctaaaaattattagctgcaactggaggtggtctcacacttgataagccttgattatataccggtctggcataatcacctaacggtctcccttggacgtgagctatgtttctgaactggtctacacccaagggctgattccgagccatttttcgatccctcttttcttcatatgaaatttgtgcatctctatgttttactccttcagcatcctttgcagctttctctctgagttgggctgcctctctcgctgccaaatcaacaatatcattatctccagccatatcttctttggttgaggattgcccaaccttttctattttttcggcgagatttctttccttcctcaactatcgcagttgtttctcgatttctgattcgtatggttgcaattctttccaagaaaatcgagtgatgcaccaatctaacctgtagcctgcgaacagtcaaagaacaccaaacataaaaagagaaaaataaaataaaaataaaaattcttgaattagtaatacaaactatttcaaacactattaattgtcaatcctcgacaacggcgccaaaatttgcctagcttaaaacacacactaaaatatgctcgctagtcgaatatagtataatataatatcatatccacagggattggagttaaacagtattatcgtagtttgtatctagattactatcgaagataatcaacattttagaattatgtgattaaaaattaaaattaactaagaatctaaagctaattgacaaatgaaaatcgaaacaaaagtaagtaaagaagatatcaatgggagaaaataggggttgattggataggtgcaagataaatgtctgggatttaactctagttaattcacttctaatgttcaagtgagtctctcgaattcactcaattattagttcaaacgtttagtagaaactcctctctcgattaagtctcaacctcacaatatgaaccaatttaagctcggtgaagatatgcaagaattcgtagtggattggtctttaggagaacctctctcgattatcctcctaactaggtttaatcaataattcaactagcctctttcgattactaagaagaattaatgaattcaaccaacaagataatgcaaagatatcacaagttatgcctctctcgattacatgaacatgtgaatatagatgcaacaattaaaacatccaaaatgattcaatgcataaaaactagagttaatatccataaacaaatatcaatacaccaaatccatcaatccctaaagagaactactccatagatatggagtaattcatcacaaatataaagaaaaacataaaacgatccaaactcttgtcttgagtgaggattgaatgatgaaatccttgtgctttcgcttctccacctcctctagcctccttaggtcttagatgtgtcaaaagtcccaaaaataacatttttacatgtatttatactaagtagggtcgggcccagatgaaaataccttttcctgcgcgaaataggataatactctgtaaaattgcacaggcgcgccgcatggggcgacgcgccagcggggcattgtgggaaacttcagagagtttctgacaggcaggaaattacacacgcgccgcggtgtatttctcagagtacggatttgcttgattttgacatccagacgtggtttcgacccccgaacgcgatcccggcttaatcccttgggcttttactcagacttcaaagctccaaatagctcaaattcattccataacatctacatagctcggaatcactcctacaaggcataaaatacacaattagtgcaaaacactagcgattaaagctcaaactcaattaaagtgcagtaaattagagtaataagcgactaaaacacgagattatagcctaccatcaacaccccacacttaaaccattgctcgtcctcgagcaatcaaactacactttatatagacacgaccttttttaaacaactctctaactcatcataccaagaatatttaaaatagactaagcacaatacgtaacatctagcctcaagatttgactcaaaagcaccacgcattatttataacccgctcacttactctaacacagaggtcaacgacattacctttccttcatgaatcaagtgccctcacaacaatagagagtagttccacacacaataaaattaagaacaattaggaactcaagatagaaagaattcactcactctcagaaacaacattcatatgccacaaaagatgaaccataggcttgcccgtagtgtactactcaactaatcgagctcattcagtcaaggatcaagtaggactttaattggttgtaatgtaggctgcgggacgggtaggatacatttagatataagagtgactacacctccctaagcactttaatacatacatttcattgttcaaaaccccacacttatgtcaaaccataactccaccttcacatcaatatacattaactcccaacttctttaagcacaattacatcaagatttaccactatcatggaatatttttcacaatcaaaactttttttttctttttcaattcaagtggctcttactttttcaatacagtgcacctttctccttatttcattagttccactcaaaagccaaaccaaccaccccacacttcaacttttacaaagttcataacaaatttaagtgctcacgagaggttaaaggttcaaatagatggtcaattcaaacaaatgggtaaggcttgtaatgtggttgccaaagaaacaagattacaggctcaaaggggttaactaagatacataacaattaggtgggtaaaagcatataactggctcaacaaagaaatgcctaaatcacttccaagactgaacaaactactatttcgctttgcaaacacacggggcaagttctagacatcaaatgcaatgcacagaatacacaaaacctcacacacacatggcataactcactcagattggactatcaagacactctagtcaaagcagttaagcaaagttaagatcatacaatttaaggtacttatgcaagagtcaaaaactgagcctaagcgtcacaactaaagcactcactattctcaaggcataataaagtcaagagatattgcttcaattcaaaacatagcacaaggtttcctactattctacaaaacaaaaactaactacacccggttcaaacaaaacccttggaaaagaaccgcggcacaaagaaaaaccaaggggaattattacactacctaacaaaaaaatctttttgtctttttctttcgactttaatccctcaagaaacccgtcgaatgatatccatcgtcgggaaaagtcaaaaattttaaatttttatggtttttctcatttttctatctctaactactaaaacaacaaaactaaattactaacacagatacatacaacatacaattttccccaccccacactttaagttgtggcatgttcctgaacaaagtgcacacatccatgcagacaacttcttctcagccttcttggggtacaccccacacttatcttttcactgcagccttctcttttgaactcttcactttccactcaacacttgcagctggcttctcctttttcacccccgtttctacattcatctcgaaagtcacagtctctcacccactctaagcatgagttttctatcatgtatatcaaattgctctacccgttgctaagaatggtcttcctaagattaggggatctccttgttctcctccatcttcaccactataaagtctacaggaaatacaaacttatctacccgaactaagacatcttccactatcccctcgggtattatagttgtttggtctgccagctgcaaagatattggtgcagaccttatctctccaatctcattctccagtttcctgtaaatagacaaaggcattaaattaattgaggcaccagaatcacataaagacttatcaaaattaagagtgcctaaagagcaaggtatagtaaaactccctggatctccacacttttgtgggagtttgttttgcaagattgcactgcaatgctctgtgagcttgactactgatgtctcttctatctttctcttctttgtcaggatttccttcaagaacttggcataagctggcatttggagagcacttctgtgaatggcaaatttacattaacttgtttcagcatatccagaaatctctcaaattgcttgtccagcttctctctataaagcttttggggaaaaggtaaagcaggcatatgcttgctcttcagattcatcccttcttgaattctcttccttcttctttttctcagttcccttcttgcctttcttcttcttatcaacttcatttttcagctgctccccactttctttttcaggtaccacctctttttggataggggtgggctctttcactacttgtccacttctcagagttacaacatttaccgtctccttggggtttctttcagtatcagctggcaaagtacctgggatcctttcagacaatatggtggcaatttgtcccacttgtttctccaagtttcgcaccctgtgccaagttctttgatagctgcaccatgagcatctaacctctcatctgtcttgacaataaaggacttcatcagatcttctagcccaggctgattggattgttgaggttgaaactgctgcctttgctgattttggaagcctggagctccttgtccctggaatctggagttgttttgttgccatgcatttgcagtacccccaggtgaactccatgaaaaaaccggggtgcttctgacccattgcattgaagttataattcccacaacatttacttcctcagttgaggcctgacactcatgagtagggtgtcctcttccacatatatcacaagctgtgtgattctcactttgtattgaagctaaggtcagcttccttatctctttcgccatggcatcaagttgtacctgcacagatgtgttagcatcaacctggtgaacaccattcgcccttcttctttcagcactttcagagggccactgatttgcatcttcagacaattcatcgagaatagtgactatctcctctggtgtctttttcatcaaagggcctccagctgcattactcaatgttctacgtgaggccggtgtcaaaccatcccaaaaatcctggagttgcatccagagttcaattccgctatgttgacactttcgaactaattccttaaacctctcccacgcttcaaacacagtttcagtctttctggcagaagttatggatttctcttctaaacttgcccgtcttagctgaggagaaatatttatcaagaaattttctggtcatctcctcccatgttctaattgatccctggggcaagcttcgaagccactgctttgcatcatctttgagtgtgaaggggaatgcccttaagtaaactgcatcttgtgacacaccattgtattgaaaggtgttcataatctcctcgaagtccattagatgtgtatttggatcttcgtttcttccctctgaagacacaacaattttgaagagtttggagcaacccttgcttcaattcaaaattgttcgctgcaactggaggtggtctaacacttgataagccttggttgtagaccggtctagcataatcaccaagtggtctcccagccgggagctatatttcctggtctgcacccaagggtgattctgagcaattctccgagccctctcctcttcatagacaagttgtgcatttcgaagagctgcttcctcagcatctcgtgcagctttttctctttgttgggctgcctctcttgcagccaaatcaacattatcatcatctccagccataatttctttggttgaggattgcccaaccttctctatattctcggggagatttctttccttcctcaactgtcgcagttgtttctcgatttctggttcgtatggtagcacttccttcccagaagatcgagtcatgcaccaatctaacctgtagcctgcgcacagtcaaagaacaccaaacgtaaaaagggaaaaataaaataaaatgaattagcaactatttaaaatgatgctcgctagtcgaatatagtataatataatatcgtatccacagggattggagttaaacagtattttcgtagtttgtagctagattgctatccaagatgatcaacaattgagaattatgtgattaaaactaaaattaactaagaatctaaagctaattgactaatgacaatcgaacaaaagtaagcaaggaagatatcaatgggagaaaataggggttgattggataggtgcaagataaatgtctgggatttaactctagttaattcacttctaatgttcaagtgagtcgctcgaattcactcaataattagttcaaatgtttagtagaaactcctctctcgattaagtctcaacctcacaatgtgaaccaatttaagctcggtgaagaaatgcaagagttcgtagtggattggtctttaggattactagcctcctccgattactaagaagaattaatgaattcaaccaacaagataatgcaaacatatcacaagtatgcctttctcgattacatgaacatttgaatatagatgaaacaactaaaacacccaaaacgattcaatacataaaaaaaactagatttaatatccacaaacaactatcaatacactaaattcatcaatccctaaagaagaactactccatagatatggagtaattcatcacaaatataaagataaacataaaacgatccaaactcttgtcttgagtgaggattgaattatgaatccctttgtgcgttttcttttccacctcctccttagcttccttaggtctaagatatgtcaaaagtcccaaaaataatatttttccatgtatttatactaagtagggtcgggcccgaacgaaaacaccttttcctatgcaaatttggaaaatactctgtaaaaaatgcataggcgcaccgcatgtggcgacgcgccaggcggggcggttgtggggaaatccaaagagctgatttttcctctttgcaggaattttgcactagcgctatgaggcccgcagggcggtagtgcaattttctaagactgaatttgttatctcattgtttttatgttcatgcttggattttgacccccaaacgcgatcctggcttaatcccttggacttttactcagatttcaaagctccaaatcactcgaattagctccatagcattcacatagctcggaatcctcttacaaggcactaaatacacaattaatgcgaaacacaagcgattaaaactcaatctcaattaaagtacaataaattagagtgtaataagagagtaaaacacaggattataactgtaatgacccggtcggtcatttcgagagttataaccctgttttccccattcctacttctgtttgtgtcattcagctatattatgttatatcgggttaattggttcgagtccggaaggaactcggggtgaaatgagacacttagtctcataattgaaattttaagttagaaaaatggaccggatatggacctatatgtaaatgacctcagatttgtattttgatgattccaatagctccgtatggtgattttgggcttaggagcgtgtccggaatagttttttggaagcccaatttggcttgaaatgccgaaagttttattttgagaagtttgaccggggggttgactttttgatatcggagtcggtatccgattctgaaaattggaatacctatgtcatgtcatttatgacttgtgtgcaaaatttgaggtcaatcggaagtgatttgataggttccggagttgtttgtagaaattagaaattttaaagttcattaggcttgaattggggtttaattcatggttttagcgttgtttgaggtgatttgaggattcaactaagttcgtatgatgttttaggaattgttggtgtatttggttgaggtcacgagggcctcaggtgagtttcagatggttaacagatcaaaaattgaactagaataactgctgcaatttccttctgttggaaattgcttctacccagcgatcgatcctagaatcgaggggcatgatcgaagatacgatcgagcccagaatcgaggggcacgatcgagcccagaatcgaggggcacgatcgaagatatgatcaggcccagggtcgagggtcacggtcgaaggccaagatcgaaggcatgatcgaaggcatgatcgaaggcctaggaccgagaatcaggattgaaggccctggatcgaggcccaggatcgagggccaagatcgaggacctctatcgaagaccgaggatgtctgggcagaactataaaatcagggacttcgtctcattcgccatttttgaaaaattggagcttggggagagccggtttttggtatattttcaaggaaaaacttgaggtaagtcccttgttatcatttatactccataatattgaattatcatcgaataatccgagtagattacattattttgaggtgtaaatcggatattggaacatagaaatttggaaatacgatttatacatttgagggtcgagttgaggttggattttggtaaaattggtatgggtagactcgtgattgaaagggctttcagattttatagcttttgtcgggttccgagatgtgggccccacaggcgattttgagccaatttcgggttttggtctaattttgaagcttttcttgtggaatgcaatccattagcgtatattgatggtattatactgatttttaatagatttggagcatttggaggccgaatccagaggcaagagcattgcgaggtagagatttgaccggtttgaggtaagtaacgattgtaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgaaaccatttgatactcatatgttttagaaagaattcctgtaaattgggctgaataccatgtttgggcctagcgccaatgttgcttggacccttatgggttgtttcttaccatcctctcattgttttcgattgaaaattctatgctcagtcgtgtttatgcttgtttaccacataactcagttttatgactctattttatgcatataaatgttttgggccgaatgccctgttttactgaaatgcccgagtggcttgaaatatttatgactgagtgaggccgagggcctgattggtgaggatgagtatggatcggggctgcccgcctgcagcatacttgtgactgagtgaggccgagggcctgatttgtgaggatgagtatggatcggggctgcccgccagcagcatactttattattatcgcacgtgagttgtccgtgcagattatagcgcttgggatgaaggattccctccggagtctgtacacaccccagtgagcgcaggtacctactgagtgcgagtgccaagtgccgagtgcagagtgattgtgaggtatgcccgagtggcaagagtgatggtgaggtatgcccgagcggcaagagtgattgtgaggtatgcccgagtggcaagagtgattgtgaggtatgcccgaggggctgtttatgatttcatcatttttactcacatttgctgaacctttgtttgaaaaactgttggaaaaatatctttaaatgagttttactagaatcgggtttaaacgagacggtttgattcaaacactgatttttaagcatgttgtactttactgagatttcatgatatgaacgttatatgctttattgctcgtcactactgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagcggttattgagtgttctggttgcaggtttttttttctcggagacagtaaggtagttgttggcgatcgcagcccctgctcttctccctcttatctccctctagttatatttagctattttccaggctaagttagcctcgatattgttatacagattatagtagatgctcatgactagtgacaccccgatgtcgggcttttcttttccgcaaattctattttttcttgatttgaactcttttaaatggaggttttattttaattaaccttgaaattatctttgaaatgaaatatcagtttgttttggaaatgagtcggcctgcctagttccacgataggcgccatcacgacatggttagttttgggtcgtgacaataacctaccatcagtcaccttctgatattttcttgcactgttgattccactttagaacagttgtatttagaaattttatagtaaactctatagagcttgtgactagcactaccggttttgggattgtagggaatttctatttcagattattctagataaattgtttcgttattaccatttaaactgaactattaaaaaatgactaaaattattctaaagttggcttgcctagcaagttaaatgttaggcgtcatcacggtcgcgaaggtgggaatttcgggtcgtcacaagttagtatcagagctctaggttcatgggtgctacaagtcataagcaggtttagtagagtcttgaggatcggtacagtgacgtttgtacttatcttcgagaggctacagaaactaataggaaattccacttcttttattcattgtcatgcgatatttattcagcttgaggcacatatcttatattcatacacatccactcatgtatgacattgcgcactcgataacagttgtgcgctggcggttcgtgatgtcgctgatagactacaagggagccagggatgctcgaacatcgtctcaacgtgtggccgtgactgaagatgtagatgtattgaaggatcactcattgatttacgtgggggtgcaatggattcttgcatctggttgatgagtacgagctgtgaaggttagtattgtggatcaaggacgttgtgtcctttggcttcatgccaagtgggggagtccgctatagatgaacatattgcggggtcatgtgttatattagttctggcctgagatgtgcatatttggtactaaaaggttccccaaattttgcacatgtttaaggcctgagattttgatggtgataatgttgggacttgcagtatgactgcgtccttaataatcctatttcagtatcaaaggagttagagaaacaacttcaaatttatagaaggtctattcaacgtggacgtttggttgcggcagtatggggtgcttcagaggaagtacggtggttgatgagctgatgggctatgtggtttgtgccaagatttgtctgtacggagctttacttttgggatcgtcatgtacaaataggggggagtattaccccaaggaagaaacgaggaatatgtgaaaaaatgggtcagctcggtggtgctgggttagaatagcaaaggaagaaattggcctttggagagataattctccaccggtgtttgtggcaagtctatgaagagggtagaccatccaatgcaacaccacctacttgggctcatttttcagagatgattttgagggagtttgttccctagactctacggaatgcatggcgcatagagtttgaagaactgcgtcaggacaccatgacggtgtcagaatatgccatcaggttcaaagagttagcctatcatactcttactttggttcctatagccagagagcgagtccacagattcattaaaggactcagttatgatcttagattctgtatgactccagggctacaagctgatacttcatttcagcaagtggtggaaattgccaagatgttacaacgtgtttgaggtgaggaaaaggatactagggagaccaagaggtctcgaggttctggagaattcagtggatgctactgtcacggcccaatttcataataggtcatgatggtgcctaacaccgctgctaggcaagccaacagtgaactagtcatgtgatttcctctttttaacaaaattcttttccaattaatgaaactttccttaatttaaaaagaatttgaggaataccagatctaaaataaataacacgaaagcaactgtgtgcattcataatcatagaataaaaccaaatctgcaagtctactagtttgtgtgccaagacctagtgtcacaagtgtatgagcacctggtgtcacaagtctactagtctattgtccgaagtgaaatagacagaaaaatacaatcaaaagaaagactccggctgctgcagaacaggctcagaaggcatctcaccgtgaagcctcgaagtggtaatcaagtgcgcgcaccggactgatattcagatgcacccgcctcaaatcctgcacatttaagtgcagaagtgtagcgtgggtacataaacaacgtgtacccagtaagtatccagtctaacctcgaagaaatagtgacgaggggtcgactttgacacttactatgggctaacaataatatgtcaaaattttaattaagcatggattacacgaagaatactgaaaacccaataataggaaacactaaataatcctttcaccaatattaagtcccaaatttactattttttccattatttaacaatttatatctcaagccaaagaagcaatatcaattataattggttccaaagatttatcatgtgcaaattatgccgaggtcgtacaactcgatccaacataaaatttaaattgtgcactgccgagggtcgaacggcacgaaccatggatgcatctatctgctaccgaggcattcggcccgctccacaaatagaaaatattttaaggaaaagacaaattctcaataacagtcaagtgttccattcacaacttcaagtaagtgaaatttaattcttttatcaggtttcaaaagacttaagcaattaagttaacaagtagggtacaaacattgtaagtatagcatgatatgggtcctagactacccggacaatagcataattggtagctacgtacggactctcgtcacctcgtgcgtacgtagcccccacaaatagaagcacatttttaattcaattcacctatggggttaattccctcttacaaggttagaaaagagacttaccttgtctcaagcctactttcgatccaagatttgtgctcaaacccttaatttggtgccaaaatgtctcaaaactagttgaatgttatataaaatagtcaatataggctcaaaagttcatattctaactattaaagcgattacccaaccccaattgatgcattcccaaaattcacccccgggcccacgtgcccggattccggaaagtttccaagcaaattcttacccataacctcatgaactcaaatatatgatttttactaaattccataacaaattccgtggttaaatcttatttttgttaaaaacctagattatcacctaaacccttgattttcactaatttacatgttataatatacaaacaaactatgtattaaactcacattgcgtgaaaattacttacctcaaagtgctaggtgaaatcccctctctaagagctccaagaatcgcccaacattgaaagcaaatgagccaaaatagcctaagtgtcgtttttaaaagatgattctgcccagagatccttatacgcgattgcggccaagctctcgcgatcgcgatggctaaactgaagagcccaggaaaaggctctacgcgaatgcgagaggacccatgggaacgtgatgcactgggctgcatactattcacgaatgcgaggtcaaacacgcaaacgcgtaaggaaactgggttgcccaggcctaggcttctacgcgaacgcggcctgctcaatgcgaacgcgaaggccaaagggcccaggccttcgcgaacgcgtccctgcgtatacgaacgcgaagggaaaaaacctccagtccccaaatccttcaccgcgaacgcgagggtctgtccgcattcgtgaagaaggaaaccagaacagaaaatctggtgttttcaacttaactccgggcggtccaaaacacacccgagcccctcgggactccgtccaactacaccaacaagtctataaacataacatggacttgctcgaactctcgaaactcgtaaaacaataacaaaaccaagaatcaaatcccaaaattgaataaaaatatgaactccaagtttccaaattgctccgaacgcgctgaatcatacttagactactcggaatgataccaaattttgcgtgcaagttttaaatcaccatgcggtactattcccagtctcggaatcccatttggaccttgatatcatgaaaacatactccaaaccaaatttaaagaactttaaaaccttcaaagtataaactttcactattaagcgccgaaacgctcccaggtcatccaaaacccgatctgaacatacgcccaagtccgaaatcatcatacgaacctattggaaccgtcaaatctcgattctgaggtcgtttactcaaaacgttagccaaagtcaaacttagcctttttatccaacttaaggaatcaagtgttccgatttcaacccgaactcttccaaataccgaactaaccattcccgcaagtcataaaatagtaaaagcatgtacgagaagccttatttaggggaacggggttcttgaaagcaaaacgactgatcgggtcattacatcctccacctcttaaaaaaacattcgtcctcaaacgggttcagaatcatacttggagtgctaaataaatatggatatctactctgcatgtcttcctcggactcccaagtcgcttcccggactagttggcccctccactggacctttaccgcagaaatcttcttggacctcaaatggaaaacctgcctatccacaatggcaactggctcctcctcataacccaggctctcatctaactgaatcgtgatgaagtataacacatgtgacaagtcggcatgatacctccggagcatagacacatggaaaatcgaatgaacccccgatagactgggaggtaaagcaagctcataagaaacctccccaagtcgtcttaacacctcaaatggacctataaaccttgggctcaacttgcccttcttctcgaatctcacaatccccttcctcggcaagaccttccaaagaaccttctcgcccatcataaatgataaatcacgcgccttctgatccgcgtaactcttctatctggactgtgctgtgcgaagtcgctcctgaatcaactttaccttttccaaggagtccttcaccaaatcagtaccatataacttagcctcaccgggctcaaaccacccgatgggagaacgacatcgccgaccatataaatcctcaaatggagccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgatgttggactgataactgttgttgtaagcaaactcggccaaaggcaagaaccgatcccattgtcacccaaagtcaatcacacatggccttagcatatcctccaagatctgaattgtccgctccgactgtccgtcggtctgtggatgaaatgttatgatgaactctgcacgggtccccgattcactctgtactactctccagaaatgtgaagtgaattgagggcctctatcttataagatggaaattggcacaccgtgcaaccgaactatctcctgaatataaatctgggccagcctctctgaagtatacgtagtcacaaccggaatgaagtgtgtcgacttagccattctatcaacaatgtcccaaactgcattgaacttccgcaaggtccgcggtaacccaactacgaaatccatagtaatgcgctcccacttccactcagttatagtcatctgctggagtaggccacctggcctctggtgctcatatttaacatgctggcaatttaggcacctagctacatactcaactatgtctttcttcatctgccgccaccaataatgctacctcaggtcgcgatacatcttcgtagcacctgagtgaatagaatatcgagaactgtgtgcctcctctaaaatcctctcccgcaagccatcgacattaggaacacatagacgaccctggagtcacagaacaccatcctcgccgatagtaacctctttggtgccaccctgtagtaccatctctctgaggaccaacaaatgcggatcatcaagctgtcgagctttgatctgctccaatagtgaagactgggcaatgatgcatgcaagagctcggttgggctctaaaatatccaacctcacaaatctgctagccaaggactgaatgtccaaagctattggccactccaatgctgaaatgaaggccaagctacccatactctctgcctttctgctcaaggcacccgcgactacattcgccttgcccggatgataaagaatggtgatatcataatccttaagtaactcaagccatctgcgctgcctcaaattgagatccctttgcttgaacaaattctgcaagttgtgatgatcagtgtaaacctcacaggataccccataaagataatgcctccaaatcttaagagcgtgaacaatcgcggccaactccaaatcgtgcacaggataattcttctcatcgggcttcagctgacgtgaagcatatgcaataactcacccctcctgcattcatacacaacccaaacgaatgcgtgaagcattgcaatacatagtatacatccccgagccagaaggtaacactagaactggtgttgtagttaaagctgtcttgaacttctgcaagctcgcctcacaaccatcggactaacgaaacggagcacccttctgggtcaatctagtcaaaggtgttgcaacagatgagaatccctccacaaatcggcaataataacctgctaaccccaagaagatcccgatctcagtcgccgtagtaggacgagaccaactgtgaactacctcaatcttcttgggatccaccttaataccctcgcctgttacaacatgccctaagaatgctacagaatctagccaaaactcatacttggagaacttagcatatagcttctgttcccgcaaggtctgaagcaccactctcaaatgctgctcgttctcctccatactatgtgaatagattaaaatgtcatcaatgaagacaatgacaaataaatcaatatatggcccgaacaccctattcatcaaatccataaacaccgctggggcattagtcaagttgaaggacatcactagaaactcataatggccatgtctagtacggaaagcagtcttcggaaaaactaagtcccgaatattcaactgatggtgctccgatctcaagtcgatcttatagaacaccctagcaccctgtaactggtcaaataaatcatcaatacgcggcaacgggtaattgttcttgatggtgaccttgttcaactggcagtaatcaatgcacatccacatagtcccatctttcttcttcacaaataagactggtgcaccccaaggagatacacttggtctgacgaacccttttgctagcaactcctcaagttgttcctttaactccttcaactctttcagatccatgtggtacggtaggatagatataggctgggtacctggagccaagtcaatatagaaattgttatgatggtctggtggcatgcttggaagtttagaaggaaacacatcggagaactcccagactattggcaccgaatcaattgtcggggtctcttcggtagtatccccaacataagctagataagccaaacaatctttctcgaccatatgtcaggccttcagaaaagagataacccaactagatgcacttacagacgaaccctttcactctaatctaggaaactctggcatcgccaaggtaacagtctttgcatggcaatcaaggatggcgtgatatggggatagacagtccatgccgatgatgacctcaaagtcggtcatataaagcaacagaagatccgttctagtctcatatccatagaatatgaccacacaggaccgataaatccaatccataatgacagaatcgcccacaggagtggacacataaacaggagtgcccaaggactcacgaggaatatccaggaaatgagcaaacagagatgaaacatatatataggtagaccctggatcaaataataccgaagcatccctactgtagataaaaataatacctgtgatcacggcatctgaggccactatatctggtctggccgaaaaggcatagaaccttgccggggtaccgactggtcgacctccacctgtctaggctgcagctggctgtcctccacctgcctggcctccacctctaggtcggatagctggtgttgtaatcatgggatgttggccctgctacactgccttgccctaaagcttggggcagaatctccacacatgactgaaatccccacacttgaagcaacctcctggtacagtgatctgcggccctgaagtctgaccttgatggcctaaatacccactggaagaaccctgaatggccagtgggcgatatgaactctctggcatggggctaaagtaggcgctggaagaaccttgatggactgagtacccactggaagaatcctgaatagctagtgggtggtatgaactctccggcatggcactgaaatagggtctcgccggagcaccccgaggaggtggtgatgctagatatgtgggcctactgggatgacccctcccaaactcgcctcgtcccctgttggggcacctctaaactccccaaaataacagaccctcttgtccctttgcatctgctctctacctctctgatggtaaccctcaatcctttgagttatatccactactagctggtaagaagtccccatctcaacctcccgggccatagtagcctgaatacctgagtgcaaccccgcaacaaacctctacactcgctccacctcagtaggaagtatcataagtgcatggcgagacaactcagagaatctcgcttcataatcggtcactgacatctgaccatgttggagctgctcaaactgaaaccgcaactcttccctctgagagggtggaatatacttgtccaagaataggcatgtaaactggtcccaagtcataggaggagaacctgccgtcctcccaagaaggtaagactgccaccacctacgggccctgccctccagttggaaagtagtgaaatccacctcgtgggactcaaatatcctcatgttgtgcagtctgcccctacaatgatcaatgatgtcctgggatcctcatgtcgctcacctccgaagatggtagggtgtagtctagtccatctattcaatagcttctgtggctcgccggccacagctggtctaggcttaggtgccgctactgcaactggctgggcaccgcccacaggtagtgcacccagggtctgatatacggcagccgcatgtcatagagcctgagcagtatgggtcgtgctccccctcccgcctgagatatggttgggtctgctgaaaataaaccagcctgggtcatagaatccatgaaccgtagcaaacggcccatggcctcctgaaatcccagtgctgacatgaaatcgaccaaggctggctttgctgcgagaacctcgccctgctcttcaataatggggtcctccactggatctactggtggtgcaactggggcaactctcggatgtcgtcgtcccttacctcgggtagatgccctcccccgacctctacatcggcctctagcagtagggggagcagcccctcccgggtttggaaccatcgtgcgcgttctcaccatctgtgagagaataagagaagaaactcagtacaccattaattgcacgataggagatgaatgaagagtagtttcctaacaccctatagcctcttgaagataagtacggacgtctccacaccgatctgcaagactctattaggcttgcccataacctgtgagacctacgtgaacctagtgctctaatactatgttgtcatgacccaatttcataataggccgtgatggcgtctaacgccgccgctaggcaagccaactgtgaacttgtcacgtgatttcctttttttaacaaaattcttttccaagtaattaaactttccttaatttaaaaagaatttgaggaataacagatctaaaataaataaaacaaaagcaactgtgtacaatcataatcatagaataaaaccaaaaccacaagtctagtagtttgtgtgccaagatctggtgtcacaagtgtatgagcatctagtagaatatataaaagaaatctagtctactgtctcaagtgaaatagacagaaaaatacaatcaaaagcaagactccggctgctgtagaacgggctcagaaggcagctcaccatgaagcctcgaggtggcaatcaagtgcgcgtgttggactgatatccagatgcacctgcctcagatcctgcacatttaagtacagaagtgtagcgtgagtacataaacaacgtgtacccagtaagtatccattctagccttgaagaagtagtgatgaggggtcgactttgacacatactatgagctaacaataatatgttaaaagtttaattaagcatggattgcaagaagaattctgaaaacccaataacaggaaacaataaataatcctttcaccaatataaatcccaactttacatttttttccatcatttaacaatttatatctcaagccaaagaagcaatatcaattataattggttccaaagatttatcatgcgcaaattatactgaggtcgtacggcccgatccaacataatatttaaactctgcactgccgagggtcgaacggcatgaaccatggatgcatctatctgctactgaggcgttcggcccactccacaaatagaaaatattttaaggaaaacacaaattctcaataacagtcaatagttccattcacaacttcaggtaagtgaaatttaattcttttatcaggtttcaaatgaattaagctattaagttaacaagtaggatacacacattgtaagtacaacatgatatgggtcctatactacccagacaatagcataattggtagctacgtacggactctcgtcgcctcgtgcgtacgtagccccacaaataaaagcacatttttaattcaactcacctatggggttaattccctcttacaaggttcgaaaagagacttaccttgtctcatgcccactttcgattcaagatttgtcctcaaactctcaattaggttccaaaatggctcgaaactagtcgaatgttatataaaagaatcaatataggctcaaaagttcatattctaactattaaagagattacccaaccccaattgatgaattcccaaaattcactcccgggaccacgtgcctggatttcgaaaatatttgaagcaaattgttacccataacctcatgaactcaaatatattatttttactaaattccataacaaattctgtggttaaatctcatttttgtcaaaaatctaggttttcacctaaacccataattttcactaatttacatgttattatctacccatgaactatgtattaaactcacattgagtggaaattacttacatcaaagtactaggtgaaatcccctctttaagagctccaaatatcgcccaacaatgaaagaaaatgagccaaaatagccttactcccgtttttaaaagttgattcttctaaggggtccttacacgcgaccgcggccaagctctcgcgatcgtgatggctaaactgaagagcccaggaaaaggctctatacgaacgcgagaggacccatgcgaatgcgatgcactgggccgcatactcctcgcgaacgcggggcaagcacgcgaatgcgtaagacaactgggttgccctagtccaggcccaggcttctacgcgaacgcggcctgctcaatgcgaatacgaaggccaaagggcccaggactccacgaacatgtccctgcatatgggaacacgaagggaaaaaagcaccagtccccaaatccttcaccgcgaacacgagggtctatccgcgttcgcgaagaaagaaaccagaacagaaaatctggtgttttcaacttaactccgggcagtccgaaacacacccgggcccctcgggaccccgtccatctataccagcaagtctataaacataatatggacttgcttgaactcctgaaatgcgtaaaatatcaacaaaacaaagaatcacaccccaaaaccaaattaaatcaaaatatgaactccaagtttccaaattactccgaacgcgctgaatcatacttaggctactcggaatgacaccaaattttgcgtgcaagttttaaatcacaacacggaactattctcggtctcagaatcccatttggatctcgatatcataaaaacctactccaaaccaaatttaatgaacttcaaaaccttcaaagaacaaactttcactagtaagcgccgaaactctcatgggtcatccaaaacctgatccaaacatacgcccaagtctaaaatcatcatatgaacctattagaaccgtcaaatcttgattctgaggtcgttaactcaaaacattgagcgaagtcaaacttagactttttagccaaccttaaggaaccaagtgttccgatttcaacccgaactcttccatatcccgaactaaccatccacgcaagtcataaaatagtaaaatcatgtatgagaagtcttatttagtagaatggggttgtagaaagtaaaacaatcgattaggtcattatatttctgcagctataacttattatggcggagactcgagcagtcggtcagctcagtccgcgcattagattatacggggtgcaccagtaagttcttttactgcaccatcagcacgagatttatataatggttattccaattacccggcaaagacttagtatgagcagccgaacctagagaggggttgttatgagtgtgatgatactaggcacatcatgagagattgtccgagacttgggagagacatattacattagaacactcaagccacatgctccatttcagttgctactctacctacatattcagttaggggtgttggacaggcgggtagagggcgtcctagaggtggaggaccggcccgttggtataattgctatgaattggttgaggccgttacaccaaatggtgttgttacaggtatgatttaattcataatagaggagcactattcttattttgattctattcctattatcaaggtgagatctcctttcatgctccttatatggtgagtttgtgaatttgtactctactcccgtgtttatccctattgggagattcgatggtgttagcccgtgtctattatttttgttttgtacattattgagggctctgagtccaaaagtgactttctgttactcactaccataggttttgatgtaatttcaggataatttgttacaattttatgaattatattccctaccaatatgggggttcattatgtgttgtgaatttgtttaacgaaaattatttttaaagaagaaaatggaaagattttgattggaacaatgttcatattacttgtgattcagagctgaggatagaaattctcgcattttaatatgatttgatatgtttaaaccgtgctacacgccacagtagaagttacatcaggataagatctttttgatggaaatttatgtgtttaaattctcccttgtgaaattaaatttgtactatagtattgaaagggagtcatgcctgttaggcttatttgataattcttatatgtgcttctccgtgcataattttccatattcgtgttgtaattattgagttttagcatacgaggtgggtgccttggtgacgttaaatgtgattcattaattcgggtaaataattatgaagccttcatgccttgtgtctcgttgtcagtattgtgaaggtttgaaatgagattttgttaacgtgaagttaattgacgatgctgtaattggttatgaacaactattatgaacagagatgtggttatgggtattagcatattgcgataagttatatggttgtaccgtgcgagtgtaggcacgagttggtgcagccggttgaggctaatatcatgagtcgatatgaaaatcagaccttttgaatatgtttggagtgtaagaaatttggttccaaggtctataaggttagataggagaaataatctcaatggaaatggtgatgttatacttatgtcgattggggtgacgtgggatcacccgcgagtttatgtgtaagagaaaaatcagcaatttgataacctcagaataattcttagcacgttcgaggacgaaagtttgtttaagaggtggaggatgtaatgacccgacttgtcgttgtgagaattagcatctcgttcagcgacttacgacctcaagcagcttcgtaatgtgtattatgacttgcgtgtgtggtcgagtttggttttcggacaattcaggatcaaattcgagaacaattcttatttaagaagcttaaaagaaaagagttgacaagagagttgacttttgagcaaatgactccggaaaatttttttgatggttcaaatagctttgtctggtgattttggacttaagagtgtgtccggctatttatttggaagtctgtagttgattttggcttgaaatgatgaaagttacaaatggatggtttggaagtttgactgtgagttaactttggtgatatctgggtcaaaatgcaattccgggagttgtattagctctgttatgtcatttggaacttgcatgcaaaatttgatgtcattacgggttaatttggtatgtttcggcacgagtttagaaagttggaagatttggaaatttatgagttcgatttgtggtgcgattcatagtttcgatgttgtttgatgtggtttgaggcctcgagcaagtcctcgttatgttttaggacttgttggtgtatttggttaaggtcccgggagcctcgggtgcgtttcgaggcaaattttgaacaaatttgggcatttcggcactctcataatcttctgggaacaattgtcatgcatgggcacattttggagtggtgaagcaaagcaccatgtgcggaccagagaggaaatgtgcggaccgcagaggaaatgtgcgtatcgcagaattcctcttgcggccgcagaaaggggattctgcaggtttgatggtatgacttcggaagcttatattttttaatctacaaggaatttggagatgatccaaaaatggaagttatatccctttgagtttagttttttgaaaggtaagccaattatcctttggacatttatagcgaaatttacggtcaatttactgaagcctgatagtgctgtgactgctgagtgcgactgcacaatttagattgcggccgtggaacttggaatgtgcggaccgcacaaaaaatgtgcggtcagcacattgggagatcagattggtaccatataaatgagggtttcatcttatttttcatattttgactttggaagctcgatttgtggcgatctttcgttgatttttcaagcaattcatcggggtaagtcattctagatcggaattagttaatatatatgaatatatcattgttttcatcatttaattagtatttttagatggaaatttggaaaaaattgtagaaatttcataaaataaattttagggatttgaaaggcgatccgatatcggaattcgataatttttgtatggttgaactcgtatcggaacaggtgttcggattccgtgaatttttgtcttgttccgaaaagtggtccccgcattgacttttggttgacttagtattattatttaaatttgttttctatgaattgtaattaatttataaaaatattttgattagattagagccgttcgaacgtcgtttcgcgcaagaaggctattttgggatatcagcctaactccgttaaagtaagtgttttgtctaactttgtgtaggggaaaccaccccttaggatttgagatgattgtgtcattcatgttatgtgaaggtcgtgtatgcggggtgacgagtggatacacgacctatatgtggtatttgaccggtttggatcgttaggctccttttatagaattgattataaatatcgtttcatgattatatcttttgttgttagaattgtttgtatgtgctttacttgaatttgttagcacatgttccatcattgttgtcaagttcacccttatatgctaattattaagtgtaatcactcgttgaattcatgctttacgtgctacatgccttaattgtcaattgatgcccataaattgtgccttggcttatggattgtcatttccttgctatttgatttcgtgagctatcgtgtagcctttttcattagttgtgacttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataccgtagttggttgtaaattggttgactattattgtgagggatcgggttccacgccacaacaaatatgatttattattgtgagggatcgggttgtacgtcgcaacagatatgatttaatatttagagggatcgggttgcatgccgcaatagtatgatttatttttgtgagggattgggttgcacgccgcaacaaatatgatttaatattaagagggatcgggttgcatgccgcaacagtttgatttattattatgagggatcgggttgcacgccgcaacatatatgatttattattgcatgggaccgggttgcacgccgcaacaaatgtacaaatatgaaattattgtgatactaaggttaattccgattgtgatgctcacgatgcatttcatgctaggacggttactgtggtttcttaaaccacctcattgtattttgattataattaattaaccgtcaatatattaaaaatgaaacaatatggactttttgtgtgagtcatgcatcctatgtgatatgttaagttgctgagaatttagcagaggtaaatgaaagaattttcaagttgttccacttgtgtgtctttcaaaaataaaactcatatcttattcgtagatctactaatttaaatggtgattatatttgtactctaattgatacctcaactttctcattatcttaatagcgtgtaatttatgtgaaaaattattattacattttactttaataaatcccatatttatatcattaaaatttgattgaatatcttaatttgtataaatataatattgtattggatctcatatatttctaaactaaactcatttgatattctatttgcacaacctctccaccttatttaaatcttaaattggcttaataactcatttgactctttactatgttcaagttggaattctttttaattgtgtttaaattattcatcatttaatggtaaggacgagagtttaagcacgaagggtaatatcgtgctatttttatattatatttttactctgactgtgttgttgctcaatttcttgattgtttgttcgatgccatccatgttctcattattttcattgttgatttgtgttgggaaattcttctattattggccttaaatttatactcttcccttgttagcttcatgaaacaaattgtacagctttatatgtctggtaggtgtcttgacctggcctcgtcactactctaccgaggttaggcttgatacttactgggtaccgttgtggtgtactcatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatctttttatgcagatccagataccccagagttattgatattctttttagttaatcgagcattgtggtggagactcaaggtatacccgttgtctcgttcgcaggcttcagagtcacattttgatatttttttgcactgttgattctactttagaacagttgcatttagagattttagagtaaactctgtagattttgtgacttgtactatcgattttgggattgtagtaaatttctatttcagattattccagataattggttttttattgccatttaaacttaactgtgaaaaaatgactaaaattattctaatgttggtttgcctagcaagtgaaatgttaggcgccatcacgatcccgaaggtggaaatttcgggtcgtgacaagaaatcaatagttgtttttgaaaatggaagaaaacaagttaaactctactaacctatgaagttgggatgaaaattctcttcaaaatcgcctctaggccgagctgaaacttggaaatgatgaattggttaaatcctcactttgggatatttaagtcactgggcgtcaggccttcttcgcgttcacgaagggcctgaagcgatcgcgaagagcagcggccaaaatggccttcacgttcatgagggtttgaacgcgtctgcgatgctttgtcccccctggccattgcgttcgcgagcctaggctcgcgttcgtgtagaacaaaccctagccttcccccagaatcccttgcccatcatgttcgcgagtgaagggccgtgttcatgaagggtaatccttccgatgctttgtgttcaaatttacaaccgagcgtccgaatcatgtcaaatcaactccgattttaaccaaattttgcagacaagacaataatagtaaaatgaacctatatcaagtctcgaaaccgaaattcgagcccagtagctataaagtcaacctacggtcaaactttcaaattctttaaagcttcaaattactagttttcaataaatcacgttaaatcaagttagaggctttcgaatttgattatgggcatacgcccaagtcccaaatcacgatacaaatccaccaggaccgtcaaaatactgatccgggtctgtttacataaaatgttgagcgtagtcaactaaaattattttaaagaaaaattcacattttctagaacaagacacagacaaaaatcgaggaatgttaaacggagctaattgagatctcgaaatacgaaaataaggctaaatctcaaaatgacttatcgggtcatcacatgggccttcattttcattgtcaagacccaaaattcaagtagttgtgatggcacctaacctataccgttagctaagccaattatccataaacacaatccaaatgagattaacacgaaataaatgatgaaataagtgagttcttatacaataactcaaggactagtagtacaagttaggagattataatacttggagttacaaaactaataggaaaataatacaacatctgtttgaaatatacataaatataatctcaaatatagaactaccaagaacaagtggtagcggtaattcaaagagatatgcttccttcctctagactagccgatcaccaaaacacagaaaacacatctcgcacctcattcatggaatccataagtcgtcaatgtacagatgatactgagcactcacatgcgcatacgagcgagtggaaggaattcaaaaaggtacaagcttcaggatcatttggctctactagacacttggtcgtgactcgtagaacctatgaacctagagttctgataccaacttctcacgacccaaaatccaactagtcgtgatggaacctatcctaacccactaggtaagcgaattaataataaaccacaatataatgataataataagagttaagaatgaaataactgaattttatacaactccccaaggactggtagtataaatcatgagcttctaagacttagagtttacaaagctggtatgaaataaatacatcatctgttcgaaaagtacataaacaaatttataaatctaaagctaccaagaataagaggcacttataactggaacgtatgtatatcttcaatgccaattcccgccatacacaacaacattagctcaaaaatatgcacgcaaggtgcataaatgtagtatgagtaaaaccgaccccatgtactcattaatctaaaaaatctggcaacccaattcttagtaaaatgaccataaattcctcatacgatgtcgaaacttgatgattccagttgctatggttccaaaattacgatacggatattggtttagcctaaacacgaataaaaggccgttttctcaatacggtaacctttatactcaaatcgatgttgaaaccgaaaacaatcaccatacaacccaaacttatccaaaactcatcgaaatatggccaaactttaaggacatgtccaaaatcatcatacaaacatattggaataattaaaacccgatttcgagtccatttaaccaaaagtcaaaccttgattaaatcttccaacttaaagcttctaaaatgagtattattcttccaaatcaatctagaaccacttgaaaaccgataccaaccatacacgcaagtcataatacataatatgaagctacttaaagttttaaaccaccgaatggaatgctaaagctcaaaacgaccggtcaggttattacatctttaattcccattcccgccattcacaaaaacatcagcgtgcaaaagtgtagtatgattaaaaccgactatatgtactcaataagaaacaaacctaacctcaagttgaaagtagtgacgagctccaaaaacggttagagtccaacaccaatagccaataacaactcgtaataatatcatgaaggcagtaaaagtaataactcaaaagatattatactcagcttgtttgcagtcacaaaaaagtagacatgctttccaagtataacagtaaagtccaaatctttcgacggaattaccaaagtatgagtatatctgaaaattgtgatttcccccaaactttcaacaacatagaagacatttcattaccagatagcattagaaaagtacatctctatacctacatgtcaatatgcgtatcaagtcatcaattatcatataccgtctagcaggaggaatatgcatctctatgcctaggtcaattaagaatgaaactaatactcatttaaacggtataactcaaattaaaggaaaaataggttgctacccagtaaaataaatcaggttttacaacaaatagctcgtgtacgtactcgtcacctcacttgcacggcgctcacatatcacaacagtaccaaatcctaaggggatttcccccacacaaggttaggcaagccacttacctcgaaccaagttcaatcaatcctgttttcattcttaattgagctattccaatatgtgtagttatcctgtttagtctaatatcgcatgtctacgtgctttaactgcttatttgaactctgtgaagcatgcctagttgattttcctgttttccttgttctttatcagtattaactgtagaaatcttgttgttaactgttgtatttatcggtttgagctgtgtgtttacttttgagactacgaggcggttcctcgggagttctccctgcacatttacttttgggactacgaggcggtacctcgggagatctcccatatttacttttgggactacgagacggtatctcgggagatcccctgttgagtgtttatttattttactacgagacggtatctcgggagcgcccctgttgttatcacattgtgtgtgttattatttctctgtgaattctttctgttaaatttccccattttacttcattttattatatcatctgtcttattattatatcccagtagggcccggacctgacctcgtcactactctaccgaggttaggcttggcacttactgggtaccgttgtggtgtactcatgctactcttctgcacatgttttgtgtgcagatccaggagcccctctattctcccctatatgtcatttaccttccgtatttcttttattagactctggtgtatagagatactagtttccttctgtagcttgtgacttatgatgttcgggttttgggaatactgtgtattactagagtattggttattgtacatgccaagcgtattgttaccagttagttgttaagttttacttccattttgttatttcctatttagagactaggtgccgtcacgacgttcttacggagggagagttgggtcgtgacaagttggtatcagagctctaggttcataggtgtcgtgagtcacaagcaagtttagtagagtctcgcggatcggtacgagacgtctgtacttatcttcgggaggctatggaactgttaggaaaaattacacttctttgattccttgtcgtgcgaaattgttgacttcaaaattctaaacttctgtattctattctctcacagatggtgaggacacgtacaggcggatctgatgaccaggcacccgcgccccctgctagagccgcgagaggccgggccggggtagaggccgaggacgtccacgcggtgcagccagagcacccgcacgagctgctacagaggagcccccagtagctccagctggagggcaggcacctgaggtacctgttgctgcaccagccctccaggagactctagcccagtttctgagcatgttcagcaccttagctcaggctggattgattccacttgctcctgccacatctcaggccgggggagcacagactcccatcggtacccccagagcagcggttcaggtcgaccaggtccagagatcataccatgcagccggtagctccagttcagcccgaggttagggcagcagtttctgaggcggagcagctcagacttgagaggtacaagaagtaccaccctcctaccttcagtggattggcgtcagaggatgcccagggttttctggaggagtgtcaccgtattctccgtactatgggtgtagcggagtcgagtggggtttcttttactacattccagcttagaggagcagcctatcagtggtggcgtgcttatgagttgagtagtccggctgaggcagcttcacttacatggactcagttctcggacatgtttttgagggagtatgttccccagagtctcagagacgcatggcgcgtggagtttgagcagttgcgccagggtgctatgactgtgtcagagtatgcagttcgcttcagtgatttggcccgacatgcaccggccttggttgccacagttcgagagagggttcgtcggtttattgagggactccaccccagtatcaggattagtatggtcagggagttggagatggatatttcttaccagcaggttgtgagtattgctaggagattggagggcatgctcgctcgggatagagaggagagggaggccaagaggtctcgagagtctggcacttacagtggtactcgtgccccagctgcagttcgccatggtaggggttatgtgagtcgccccgttcattcagctcttccagccgccagtggtattccggccccttctaggccccaggagccttattatgcaccgccagtatctagtgtgcctcctgcacggggtgcttttagcggtcagtccagcagacctggcccgagccagtcacagcagccacgcctccgagagcttgttttgagtgtggcgacaccccatatggtgagggattgccccagacttaggaggggtgcacctccacagacttctcagccaccgcgtgctccaccgggtcctcaggctatgattccagcaccagctaccgccccacctgctcagccagctcgaggtggaggtcggggaggtcgccctagagggggaggccaggccagatattatgctcttccgctcgtacagaggcagttgcttccgactctgtcattacaggtattgttccggtctgtcatagagatgcgtcggttttatttgatccaggctccacttattcctatgtgtcctcttattttgccccgtatttgggcgtatctcggattcttgagttcccctatttatgtgtctactcctgtgggagattctcttattgtggaccgcgtgtatcgtcgtgtttgattgctcttagtggttttgagaccagagccgatttattattgctcagtatggtagactttgatgttatcttgggcatggactggttgtttaagaccgtgacgctggctatgccaggattaccgcgattagagtggagaggtaccttagagtatactcccagcagagttatttcatttcttaaagctcaacgaatggttgagaaggggtgtgacgcgtatctagcttatgtgagagatgtcagtattgatacccctacagttgagtcagtcccagtagtgagggactttccagatgtgtttccagctgatcttccgggcatgccgcccgacagagatattgattttggcattgatttgttgcgggcactcagcccatctctattcctccatatcgtatggctcctcctgagttgaaggagttgaaggagcagttacaggagttgcttgataagggcttcattcggcccagtgtgtcaccttggggtgctcctgtcttatttgtgaagaagaaggatggttctatgcggatgtgtattgattaccccagttgaacaaagtcacagtgaagaacaggtatccattgcctcgtattgatgacttatttgatcagttacagggtgccagagtgttttccaagattgacttacgttcaggctatcatcagttgaagattcgggagccagatatcccgaagactgctttcaggactcggtatggtcactacgagttccttgtgatgtcatttgggctgaccaatgccccagcagcttttatgcacttgatgcacagtgtgttccggccttatcttgactcatttcatcattgtgtttattgacgacattctggtgtactcccggactcgggaggatcatgagcagcacctgaggactgtgcttcagaccttgagagaaaagaagttatatgcaaaattttcaaagtgtgagttttggctagactcagtggcattcttgggtcatgtagtatcgagtgatgggatccaggtggatccgaagaaggtgaagcagtgcagagttggcccagaccgtcctcagctacggagatccggagttttcttggtttggcggggtattaccgtcgatttgtagagggtttctcatctattgcagcacctatgaccaggctgacccagaagggtgctccgttcaggtggacagaggagtgtgaggagagctttcagaagctcaagacagctttgactacagccccagtattggtattgcctacaggttcggggtcttatactgtatattgtgatgcgtcgcggattggtctcggcgcggtgttgatgcaggacggtagggtgattgcctacgcgtccagacagctgaaggtgcatgaaaagaactatcatgtccacgaccttgagttagcagctattgttcatgccttgaagatttggcggcactatttgtacggtgtcccttgtgagatttacaccgatcaccggagtttgcagcatctgttcaaaaaaggatcttaacttgcgtcagcggaggtggttggagctgcttaaggattatgatatcaccattttgtaccatcccgggaaggccaatgtggtggccgatgctttgagtcgccgggcagagagtttggggagttagcatatctaccagcagcagagaggccattggcgttggatgttcaggccttagccagccagtttgtgagattggatatttctgagccgagtcgagtattggcttgtgtggtctctcggtcttctctttatgatcgtatcagggagcgtcagtatgatgacccccatctgcttgtccttaaggacacggttcagcacggtgatgctaaggaggtcactattggggatgatggtgcattgaggatgcagggcaggctatgtgtgcccaatgtagatggtttgcgtgagttgattctccaggaggctcacagttcgcggtactccattcatccgggtgccgcgaagatgtatcaggacttgaggcagcattactggtggaggaggaatgaagaaggacatagtggaatatgtagctcggtgtctaaattgccagcaggtaaagtatgagcatcagcggccaggtggattgcttcagaagttagagattccgagtggaaatgggagcggatcactatggatttcgttgttggacttccggactcagcggaagtttgatgcagtttgggtgattgtggataggctgaccaagtcagctcatttcattcctgtgatgactacctattcttccgagcagctggctcgaatttatatccgcgagatcgtcaggcttcatggcgtaccggtatctatcatctctgaccggggtacgcagtttacatcacggttctggaggggtacagcatgagttgggtactcgagtggagctgagcacaacatttcaccctcagacggacggacagtccgagcgcactattcagatattagaggatatgctccgtgcgtgtgtgatagatttggaggttctgggatcagttcttgccacttgcggagtttgcctacaacaacagttatcagtcgagcatccagatggcaccgtatgaggcttatatggtaggcggtgcggtctccagtgggttggttcgagccgggcgaggctagattattgggtacagacttggttcaggatgcttggaaaaggttaaggtgattcaggatcgacttcgcacagccagtccagacagaagagttatgcgatcgaaggttcgcgatgttgcattcatggttggagaggtcttgctccgggtgtcacccatgaagggtgtgatgaggttcggaaagaagggcaagttgagccctaggtatatcgggccttttgagattcttgagagagtgggggaggtggcttacaggcttgcgttgccaccgggtttatcagcagttcatccggtgttccatgtgtccatgctccgaaagtatcacggcgatccgtcccacgtgttagatttcagctctgtccagttggacaaggatttgacttacgaggaggagccggtggctattctagcccgggttcgtcagttgaggtcgaagagttatccttcagtccgagtgcagtggagaggtcagcccatcgaggcagctacttgggagtccgagtcggacatgcggagtagatatccccaccttttcaccagcccaggtacttttctatgtccgttcgaggacgaacggttgttttagaggtggagaatgtgatgacccgataggtcatcttatgttttagaacctaattcttgctttgaagccttaaatacctcattttagccttcctcgatttgcgtgcgcagtccgggtgtttttcggaaagcttttatgttaaaaactgagaaaatatgaaaattttgccttaaaatccatttgagttgacttcggtcaacgttttgagcaaacggaccggattcatgttttgacggtcccggtgggtccgtatcgtgatttgggacttgggcgtatgcccggaatcgaattcggaagtccctagcccgagttatcggactttgttgaaatttgaaagtttgaaagcttaatgactttgaaagtttgaccaatgtttgactttattgatatcgggtccgtattttggtttccggaacccggtataggtccaatactatatttatgacttgtctgtcaaatttggtgagaaacggagttggtttgacgtgattcggacgtccggttgtgaaaatagaagtttcaaagttttcttgaaaatttcctttgatttggtgtaaattcgtagttctaggtgttattttggcgatttgatcgcgcgagcaagttcgtatgatgtttttagacttgtgtgcatatttggtttagagcccgagggctcgggtgagtttcggataggctacggagtggtttggacttagaaaactcagctggttctgcaatttctggtctctgatctcgcaattgcgagatcagtgttcgcatttgcgaacatcccaaatcctgggccttcatttgcgaagagtacctgggtcagcatagttcgcatttgcgatcaagaggtcgcaattgcggggaggccagagttcgcatttgcgaagtggggctggggcaggcttggtcgcatttgcgatcaatttggtcgcaaatgcggaagatcaatgttcgcaattgcgaacaagtcatcatttgcgatgaaagcagagatggaaggacttcgcatttgcgatggttttcgcgcatttgcgaaccccaggtcgcaaatgcgacatctgcaactgatcaaaatgggacttagacgggattttggttcattctctcaaattttcaaaacaagaaaccctagaggcgatttttcaaagaacctttcttccccaaatcattggtaagtgattctaaactagtttctttcaatctttcactacatttcctaagatttcaaccaaaaatcttgtgttttcatggtggaaattgggggtttgggtagaattagggatttttgtaaaatggggatttagacctcaaattgaggtcggattccaaaacaaattacataaccgggctatgccttttccacgaatatccgactccgaatggcccaaaactagccaaaataaattacatacaataaatacaactataagaaactaatctaattaatgaaatcaaatctaaagcaagaaattagaaaatctccccaaaaggtcgacccgggcccacgtctcgaaatcgggtaaaagtcacaaaatatgaacacccattcactcacgtgttcactcgtaccaaaaattatccaaatccaatatcaaaatccgaatcaaaactcaaaaacttagttgaagaatttctcccatttttcccaaatttctcaaccaaattccttaattaaatgatgaaatcaactatagattaatggaatataaccataaatgagttaagaatcattaccccaaatttctctctgaaacatccttgaattatcgcctcaatccgatctctcaaagaccccaaatgtaaatgagatcaaaccctcaaaatttccccttttctgcccaacgatctcgcacctgcgggcctctagtcgcacctacggaatttccatcgcaagtgcggaaatgactaaagaggtctggtacatcttctacgatgaggtagccgcacctgtggacaatggtccgcttctgtgaagtcctcatccactcagctcccgcttctgcgatcactccccagcaggagcggctccgcttctgctccccttttgttgcacctgcgaccactggttacccagaacagggccgcatctgagagctctcttctacatgtgtgagtccgcacctgcgatctccccacagcaggtgcgaaaacaccagaaaccagaaaacttcagcaatttgtataagtccaaattcaatcccttaagcatctgaaacacatccaaggcccccgggacctcaaccaaatataccaacaagtcctaaaacaccatacaaacatagtctagccctccaatcacatcaaacaatgctaaaaatacgaatcaccctccaattaaaacttcctttgacacttcaaacttctaaaaccgatgccgaaacctatcaaaccacgttcgattgacctcaaattttgtacacaagtcataattgacattacggacctactccaacttcaggaatcggaatctgaccccgatatcaaaaggtccacttccaatcaaaatctccaaaaatttgactttcgccaattccagcctaaatcagctacagacctccaaaacacaatcctaaaacgcccctatatccaaaatcactcaacagagctaacagaaccgaagaaactccattctagtgtcgtcttcacacagtcccaactacggtcaaaatcctaagacttaagctttcgtttagggactgattgtcattcatcattccaaaaccacaaacagaaccgcccggcaagtcacataaggagaaaacgatacgggggaagcagtaaacaggggatcggggctattactctctaaacgaccggcctggtagttacatcctccccctctttaaacaatcatttgtccttgaatgatcatagagacatacctgaagtggtgaaaatatgaggatagcggctgcgcatatcctgctcggtctcccaagttgcctcctcgaccggctgacccctccactgaacctgcacgcaagcaatgttcttcgaccataactttcgaacccgcatgtctaaaatagccactggctcctcaacataagatagatccttgtccaactggactgagctaaaatccagcacatgatacggatcaccgtgatactttcggagcatagaaacatggaataccgaatgaaatcctgctagactgggaggtaaggcaagctcataagcaacctccccaacaggccgcaacacctcaaaggggccaataaaccttgggctcagcttgcccttcttcccgaacctcataacacccttcataggagaaacccggagcaagacccgctctccaaccatgaatgcaacatcgcgaaccttctgatccgcataactcttctgtctggactaggctgtacgaagtcgatcttgaatcaccttcaccttatccagggcatcttgaaccaagtctgtacccaataatctagcctcgcccggctcaaaccaacccactggagaccgacaccgcctaccatacagagcctcatatggtgccatctggatgctcgactgataactgttgttgtaggcaaactctgcaagtggcaagaactgatccaaagaacctctacaatctatcacacactcacggagtatatcctctaataactgaatagtactctcagattgtccgttcgtctgagggtgaaatgttgtgctcagctctactcgagtacccaactcatgttgtaaactgtgtaccccggtcagagatgatagataccggtacaccatgaagcctgacgatctcgcggatataaattcgatccagcttctcggaagaataggtagtcatcagaggaaggaaatgagctgacttggtcagcctatccacaatcacccaaactgcatcaaacctccactgagtccgtgggaatccaacaacaaaatccatagtgatccgctcccattttcactccgaaacctctaacttttgaagtaacccacctggccgctgatgctcatacttcacctgctggcaatttagacaccgagctacatactccactatgtcctttttcatcctcctccaccagtaatggtgcctcaagtcttggtacatcttcgcggcactctgatgaatggagtatcgcgagctgtgagcctctagagaatcaactcacgcaaaccatctacattgggcacacatagcctgccctccatcctcaatgcaccatcatccccaatagtgacctccttagcatcaccgtgctgaaccgtgtccttaaggacaagcagatgggggccatcatactgacgctccctgatatgatcataaagagaagaccaagagaccacataagccaatactcgactcggctcaaaaatatccaatctcacaaactggctggctaaggcctgaacatccaacatcaatggcctctctgctggtggtagatatgctaaactccccaaactctctgctcggcgactcaaagcatcggccaccatattggccttccccagatggtataaaatggtgatatcatagtccttaagtagctccaaccacttcgctgatgcaggttaagatctttttccttgaacagatgctggaaactccgatgatcggtgtaaatcacacaagggacactgtacaaatagtgccaccaaatcttcaaggcatgaacaatagctgctaactccaggtcgtagacaggatagttcttttcatgcatcttcaattgtctggatgcgtaggcaatcaccctaccatcctgcatcaacatcgcatcgagaccaatccacgacgcatcacaatatatagtataagatcctgaacctataggcaataccaatattggggctgtagtcaaagctgtcttgagcttgtgaaagttctcctcacactcctctatccatctgaacagagcacccttctggttcagcctggtcataggtgctgcaatagatgagaatccctctacaaaatgacggtaataccccataaaaccaagaaaacaccaaatctctgtagctgatgatggtctaggccaactctacactgcttccaccttcttcggatctaacttgatcccatcactcgatactacatgaccctagaatgccactaagtctagccaaaactcacactttgaaaattttgcatataccttcttttctctcaaggtctgaagcacagtactcaggtgctgctcatgatcctcccgagtccgtgagtacaccagaatgtcgtcaataaacacaatgacgaaagagtcaagataaggccataacacactgtacatcaagtgcataaaagttgctggggcattggtcagcccaaaacacatcacaaggaactcgtagtgaccataccgagtcctgaaagcggtcttcaagatatctggctaccgaatcttcaattgattatagccggaacgtaaatcaatctgggaaaacacctggcaccctatagctgatcaaataaatcataaatatgtggcaatggatacatgttcttcactgtaacattgttcagctgacgataatcaatgcacatacgcatagaaccatcattttgctttacaaacaagacaggagtaccccaaggtgacacaccgggccgaatgaatcccttatcaagcaactcatgtaactactctttcaattccttcaactcaggaggagccatacgatacagaggaatagagataggctgagtgcccggcaataaatcaatgccaaaatcaatatatctgtcgggcgacatgcccggaagatcagctggaaacacatcttgaaagtccctcactactgggactgaattaactataggggtatcaatactaacatctctcacataagctagatacgcgtcacaccctctcaaccattcgctaaactttaaggaatgaaataactctgctgggagtatactctaaggtacccctccactctaatcgcggtagacctagcatagacagcgtcacggtcttagcgtgacaatcaagaatagcataatggggcgacaaccaatccatgcccaagataacatcaaattctaccatactgagcaataataaattggctctggtctcaaaacaactaagagaaatcaaacatgaccgatacatgcggtccacaacaagagaatctcccacatgagtacacacataaacaggggaactcaaggaatcccgagatacgcccaaatacggggcaaaataagaggacacataagaatatgtagagcctggatcaaataaggctgacgcgtctctatgaaagaccgaaacaatacctgtaatgacagagtcggaagcaactgcctctgtaccagctggaagagcataatatctggcctgtcctccccctttagggcgacctcgacctccccgacctccacctcgagctggctgagcaggtggggcggtagttggtgttggaatcatagcctgaggacccggtggagcacgtagtggctgagaagtctgtggaggtgcacccctcctaagtctggggcaatccctcaccatatggcgagtgtcgccacactcaaaataagctctcatagggcgtggctgctatgactggctcggtccaggtctgttggactggccgctaaaagcaccccgtgtaggaggcacactagatactggcggtgcataataaggctcctggggtctagaaggggcctgaataccattggtgggtggaagagctgaatgaacggggcgactcacataacccctaccatggcgaactgtagttggggaacgagtaccactgtaagtgccagacactcgagacctcttagcctccatctccgatctatctcgagcatgccctccaatcacctagcaatactcacaacctgctggtaagaaatatccagctccagctccctgaccatactaatcctaatactggggtggagtcctcaataaatcgacgaaccctctctcgaactgtggcaaccaaggctgttgcatgtcaggctaaatcactgaaacgaactgcatactctgacacattcatagaaccttggcgcatctgctcaacctttgttctccatgcgtccctaaggctctgagggacatactctctcaaaagcatgtccgagaactgagtctatgtaagtgaagctgcctcatccggactatcaactcataagcacgccaccactgataggctgctcctctaagctggaatgtagtaaaggaaaccccactcgaatccgctacacccatagtacgaagaatacagtgacactcctccagaaaaccctgggcatcctatgatgccaatccactaaaggtaggagggtggtacttcttgtacctctcaagtctgagctgctccgtctcagaaaatgttgccctaacctcggcctgaactgcagctaccggctacatcggtataatctctggaacttggtcgacctgagcccgctgctctggagtaccggcgacgggagtgtgtgctcctcccccaacctgagatgtggcaggagcaagtggaatcaatccaccctaagctaaggtgctgatcatgctcagaaactgggctagagtctcctggagggctggtgcagcaacaagtacctcaggtgtctgccctctagctggagctactgggggctcctctgtagcagctcgtgtgggtgctctggctgcaccacgtggacgtcctcggcctctaccccggccccagtctcttgtggctttagtagggggcgcgggtgcctggtcatcagatctgtatgttcgtgtcctcaccatctatgagagaatagaatacagaagtttagaatttcgaagtcaacaatttcgcacgacaaggtattaaagaagtgaaatttttcctaacagttccatagcctccagaagataagtacaaacgtctccgtaccgatccgcgagactctaataaaccggcttgtgactcacgacacctatgaacctagagctctgatactaacttgtcacaaactaaactccctctgtataacgtcgtgatagcacctagtctctacgactaggtaagcctaataaattatggaaaataacaaaatgaaagtaaaacttgctaactaagagtaatggataactgaataactagtaacaatgctctcggcatgtacaataaccaatactctataaatacacagtcttcccaaaattcgaaacatcgtaagtcacaagatacagaaggaaaatagcatctctatacaccagagtctaataaaaggaatacaggaagtgtttgacataggggagaatagatggggactcctcggtctgcggatgcgagcagatgtaccttgaagtctccgaaacagccgcaattacacaactaattgcgaggtcagtatgatgaatctggatctgcacacgaaagcatgcacacaagaatatcataagtacaccacaatggtacccagtaagtgccaagcctaacctcggtcgagtagtgacgaggccaggtcaggcccactggtaaatgataaataaggtaggagaatatacagtataataagagactagaatttaacaaaaggaaacacaacaaggcaacagtacaacacacacaggggtaaacagtaggggatctcccgatataccgtctcgtagtcccaaaataaatatacagggagaactcccgaggtaccgcctcatagtctcaaaagtaaatgtacagggagaactcccgaggtaccgcctcgtagtctcaaaagtaaatgtacagggagaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaggtaccgcctcgtagtctcaaaagtaaatgtgtagggagaactcccgagaaaccacctcgtagtctcaaaagtaaacacacagctcaaaccgacaaatacaacagttaagtgcaagatttctacagttataatgacaaagaacgaggaaaagtaggaaattaactaggcatgcttcacagagttcaaataagcagttaaagcatgtagacatgcgatattagactaaacaggataactacacatattggaatatctcatttaagaatgaaatcagactaatactcatttaaacggtctaactcaaattaaaggaaaaacaggttgctacccagtaaaataaatcgggttttacaacaaatagcctatgtacatactcgtcacctcacgtacgcggcgctcacatatcaaaacagtaccaaatcctaatgggatttcccccatacaaggttaggtaagcgacttacctcgaaccaagctcaatcaatcggtaacgatgccttttccacgaatatccgactccgaatggcccaaatctagccaaaatcaattacataccataaatacaactataagaaactaatataattaatgaaatcaaagctaaagcaagaaattagaaaatcaccccaaaaggtcgtccagggcccacgtctcggaatcggataaaagtcacaaaatatgaacactcattcactcacgatttcactcgaaccaaaaattatccaaatacgatatcaaaatcccaatcaaaactcaaaaacttagttgaagaatttctcccatttttccgaaattctcaaccaaattccttaattaaatcactactagaaatacacagttttcccacggtaaatcagtgggaaattagtgggaaaattgagttttcacatcgcattcccaccaaaacggatccccggaaaaggcctggtgggaaaaagcttcccagagaagtagtgggaagtttcccacagttttcccaacaaagatttaataggaaaaataatgaagttttccaccgacaatccgtgggaagtattattagtaatttttattattttaatatattagacaggaaagtggtgggtaaaatgcatgtaatgaaaacaaaagtatgaactttcacaccgatatcagtgggaatcatgcaagatctgtaactaaaaggacgaaccttcccacatattcagtaggaagtttggaaaatatttttgtgcattgtgctgctttttatactgcaccacctaccaaacaaaaaatataactaccaacaacaagcctaaatacaattaaacattcacatacaaaattcagcattgattctgatccatttcataaacatccaaccaaaacagaaatacaataaaccaataatgcaactaaacagtcaaataaaaaattcaacatccaatcttatccaattgaatgaactcttccaacgattgtttgaaattccgcaagtctatataactctcctgtgatggttggattggatttcttttatcatcggttgattggctttcaatgaactcctccaacgattgtttgaaagtattctacaaacaaagttacatttattatatgaaaggaaaatcttttaggcttcataaagctaaatcgagttcaaaatctaataataatcctctaacctttgattttacatgagtgaatatgatattacctttgattttacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgagagtgaaaatgaaaagaaagaagaaggtatgtactataataggaaagacattcccactaattcactgggaatatttgtgggaattgtcttattaaattcatttttttgtgaaatgtttttaacctcgcgggttttttggaccaaaatttaaattttaaaattttgaatttcccactacatctgtgggaacattaaaataattgtttatctttagattcctaccgtttcactgggaagagtttaataattctatgtagtaatttttctaatgtatttcccactgattcggtgggaaacaaattgcacgcttttttgcgccaaataattcccacttatagtctgtgggaacgttttaaaaaaaggtaaaagaaaacccttccatttcccactgcatttgtggaaaaattaaaataattttttatctttagattcccatcgtttcattggaaaaagtttaacaattttatatagtaattttctaatgtatttcccactgtttcggtgggaaacaaattgcattcccactgattcggtgggaaacaaattaaatttccactgattcggtgggaaacaaattgcactctttttgcgccaaataatttccacctatattctgtgggaatgttttaaaaaaaaggtaaaagaaaacccttccatttcccactgagtttttctaaattgcagtgggaactgtcactaataatatatctgtggaaaattttcctgggaaatttacatttttctagtagtgaatgatgaaatcaactatagattagtgaaatataaccataaacgagttaagaatcattaccccaaagatctctccgaaatatccttgaattatcgcctcaatctgagctctcaaagacccaaaatgtaaatgagattaaaccctcaaaatttccccttttctgcccagcgatctcgcacctgcagacctctagtcgcacctgcgacgccgcacctgcgaaatttccatcgcaggtgcggaaatgacttaagaggcctgggaccgcttctgcgatgaggtggcctcacctgcacatgcgcacctgcggacaatggtccgcttctgcgaagtcctcacccactcggctcccgcttctgcgttcattcccccgcaggagcggctccgtttctgtgcccctattgtcgcacctgcgatcactggttacccagaccagggccgcatctgcgagctcctttctacacgtgcgagtccgcacctgcgctctccccaccgcaagtgcgaaaacaccagaaaccagaaaactttagcaatttgcatatgtccaaattcaatccgttaagcattcgaaacacaccagagggccccgagacctcaatcaaacatagcaacaagtcctaaaacatcatacaaacttagtcgagccctcaaatcacatcaaacaatgctaaaaacacgaatcaccctccaattcaaacataatgatctttgaaacttcaaacttctacaaccgatgccgaaacctatcaaaccacgtctgattgacctcaaattttgcacagaagtcataattgacattacgtacatactccaactttcagaatcagaatccgaccccgatatcaaaaagtccacttccgatcaaaatctcccaaaattggactttcgccaattccatcctaaatcagctacagacctccaaaacacaatccggacacgccccaagtccaaaatcacccaacgaaactaatggaaccgacgaaactctattccggagtcgtcttcacacagtcccgactacggtcaaaatcctaaaacttaagattccatttagggactaagtgtccctaatcattccaaaaccacaaacagaacctccgggcaagtcacagaaggagaaaaagatacgggggaagtagtaaacaggggatcagggctattactctccaaatgatcggtcgggtcgttacacttggaaccccagccaatcatactatcaagtacaaatacattattcaaacttatccaaagcctcagaacatcacaacaaagaattgaggctcaaacgaaatagaatttctcttaagttattaaatttctattctttcaaaagagtgtctgaatcatacttaaacacttcgaattacttccatattttgcacataagttcaatttaactatatagacatgtctaaagtcttggaaaaccaattggagtccaataacatcaaagtcaactcttggtcaaacttatgaactcttaagttctacaaattgccaactttcaacaaatagtgtcgaatccttctaggaacatccaaaatcgaatccgaacatacgcacaagtccaaaatcatcatacgaacctataagaattaaaaaaactgaatttcgagtctatttactcaaaagtcaaaccttggtcaactcttccaacttacttccaaattaagagtcgttcttccaaatcaatctcgaatcactcaaaaattaaacccagccatacacgcaagtgattatacatcatatgaagaaactcaaagtctcaaaccactgaacggaataccaaagcctaaaatgaccgatcgagtcattacattctcctccacttaaacatacgttcgtcctcaaacatgccaagagacattccaaagccatcaaagcactgtgtaaactcactgtacacatacctgtgggtgatcccacatcaacccaatccatataagcctgaccatacaacctaaccgaagatcttaacttcaaccttagtctataaaccttataatcaaattccaaatctctgaaatccattacaagatctgattcttacatctatacattgtataaatttgaacaggccgaatcacgccataacctcaacccaaaaggtaatcacatgatataccacattgctaagatactcatagaaataaatccctaccaccacaattgttcaataacaaacccgataccggtaataaaacctcatatcaaataaaaccttattctgaaccttagcacactgccaatgatgacaggaacacacataaactcataaccaccaatcagatcaataagtcatggagctctctcgcccgacaaggactatagccaaattctaagctgattagtgacgttattctttcaaacctactataatcaaatccgatagcacctattataggtccaatggactaatctcgtcaaatataagttgctctactgacatgctacaccaatacaacccaagtccacaaactgtgcaattcgcgcacccataagcaacaactcaaatgtacccaaaagtggtaaaatgactcaaaaaagagaactgttccacaagctcaacagataccaccacaagcacaatgctatgaacccatcacacaagggagaaccaaaacactcaaaatcatcacaaagaatcatatcccaacataactccaccgcagagcatgacccaatccaaacaccggtcgacatgaataaccttgagccataatgctctaaatcaataaccatacgctaatcaatcaacaaacacacaaagtgcatgaccatagccatggagaaatggatagcaccatataccacaaataggaaagaccataaccaaggtgaaatcaaccattaaccaccccaagaaccatctcgctcgaattttgccacatggcccaaatagaacacatcatgtgtgtaaatggccgataatctcataacccattgcatcatcgaagagcaatacatggaatccaatagaaacggataagatcaactcttactcggtgctgagtaaacaaatccgaccttgtgtagaatacacatcctcattaggcctaccaatgggcccccaaattagtttcggttatccacaaatagataaataatcctccaggagtccacaataacctacataacacataccatttgttgtctaactctggccacatcttcatagtctgcaaccaaaggataatccataactgagacttcagtctccaaatcacaagaatacaaaagaatcaccatatctgatcccatctccaccactcgaatgactaactcatctctcataccttatcatcccacgagaaatacttccatacatatagcatgatttgaacatcagcagtcgatcaaccaggggagtatcgcaataccaatgaatcatctgtaagtcaaaacacagtgcgccttctgaaatgcatacccttctcaagtaataccaattagtactagaattcatctaaatatctaaaactatctatactatttaaaattcatgaccttcccttcaaaactaaaccgcaatcgtgtacatgtaaaccttgatcccacacgttacatcacatctaccatgccatcatatgaaaatcacgagaatctcattaacaactctgaatcacaagaaggatacataccccatcatccagaagccttccacttgatcccttccaagataaaatcataacatataatgcatcctcataccggtaaaaaaatacccatctcaagccatagtagaaatcatcaagaactcttcgaaaaccattagtacaagaccaagacattagaactgattcccctacctgaaccaagtcacgcaggtcgccagactcaagagtattgccacaaaacaccggcgtatccttaccacatcataagaacccaaagaacctatcacattcattaccgtcccgatccaacccactaccaagctatcctatttctctgagttccttctgaatttccttcaaactaacacttctccctgccagaacaccacgatccttacccaaagctcaccacaagagaccctaacatgaaaccacgtagtccatatgactatgatttgttttttattttttaaattgcacaagtgaagtggaagcctacacgcgtcaagtctattttaactacttttttttcttcttcttctttttcttttttgctacagaagaccggatattattgaaataagaaactaaggtggatcattacaaaccggaactgattgccgaatatcagtttctaaatcattaaacattgaatacctaagagtattttatggacatggttaaaagtttaaagaatggagatttgcttgtaatgagtcggaattattgatagttttataaagtaaggaattagcgttaatattttcagcttcttagagaacatatacctaattaaacagcatatgttttaaaaaaaggcgttttccaaaacagaggatatctaaatataaattgttttaacaagtttctaaaagacatttctgcataatcttcttagaaagttctctagcaactcttgatcagacggtttcttagaactttgcttattcgatcgggtattccttctctgcattatgcatattgtctttgaaaaaattacgctcatttaatttaatgagcattaattactacatacaaaacataaataacgaacatactaatgaaaataacatgattgaacagtaagttatttatgcagtaatgttgctgcatttggaaaaagaactgaaaactcttcctttcgaatagttatattaatatctctaggtcgcggatatgaccaaccaatttggctttggctatagaatttatgacctctatatttcttttccttagtcccattttccgatgatgtggtggatgaagtagaagatggctcaagtgagcgtgaattatgacgtatccctgttactctagtcggctcaggcatattgtttgagccaattaagtgaggaaaattaagccgagctctcgagccgcggattttaaaagcggcttgatcatacgccaatgctgcatcttcaggagtctgataagttcctagccacaatctcgcgcctcttctctccgggtcccttatctccgccgcaaattttccccacggccgccgtctcactcctatgtacctcctccaatattgcttcgtgttttcctcacgcgctgcctttccaccctcctcgggctcggattgagattcgagaattgttgtttcttcaatgttttcatccaaaaggcagctgccaaaacttgagctaggactattaggagttgcgacattgctcgaactcatcggcgaaaaactgttagaaaaatcggaatcattcagaagatggtgctcaatagagtcaagaaaatcaacgtcagagaaagagaaggttgcattatcagctggattcattttcttttcttttgccctaattaggttttggatgaatagtttcttgaacttgttcttactagggcttattgcgtacgactatttatacgcttgcccttcaaattgtagctctagactctgcattacctttattttctttttggaatttccgtgaaggtgcaattttaagcacgtgtatgttctgcttttttattttcattattctaataatgtttgatgataaattaaataatgtactgatcttcatcaattaaagaaatgatatatctctagaactgcagtcacgttcatttctgaaaattttagtcatttgagatcctttcttaacggaaatatatttaatctatatgaagaacacgcttagaatatgtgtacgtttgtatctagtaataacatgatctgtcaaatgcaagaaaagagtgtactatatttctattttaagaaataaaggtccgatacattctcagaaacgtgaagatagtacccatagagtggtggatacttctgtcttttttctgctcaattttagttgaagaaggtaaatattgctgaactacatttttactttggattcttctctttatatgtttttttggaaatgaaatatcaacaaattaaattaatgattttctttatgacaatgtggaaagaatcttacagatttttggtgcctggcatgtaggaagctctcgattgataagaagagggaggcaaaatgaaaaatattaaatgagaaataatatactccctctatttcaatttgttttgcattgtttgacttcacacgaaatttaaaaataaaaaaaaattatttcaaaaacttgtaattataaacatgtcatagtattatttgtagctataagagtaaaattttttgacttaaacatgacataatatttgtgtgattaactataaaaaattatcattaagataatatattatttttttaggaacgaactaataataaaataatgccaacaaaatgggacggagggacttatttgtgtttgacaagagtatttttattgatgaaatcttttttaatcgtttcacctaaatggatcatcactgatgagtggaaatttgccctctatacgtcttccaatcgttattttttagaagaaaaaaataatcatatcacttagctcaatcaacatctatacattcttctagatgtttagtattcaaaatatcattgaaacacgatccttataccatactactccttgtacgattatcaattgttacatgttttaattttataccaaactaaacactagcgcgaatgatcaatgcttttctaatataaaacattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccccctagtgttaaggcttttatttttttttatttaaattggtctccaataattatttatgtgcaaaaagttacaatttgagtttggctttccaaacattatacatgatcattgagaagagacttctagtgttagttctaaccaaaattctaatatacaaggtgatttggggggggggggggggggggggggtgtgtgtatatatatatatatatatatatatatatatatatatatatatatatatatatatataaggcttgcttcttttgattttgaaagatggaaggttccaacagttcatgttaacaaggcctttaacttgattgagcagtccaacaaaagagttgaagacatggatcgtatcaagactgtgactcaagtttgccaatttatcagcaggtctattggcttctctgacgcagtggctgatatcaaattcatgctctccaattaggttctggatttcactaatgatgttggtgattttccaaggtaccttccgttcccttttaatgcacttggatatgagcaatgagtcagtttttcccatggctatttcaaagccattatcaacacactatttgaggccaaataatattgttgcagcttcatccatattgctagtactaggccccatgggaattgagtaggcaaaaatgataattccttggttattcttgataagtcctcctcctccacaaatgtgttggatgcaacttacatcactgttaagcttcatcttttgagcattaggtctgatccatctgaccattgtgctagtcttctgctctggtatagcttcacatgcttgacatatagtgtgtcgatcgtcccctacattagctcttccaaatctgcttttcagtacttgtaaaagagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattatattagttttcgttttatgaaaagatggtctgatgttttcaaatattttggtgcatcttcactttcataactcccaacatatgataaatgaaagtctccttgtgatgagtatggaaatgggattgtgattcttaataatccaccaagtgaggagttggattttgagattcctgctactatagtccatccctagaggtctagcaaaatagctcaaaattttgttagcatgatcccctaaacagaatagatgatcaatgttctcaattctaggattctagttgttgttgttgcagtagtggaaaatggtgttaacttggatcccaaacctaaaacatgtttcctctgtagataatttatcatgtatggctctccaggtaagggaagagatcttaaaggggatatccttatgccagacaaaataaaattatccagattttttctctatctgaagatgtcccaagctgagacaacagaaaactttccaacagtagatggtatccaaatggctttgtctctcttgtttttgtccattttgatattaagagccttgatcttatcctgtgtttcatcatctagttgagtttggaacctattttaatttcataagccattactgatgatatcattgaccttaatctagttgtagctagtcatgtcgggaagcaactattgtaaaggccttgagtagcttcacatcatattttatgacttgtacgcatagtcaaaatttaatttcggaaagttcgaagttgattcggaaggaaaattctcaattcggaagctttaaattgaaagagttgactaaggtttgacttatgagtaaacgaccttggaatagggatttaaaggttccaataggtttatatgatgatttcgaacttgggtgtatgttcaagttgagtatcgggtggtccgagagcatttcagcgcttattatggaaagttagtattttgaaggttttgaaatttcctatgtttggtttaaagtggactttggtattatcgatgtccatttagggtttcgagtcttcgaataggttcgtattgtgatttattacttgtgcgtaaagtttggcatcattctggaatgtttaagtatgaatcgaacgtgttcgtctaagttggaatgtttcaaaactaaaagaaggattttgatcgtcgattcgtagtttggatgttgttttgtgttattagaggcctcgagcaggtttttgtcatgtcttgggactggttggtgtgattggaggaggttccgggaggcctcgggtgtgtttccgggtggttttggaccaagtttggatgggttgttgttgatggggtgctggtgtgcttcgcgatcacgaaggtagtcccgcgatcgcgaagaaggctggtgaagggcccctatgtttctcttcgcgaacgcgaggaggcttacgcgaacgtgaagaaagaccaagtcctacttcgtgaaggcataggctggatcgcgaacgtgaagaagtttgggaggggatgcctgtgaggcagaaagccttcgcgaacgtgaggtgtggaacgcgaacgcgaagggcagggtcagctgagcatcgcgatcatgaggcttttttcgagattgcaaagaagagcaggcttgggcagatttgatttaatatgggatttggctcattttctttcattttcacttggttgcacgacttttggagctcttgaataggagattttcatcatctatcatgaggtaagttcttcccacttgttgtaagctatatacacgagttgtacatagatattaacatgaaaatttgtagaaattgtgggattttgggagaaacctagaaattgatatttttggattttgaccacaaaatttgacgtgagattaggaataaatgatatattcaagttcgtggtattatgggtaatatttatcttcaaaattttttgaaatccgggcatgtgggcccaaagattgaatttgttgacttttcgagcggagttgggaacagttataaattgattaattttgggtgttggagtatatttttattagtttgcatgttgtttgactagtttcggactaatggacatcggtttgaggtgttaggtattaaaattgttatgtgctactagttgtggatgctacgtacgcacgaggtgacgagagtccgtacatagctaaaagcatgtttatgtccgggtagctaagactttatcatgtaatatttgaattatttgaactcatcttgctagcttaattaagtaaatttataattgaaattgattggaatatattaggccgagctttatcgccttgagttgtctggcgagatatttgataaacggtaaaagtcatatttactttatgccactatacctgtgttgtacgcacatgactcatagttcgataaatttcttcttttcctgtggatcgggccgaacgcctcgacaatataatgagacgcttctctagttcgcactggtcgaccctcgtcagtgtacatatcactttggatcgggccgtacaacattggcataatcgtgcgtgataccgctagcagtcggatatttaggagattccctttttattgaggcatgacatttatatggtattccttattcgttggagattgcatttgatatttctgatatgttggatagcacatgagatttgagagatttatatcgttaaaagaaatgttagaggattatgctagttaccattttatctcattatcattgttgtgcatcatatctgtttatgctttatcatactgatttattggaccactagtaagtctcgatgtcgacctctcatcactacttctccgggcgtcacgacccaaaatccgactagtcgtgatggcacctaacccaaccgactaggtaagccaattaaccactaaccaattccaataacaattaataaagcaattaagtaaagaaatatctaaatctaatacatttcccaagaactggtagtacaaattatgagcttctaagaatagaatttaaaaaactggtatgaaataatacatcatctgttcgaaatgtacatgaatagatttttataatctaaggcaaccatgaaaaagaggcaactacaaccaaaatgcaggtacatcttcagatccagctcccaacgaacacaacaacatcaacatccaacatttgtacgcaaggtgcataagtgtagtatgagtacaaccgaccccatgtactcaataagtaacaaacctaaccttaggttgaaagtagtgacgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaaggtcgggtccaaaaccaatagtccataacaacgtaaagcaaataatacaagaagtaactgagagataaaatgctcagcttaatcatgatttctgaaaatagttctgcctttcaggtacatcaataaaaacccaaatcgtttaccagagttgccaaaattatgaataggtttaaaaacaataatttttcccaaaatcctttcaataataaataagatgtttcttttacttttcagataaccagtgtaaaacaaatacatcactatgcccatcggccaacatgttacaacccaaattcgtgtaccttagatcatgccgtaagttagtcgacgtaaatccaagaagagattatctttgagatgataagaatttaatcctattggtcttaaacgatacaagggtgtataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaatactagaggtgattaattgtcccaagaggtcatgttttaatgtattttaatcatataatatccgtatcataagtcttgaagtcaagcgagttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggacccacataggcggtttagacatatggatatatataagatacctcaaccccgttttaagttattatttttcagtatattcagaccttagaaccctaaaaacagtatctcaaggttctctcatgatccaagacccaaacaaagggcaaacaacacaaatcaagtgtcgggaatcccgtggcgctagtaagtttcttgttcttcttgttgttgctgatttttgtgttgttccagctcgtgtgggaggttgttttaagtgtttatgttctgtaaatacaccttcaagtttttaatatcaaccctaggtgatttcaagtcttctaaagtaattctagtgccgaaaaacccgaattgattgctagtttcgcttccttgttcttgtggcagaattggagggatatttcgtggaaaattaaggtcaaattggagttgttctttctgtttaaaggtaaggaacctcttactctatatgtatttaagattatccaagttgcggctaagtcgttgaagctagaacttgtgaaatatatatcgaaaggcttggtagtaatgttgttggttggtggactattttggaggctcaatatgattattaatgatgttgtttgggctgtttggtgattgtattgacttgtgggaagtcatataaataggggaggtgctgtccgtttcatcgtaaaataggttgcggtcgatacataatagttacgacgcttaaacgataatgatagtgtcatttctcttattgtagactaaggagtcgtgacatttgcatagcttgaggttgggcagtatatacaaggtatgtgaggctatccccttcattcttttgcacgactccgattgtacataatgtaatgaacgagctccaaagatactctactcttagaagctagcagtacttacattgctgcccttcttatgaaacgattgatattgatgttacttctcttattcttatattatcaatgttgttggtagttcctgattcttataagattcttgatgaagagttaatattaatcctaataagtaaggatactgaccttacgtcactccgaaaggttcaacatgtgattccaatgagtccaacatgcatcatatatatgtatctattttactctaatgagccgcgttatagtcggccgggtatggcacctattgtgcaaccactgatcagttgggttttaccgagctccacgtggccgggtacgattctaccgagccttatgatggccgggtacgttttaccgagcctattatggccgggtacgatatgatgatgatgatgcccacaaaggcgtatgttttaaaagtttatgtatatatatgtatgtatcatgtatttcatgtcagtagccctcagaggtacccagatgtcacaggttgtatattctctatccctgtttacattactgttcttacttatgctttcctgccttacatactcagtactttattcgtactgacgtcctttttatttgtggacgctgcatgtcgtgctgcaggtcctgatagacgggtagacgcagctcccccaccacagtaggctatccagttcagcggttattggcgagatcccttctccggacttgccgtggtcttggtatgcatttttgttatagacattatgggtatgtcggggccctgttccggcaatgttgtagcacttatgttcctttagaggctcatagacaggtgtcgactcatgtatggtttggaatgccttgtcggctgatttttgttgtatagtctttcatggcagcatggtagctcgtaccttatatatagtttcttgacagtcttgtcgtcccatgttatgtatgttcatgacattatctttcattgttggatgttcatgatccatgtctaccatttatattgatcttgtcggcccttaaagataataaggaaggttagataaaatgtacgttggtgctcggcaagtatggcccgggtgctagtcatgaccctccagttgggtcgtgacaaacttggtatcagagcaagtctgtcctaggggttgtctatgagccgtgtctagtagagttttgattatggatgtgtagcgcgccacatttataatcaggaggctacatgacatctagggttgttaccttcttcctgaatctagatcgtgcgtagagttgagtcgtaagtgttcatatctaatattcaccttgttttctttcagcgatgccttcgactaggaagcaagcgattagtaaacggcttgatacagctgtgggagagggtaacattcaggtgcctccagccagagcaggccaaagtgaggctcagagtgagatgccgtctcatacctctccgtctcctccagaggatattaggaggcacccagtacatccagttcctccgtctggcactacagaccacgatatgcgcagtgcggtgcagttgttgactagcttggtagctgctcaggctcagaggcagaataccggtgctgctgataaaccggttagtgcgagagttcgtgattttattaatctagaccctccagtgtttaccggatcagaccccaaggaggacccacaaacatttattgatcaggttcatcgtacattgcgggttatgcatgctagtgatacggaggcagtagagttggcttcttatcggttacgggatttagcggttttctggtatgatagttgggagagatctaggggtccgaacgctcctccagccgtgtggaaggaattttctgaggcctttcttcgtcactacttgccagttgagatacgacgagctagagctgataagttcttgaaccttcgacagggtaatatgagtgtacgagagtatagtatacagtttgattctttagcaaggtatgctccccatatggtggccgagatgagtgatagggtgcatctgttcgtgaacgggttgggaccacatctgataaatgagtgcacaacagcctccttggtagagggcatggatatttcccgtattcaggcttatgcccagaccctagaggatcgtaagcgccagcaaagggcagatagggagcaggataggggccagcataagagggcgagatttgcagggtattctgatgagttcagaggcagtatcaggccccaatcttcgaggagttcggcgccacctgtagctagtgctcctccacagtttcagaggcctcggtatgatcgatttacctattctggttcaggtcagagttcgagggcatcaggctcacaatttcatagagatactagtcagacgagacccccaacacctcgttgtgatcagtgcggcaaggcccactttggactgtgccgtcgaggttccgatgcgtgctattcttgcggacagcctggccatatgatgcgggattgtcctaacagaggaggtggtggtatggctcaccgactggatctgtgtctggttcttcctcatcagttcgacctccagcacaaggttttcaacagtcgacaggtcgtggtagaggtagaggtcagtgccgagttcgagtggtgctcaaaatcgaacctatgctctagtaggtcgacaagatctcgagtcatctccggatgttgttacaggtatattgtctgtgttttcttatgatgtatatgcgctaattgatccaggatctacattatcatatgttacaccctttgtggctaataagtttggcattgaacctgaattgataagtaaaccacttgcggtatccactccgataggagattctgtgattgctagaagggtatatagaggttgcactgtgatgatttgtagtcgtcaaacctcggcaaatttatttgagttagaaatggttgatttcgatgtgataatgggaatggactggttggcctcatgctatgcaaatgttgactgtcgtacgaagatggttaggtttcagtttcctggtgaacccgccattgaatggaaggggaacattgctacgccgaaaggtaggtttatttcctatcttaaggcaaggaagatgatctcaaaaggttacatttatcatcttgttcgcgttagggatgcggaggcgaagccgcctactctacaatcaatccccgtggtcaatgaatttccagatgttttcccagatgaactcccaggccttcctcctgaaagggagattgagtttagcattgatgtgttgcctgacactcaaccgatctctatccctccatacaggatggccccggcagagttgcgagagttgaaggcgcagttgaaggacttgctggataagggtttcattaggcctagcacttcaccttggggtgcgccagtcttgttcgtgcggaagaaagatgggtcgttaaggatgtgtatcgattatcgacagttgaataagtttactataaagaacaagtatccacttccaaggattgatgacctgtttgaccaactccagggtgccaagtatttctccaagattgacttacgttcagggtatcatcaggtgagggttaaggagaaggatattccaaagacggccttccggacaagatatgggcactttgagttcttggtgatgtcgttcgggctaacaaatgccccagcagcttttatggatctcatgaatagtgtattcaggccctatcttgatgtgttcgtgatcgtattcattgatgacattctggtgtattctcgttcggaggcggaacatgcgggccacttgcggatagtattacagacccttcaggatcgtaagttatatgctaagctctccaaatgtgaattctggctgaactcagtagcattccttggccatgtgatatctgacgagggtattagtgtcgacactcagaagatcgatgcagtgaagaattggccgagacctacaacaccgtcagaagtccgcagcttcctggggctagcaggatattataggcggtttgtagaagggttttcctctatatcagcaccattgactaagttaacacagaaagctaccaagttccagtggtctgacgcttgtgaacatagttttcaggagctaaagaatcgattgacatccgcgccagtgctcactctcccagaaggaacagaaggttatgtggtatattgtgatgcctcaggtataggtttggggtgcgtattgatgcaacgtgggaaggtgattgcttatgcatcaagacaattgaagaagcatgaaaagaattacccgactcatgatttggaattggctgcagtaatatatgctttgaagatatggcggcactacttatacggcgtccatgttgacatctacacagatcacaagagtttacaatacatcttcaagcagaaggagttgaatttgaggcagcgtaggtggcttgaattactgaaagactacgacgtcgagatattgtaccatcccggtaaagccaatgttgtggcagacgctctcagccgtaagtcaatgggaagcttagtacatattgaggcaggtagacaagggttgacaaagagcttcaccagctggccaatatgagaatcagattgttagactctgatgacggaggtgttactgtacagaatacagcagaatcatctttggtagccgaggtaaaagcacggcaatatgaagatcctaccttagtaagattgagagagggaattcagcagtgtaagattacagctttcaagatcggaggagatgggacactgagataccagggccgattatgtgtgcctagtgtggcagggttgcgagagaagattatgattgagattcatcagtcccgatattctatccatccggctcgacaaagatgtatcatgacgttaaggagcagtattggtgggataacatgaagaagtctattgcagaatttgtagcccagtgtcctaattgtcaacaagtaaagatcgagcatcagaaacccagtggattgattcagaatatagagattccgacctggaaatgggaggtgattaatatggacttcattattggattacctcgctcttatcataagtttgactccatctgggtgatagttgatcgacttacaaaatctgcccattttctgccagttaagacaacttacacggctgaagattatgcgaagttgtatatcaaggagattgttaggcttcatggtgtgccggtatctattatatcagaccgaggagctcaatttacggctaacttttggaggtcttttcagaagggtttaggcacacaagtaaatctcagcactgcattccatccgcagactgacggacaggctgaacgtaccattcagacgcttgaagatatgctacgagcatgtgttctagatttcaaggggaattgggatgaccatctggcacttatagaatttgcctacaataatagctaccattccagtattaaaatggccccgtatgaggcactgtacgggaggagatgtagatcaccagttggatggttcgaagtcggtgagacagaattatatgggccagatttgattcaccaagccattgagaaggtgaaagtgatacaagagcgactgaggacggcacaaagcaggcaaaagtcttattccgatgtccgacgtcgtgatctggaatttgaggttggtgattgggttttcctgaagatctcgccgatgaagggtgttatgcgttttgggaagaagggtaagttgagtccgcggtatattgggccgtacaaaattcttcgacgaattggacaggttgcttatgagttagaattgccatccgaattggaatttgtccacccggtattccatgtatctatgttgaggaaatgtattggagacccttctcgggtcgtccctatcaaagatgtacaagttacagaggatctatcatatgatgaagtgccagtggctatattagatcgacaagtccgcaagctgagaacaaaggatgtagcttccgtcaaagtattatggaggaacaagaatatagaagaaatgacatgggaagcagaagaggagatgaagtctaaatacccttacctattccagagtgaagataacgaggatgccgggggaaagaaggacgcattataaggtgaaacggctctatgaggtaagcaatagcttgtgaatactctttttttaatacaaaatggtgatatgcagataatgtacatatccataatgctttgtatagtcttgtaaggccataggttgggtttaactgcttgcaagtttggctagtgtccattttataggggaaactcagccggaaatctccgtcggaatccacgatgagttagacaccccataaacccttacattcgaggacgaatgttcctaagggggagagggtgttacaacccaaattcgcataccatagatcacgccgtaagttagtcgacgtaaatccaagaagagattatctttgagatgataagaagttaatcctattggtcttaaacgatacaagggtgtataagagtggttaacaagtattagaagttaaacgaatcaaggatgttgtaacccgtattttcgggtaacactagaggtgattaactgtcccaagaggtcttgttttaatgtatttgaatcatataatatccgtatcataagtcttgaagtcaagcgagttatgaaacaaaagtcgataaaagttgtcgcaacttaggtttataattttacttaaactttaggtcaaatgttactgcattttctcccaatgtgcttggaattatggggtgatctacctatcaaattgaagatctatgagtctagtttccaacgcattaaaccgttcgtcgatacgatctcggaatagagagatattcgcgttttcgcgagagtgcgccaagctgctctctatggggcccacaaaggcggtttaagacatatggacatatataagatacctcaaccccgttttaagtcattatttttcagtatattcagaccttataaccctaaaaacagtctctcaaggttctctcatgatccaagacccaaacaaagggcaaacaacacaaatcaagtgtcgggaatcccgtggcgctagtaagtttcttgttcttcttgttgttgctgatttttgtgttgttccagctcgtgtgggaggttgttttaagtgtttatgttctgtaaatacaccttcaagtttttaatatcaaccctaggtgatttcaagtcttctaaagtaattctagtgccgaaaaacccgaattgattgctagtttcgcttccttgttcttgtggcagaattggagggatatttcgtggaaaattaaggtcaaattggagttgttctttctgtttaaaggtaaggaacctcttactctatatgtatttaagattatccaagttgcggctaagtcgttgaagctagaacttgtgaaatatatatcgaaaggcttggtagtaatgttgttggttggtggactattttggaggctcaatatgattattaatgatgttgtttgggctgtttggtgattgtattgacttgtgggaagtcatataaataggggaggtgctgtccgtttcatcgtaaaataggttgcggtcgatacataatagttacgacgcttaaacgataatgatagtgtcatttctcttattgtagactaaggagtcgtgacatttgcatagcttgaggttgggcagtatatacaaggtatgtgaggctatccccttcattcttttgcacgactccgattgtacataatgtaatgaacgagctccaaagatactctactcttagaagctagcagtacttacattgctgcccttcttatgaaacgattgatattgatgttacttctcttattcttatattatcaatgttgttggtagttcctgattcttataagattcttgatgaagagttaatcctaataacgtgtacgaaggataccgaccttacgtcactccgaaaggttcaaaatgtgattccaatgagtccagcatgcatcatatatatgtatctattttactctaccgagccgcgctatagtcggccgggtacggcacctattgtgcaaccactgatcagttgggttttaccgagctccacgtggccgggtacgattctaccgagccttatgatggccgggtacgttttaccgagcctattacggccgggtacgatatgatgatgatgatgcccacaaaggcgtatgttttaaaagtttatgtatatatatgtatgtatcatgtatttcatgtcagtagccctcagaggtacccagatgtcacaggttgtatattctctatccctgtttacattactgttcttacttatgctttcctgccttacatactcagtactttattcgtactgacgtcctttttatttgtggacgctgcatgtcgtgctgcaggtcctgatagacgggtagacacagctcccccaccacagtaggctatccagttcagcggttattggcgagatcccttctccggacttgccgcggtcttggtatgcatttttggtatagacattatgggtatgtcggggccttgttccggcaatgttgtagcacttatgttcctttagaggctcatagataggtgtcaactcatgtatggtttggaatgccttgtcggctgatttttgttgtatagtctttcacggcagcatggtagctcgtaccttatatatagtttcttgacagtcttgtcgtcccatgttatggatgttcatgacattatctttcattgttggatattcatgatccatgtctaccatttatattgatcttgtcgacccttaaagataataaggaaggttagataaaatgtacgttggtgctcggcaagtatggcccgggtgctagtcatgaccctccagttgggtcgtgacacaacatgtgtgagaaatcatgaatgatgtgataccgtacagcatgaggaagatacatctctatgcctatatgtcatgtgtgcatgtcagtgcaatgtatctcagagatgaatcgtctactcacactctcagagtactcaactcactgtctcacacttttcactcatcatgctcaaccactcggtactgtatacggaccaggaaagatctatcccggaatatatacatcactgaccatcagtcactcagtaccgaggaaggtcaatccggccctagggagaagatccatctccaggtatataaatgcttcggacaagatccatgtccagtgaagatccatccctcaatataatcaaccacgctcactaggggtgtacagactctggaggggctcattcagcccaagcgctataaaccgcacggacaactcacatgttatagtatcaatatctggatccgcacggacaattcacgtgctacacagacaactcaagtggcatagtatcaatatcctcacaatcaggccctcgacctcactcagtcatcaatctctctagtctctctctcgcgggctcacaatgtcataaaactagcccgaaaatgatgatatgatgtatcaataaatagcaacagaaactgagatatgatatgcatatgaatgcgtatgactgagtatgtaatgcaatgaaagcagataattcaacatcaaaaatgacctcagtgggtcccaacagaataagcatgtagcgtaaacatggcttctaacatgaatcatagctcgataactctagtacgtaaagatttattgattacagacaagttcaggtaactacacagtactacagaaataacggaatcacagttcacacgatacacgcccacatgcccgtcacctagcatgtgcgtcacatcaataccaaacacataacacgtatattcagggttcataccctcagctccaagattagaagagttacttacctcgaacaagacgaatccaaagtcgagcaagctaaacaatgctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaatattttcccaaaaattgcttgtggggtccacgtctcaaaatccgatgaaacttataaaatccgacaacccatccaattacaagttcaaccatactaattttactcaattttgactccaaatcgatattcaaaactcaaaaatttatttttatgaaatataggaatttccttcgatttctcttgaagattcaataatcttacaccaaaaatgaagattaattcatgaaatataatcacaagggagtcaagaacacttacctcaagttgtgtggaaacattcctctccaaaatcgcccaagtcgagctccaaaataagaaaatggtgaaaaatagcgaaacccgaacttaaagggttctgtcgagcaccttcgcttctgcgaaatttggactgcatctgcgcctatcgcaggtgcaagaagcccatcgcacttgcggctcaaccttgattttgcgcccttcagcccgcttctgcgactatcgcaggtgcgggattgtcttcgcacctgcgacctctgcccagtccttccttggtcccttctgcaattcattccgcaattctgcgtgcgcgcacctgcggtgccctctctgcaggtgcggtcataccagtagcaacaacacatcagttgcttcatcaactcaaaatcaagtccgttaaccacccgaaatcaacccgaggccccgggacctcaaccaaatataccaacaagtcccttaacataatacggacctactcgaggcctcaaatcacacctaacaacatcgaaacgacggatcgcacctcaaatcaaaaacctatgaactttgaactttcaaattctatatcttgtgccgaaacacatcaaatcaatccagaatgacttcaaattttgcacacatttcacattacggacttattccaaatttccagaatttgattccgaccccaatatcaaaaagtcaacccctcgatcaaactttccaaaaatttaactttcgccatttcaagcctaattccactatggacctccaaatccgaggtcgtttatcatacggagctattggaattatcagaattcaaatccgaggtcgtttacacataaagtcaatatctggtcgactttttcaacttaagttttccattatgagtctaagtgtctcaattcatttcgaaatcttttcagacccgaactaactaatctgataggtcataatacagctataaagcacaaatagagcagtaaatgggaaaatatggctgtaatactcaaaataacctgccgggtcgttacatcggggttaggctagatacctactgggtatgcgttaatttaagtactcatgctatatttctgcactaaatgtgtaggatctgacaggttcatttggtggtcatctttacgcgtaggcacagatgctgaggaggctttatggtgagccgcatttcaggctacgtatcgtagtctatggagtctccatcgtattatttactttatcttgtctcatttaaattccagataaaagttgtattattattttactccttagtaaatgctcatgcatttgtgatacgaattgtgggatattctagttgatgtttacgaattagcatattattatcacctcttattcttatgtcatactaattatgtatgtacctgtgattttaaatgcttaaatttctttacataataaaatttatgatttcaaaagtaataaaataaaaaattaattagatggttcacagttggcttgcctaacggcgacgttgggcgccatcacggtctagagtggatttcgggttgtgacaacaagtggctgctaggaatttgaggttatctcctccttcgttgtaggggaagcatagttattccaagtagtctagtgatatttaccacttgtgtcttgtcctgtccagaagcatattaatatacttctcaataagctccaaagtgcttttagggggggggggggggggggggggggggggggggaaaaaagggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctctttatttgtggagagggattttgtttgccaacccatgattttgctaatgatattgttgacaatgtcatagtagtatgatatcttcctcattcctgtggtgcgagggcatcccagatacttgatagggaaatggtgattgttcattccaatgatggtcatgagtctgttgattatggatgctttagtgttattagccactacaaagcaacttttatctttgctgatgagttgtccatacactttctcataattattcaaggttttcactaccatctccagagattttttgcttccattacagaacatgatggtattatctgcaaaagaaatgtgattaatcttaggaccattgatatttatatagaaacccatgtatccttctctatcatgaagattgtttaatattctggacagtatctcagcactgataataaacaaaaatggagatattagttctccttgtctcaaacctctttcagatttaaaaaaatccatgtcttcccacattgaaaataatggagtaccaattattggatatgaagttatagatgagattaatccaccattctgagacgccaagtttccgtagagccagacatataaaggtcgaagaaactttatcatatactttagccatatcaagcttaataataatatttttacctctataggtcttcctaatgtcattgataatctcctggtctaggagaatattatcagttatagctcttcctttgataaatccatattgattcctatagataatcttagggagaattttaaaaataatcttaccgaacacattgcacaggcttataggcctaagatctatgaatttttgtaggtgttaaaccttggggatcattactaataaagtgtgagtgaagaacttggggagttctgcaccattaaagaaagatttcacagctttaagaagatcatagcatatgatgtcccatgaagtttgataaaaatagtcatttgagccattagggcctggtgcactatccttgtcaatagaaaacaaatactatctttcacatcttgtgtaataggtgtggctatgagcatgttgttatgttcctcaattatacttctctcaatacaatccaaagctttaaaattggtggcttgagtatcctgggagaatattttccggatgtgtcgaattgcagtttctgttgtgctatcatttctttctattcattggttctgctcattcatgatcttagtaatagtcattctcctccttatttcctttataattgtatgtaaatatgatgtattagcatcacttcttcaaaccatttggctctggatttttgtcttaagatagtttcttgaatatttaggtaccttgtgaattcagctctgcttctagataattctcttctattttcaagagaattgtcattcacacaattatctttaagagttgtcatctcagctttcaaccttttggtttcttcatagatgtcaccaatagtctgtcttaacctgttgctcagctctttataaagttttttaatcttttaatgtagtgtgtagaggggatttccatagacctcttcttcccaacattcctgaactgttttcagatattcaggatgttcagtccaaaagattagaaatttgaaataccttatgaaagagcttatctcagagctcattttaactagtaaaggttcatggtctaaacaagctctagacaaatgagttactgagatgttattgatagagtcaaaccaagtagtgttgtaaataattctatcaagtatattccatatgttgttggttggtctctgttatcacactatgtgtacataaaacctataaagtctgcatcctgaagcccatactcattaaggcactcaatgaaatctaggctctcttccagtctacgccttcgtccacctttcgttttttattggaagtgataacattaaagtcttcaatttccctcaggggccttgtatgttgttagtcatatctttaagatcctgtcatagctctcttctctgttgtttagtgcatttagcgtacaccactgtaatatagatatgagagctattgttgtaagaaacattgatcagtacatattgcactttgtcttgaatggtggtaatatccacttcttttgtctagaggatccaggtcttatttgagcagttatagaagccctgctgcataccaagtcttcttctgaatttgtccattttcctattgtccatcataggttcctataaacatattaaaggatttgaaattattgtttgatggttttgactatctctagagattctttagaagcaaccccccttatgtttcatgaaattgtattaatcattgggtacattagaggtaggttccatttgctcttccttgttctcttctgcatttttatgtatctggacaaaaccaccaccagggttctaacattttctaggagttaaattgttgaagagggtgatattcggttgtactcatttacctctatggttgagattatcatggtattcagagttgatgttacctctgggttcatcatctgaattagatagtcggctctcctttctatagcctatgtctatttctgttttcatgttgtctatatcttgaaaaacttctttaaactcctcccttggcttttctcctttttcacactgataaggtggttcaagatccttgttgagggtaaaatcttagtcactattcctactagatgagcttggatatctatcttccctcccatcttcctcaatgataagggacctttcttgagtaacttatttaaggttgagtgttggccagttgatagtgtgatcaatctccttctttatgatgttaccattgatctttcttgcctttccttgacgtgtaacctcctcaggaatggctacctgtttagaatattttttcttcttgttaagtgagagattgatatcttttgggtcaacgatatccaagttgagcatttccccttgtagttcagtgtcactcatgttggtgcgggtggaattttcagctaacatttagccttgtttgttgttttttgtttcatcttttttctttctccttttgggatttgtcccatcttgtgcttcttgactgatgctgaatggattcagtagtatactgatctttgtcattatcattaatgcatgatctagtgtccatttcctcttttccagcttcttcttgaagtatgctgaatgaattgttagtttctcttatttgctggtttcctttggtgtgtgtattttccttgaaggtaggctctataaactgtggtatagtatctttctcattattgttgtcctgattttgccctttttgtgcctgtcacgacccaaaatccaactagtcgtgatggcacctagcccaacccgctaggtaagccagttaaccactaaccaatttcaataataattaataaagcaattaagtaaagaaattatctaaatcttatacgttccccaagaactagtagtacaaatcatgagcttctaaaaatagagtttacaaagctgaaatgaaataaatacatcgtctgtttgaaaaagtacataaacagaatttttatagatctaaggctaccacgaacaagaggcagctacaaccggaatacggcaacatcagcaaccaacatctgcacgtaaggtgcagaagtgtagtatgagtacaaccgaccacatgtactcaataagtaacaaacctaaccttaggttgaaagtagtgacgagctaacaaaggtcgggtccaacaccaatattccacaacatttcataatagtatagtacatgtaacaaaagagtatctcagaaataaatggctcagttcgttcacagttccagaaaaaataggcatttcttttcaagtatctcagtgaaaacccaaatcttttaccgaaaaatccaaaatacgagtaagtttgaaaactgtaatttttcctaaaagtcctttcaacaaatagtaagatgtttcattttcagatagcatgaggaaagtaattatctatacctacatgtcaagatacaggtaaaatcataaatgtccccaaaactgggtagcaaaaggaaatgcacctctatgcatgtatcacaattacgcatgtcaaatacaacgcatctcgatgatgagctcatgtacccacactctcagagtactcaatctcactgtctcgcattctctctcactatgctcagcacactcaatcactcagctctatacannnnnnnnnnnnnnnnnnnnnnnnnnnnnnnnnnnnnnnnnnnnnnnnnnnnnnnnnnnnnnnnnnnnnnnnnnncgctgcggcgtacaacccgatccatatttatagtcgactgtgctcactggggatgtgcaaactttggaggggctcctttcagcccaagcgctatatcgctacagcgtgcagcccgatcccatagaatgcaatcaatatatcgctgcggcatgcaccccgatcccataaaatataatcaatatattattgtgatgtgcagcccgatcccaagatatcactctcactcgggtcctcggcctcactcagtcatcaatctctccagtctcactcgcgggctcacaatgtcatgaaactagcccgacaacaatgatatgatgtatcaataaataataactgagactgagatatggtatgaatgcatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaagtatgaaatatcaatgaattcagtgagatgacagtaagaaacaaccactacgggtccaaacagtattggcataatgcctaaacatgatatttagcaagattgacaacttaaatactttatcacatggtgaaaacatggatatcaacaaaataggaccactatatagtgtcatgggaacaacagaatctcaattcacatggtgcacacccacacgcccgtcacccagcatgtgcgtcaccataacactaatcacataacacgtatttcggggttttataccctcaactccaagattaggaattacttacctcaaacaagccaagtgatattccaaaattccatcacgtgcgtttcgacctccgaacggctcaaaactaaccaaaaacaactcatgtacattaaacaatgctaaaggaaccaatcccgatcgaaaaagatcaaatcttgaatcaaaaacccaaaatcggccaaaagcccaacccggtcccgcacctcagaacccaacaaaatttacaaaatccaacaacccattcaattatgagtctaaccatactagtttcactcaaatccgacaccaattcgatgttcaaaactcaaaatttcatattatgaaggtttatgccaaaaccccccaattttctctttaaaattcacaatccaattacccaaaatgaaggtatattcgtgatataaaataaacaatgagtagagaacactttccccagtccacaagatgaaaattgcttcaagagttgcctcaatccgagctccatagctccaaaaatgtaaaaatgaacgaaaaccctcgataatatagcttctgcccagtgattccgcatttgcggaaaattcctcacatctgtgaccaccgcttttacggtaaaacttcgcttctgcgaaaacaactggcccagaaatccctcgcacctgcagcctttaagccgcttttgcgatcgcgcttctgcacacatgaaccgcatatgcagttgcctaggtgcgtccaagcacccgcacctgcgatcctcacgcccaactccccttcacgcttctgcgactcctctgtcgcttctgcgaccatcacacctacgcaaaaccagccgcaggtgagatcacacaagaaccaacagctagcaaaaatccaaaaatgtaatgaaatgatccgggcctcgtccgaaactcacccgagccccttgggaccccatccgaacatgccaacaagttccataacattatacggacctactcgaggactcaaaccacacataacaacatcgaaacgacgaataacacctcaactcgaatcaatgaactttgaaatttcaaacttccacaaccgatgccgaaacctatcaaatcatgtccgattatctcaaattttgcacacaagtcgcattcgacattactgacctactccaacttccggaataagaatccgactcctatatcaaaaagtccactcccggtcaatctttccaaaatttcaactttcgccattttgagccaaattcaaccacggacctccaaattacaatacgaacgcgcacctaagtccaaaatcacccaatggagctaacaaaaccatccaaattccaatacaatgtcaaatgctaaaaagttaaacttggtcaagtctttcaaatttaaagctccctagttgagaattattcttccaaatcagtctcgaataacctgaaaacaaaaccaatgattcacacaagtcaaaatacatcatacggatctactcacacccgtaaactaccgagcaaagtgtaaatgctcaaaaataccgatcgggtcgttacatcctaccccacttaaacatgtgttcgtccaggatggtgtcgagacttgtggcatttttatgcctttgtggattatgcatttcagcatcaagaaggtgaaggaaacaattttaagttcacataaggtctccttagaatgggtgtcgtggttgtggcgctttggggtgcttaaaagggaagtcagcgacttatgggccttagggcgttgtggttttatactagggtctcttgtggggtgaattttggttaagaatcatggtgttccattaaggagaagtatcaatttgaaggcaatttggatgggacttggaggaaaaggacatcgtggtagtaggttggatcagcacaataatggatataatcggttctttaggtacttatgatgtggctagcctccacaggtgtttcatggcaatgctcttgggttttggcgacctgcaaggttgggttaagttagagagattcggttctaatagcttggttgtgtgaaaatggtttttgaagagttctcaatgggttttaccacggttcgaggagtatatttcctaccggcgtgaggaatatgttgcgtattaggattttctccgggatgagatcaaatggaaggtttctgactgatcgggtatgtattctgcttgggactcagagttgattatcagattcttgtactcttcacaggatggcatggtagagcggtgtattgtgtgggattgagatttgcatgtggaaggtcactgttcagttttgaagggaaggaaataaattcgtaggcaccatggacggtttcagatgactaggtgaatgatattactttttggtattgcttgaggagagtgtacatttcaggaggcgcactgtgttttgatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtggcactctcctggttgatcgattgctgatttccagatattgcgaagtggcacggaagaattatagaagtattcctcatagtatgatcgtgtatgagagatgtgttagacattcgggcggtggagttgggatcaaatatggcgattcgtgtgttctatggagtttgagactgggggtcttcaggaacagattgtttcatggttgcggactatgaaatcgtggccgaagctagccagatgatagtatgtgttatgattcagttattgtggaccttcagagggttaattatctattggtgggtgaccagagttgacttggggcgggttcattggcaggcccaattagatgtgtattctacatcgcgccggattggttggctccatactgctattattgaaggatgtaccattcggttgttgttgaacttattcgtgttctgaaatgatctgtgagttactcttctatgctacgaggagttgtgattcgttggttacaagcacacctggtgcggttctattcgagctttataccaaaatttgtgcgagatgagtaattgtgtattgcatagttgatggcgtatggttatgttctttcgggttttctatggcattgtgtcatcttcttctccatagttatggtaattcactttgagtacttgatttcggattgtgtgtggttattgattttgagcatgatggctgaggtatttcatatggattagtgtttggatggggtcgcgcatggcagcaaagttatgttgagatattatcctttgtgttagattcgtatgttatggttgtacggtgttttgggttcttagcattgcattagggtggcacccgttgagcttgcgggacggttctcttatttgagtcatgttctcttacgggatgggaatgttgcttattggtgcacgtattgcacgggttgtggctttaaatagtattggtgtggcatgtcagtagcgtagctgggatttgataagatgaagtcgtcggatttaggatgggtgctattagatttgattgtggtatatttggaaggataatatcgaaaggcggcttagagatttgctatgatttttgtcgaaggagagggagctccacgactggtggatctgatgaatggttaagagtttatgcatgtttctttcgtcattggtagtgtacaaatgttttagaatggagtcttgtttgatatgaggtttattaccggttttgggttgttttgagcagctactgtgattagaaatcattgctacgagtatctgtgttatgtggtatatcatgcgattgtatcttgggtcatggttgcggcttggtacaacttgttcagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatcttatgagaaatttcggatgttggaaattggattctaagacttgtgggctaggttgaattgagaaattttagttatgttgtgttattggacctgtatgggatagggtgacgtgggatcacctccgggtatctgcatggtaaggttatacggcaatttgatggttatgggaacaactcttggctcgttcgaaatgtaactctcagtttctacccatatacacatattgaaaattccaaatcgctacataaaaatcttgaatccatcagaaccatttttgagagtcatccactctactcaaatctcaattaaaccggcaaaactgaccgaacgacctgcgccctattagcacaccaacacccaagggaataacccacactcctgagcaactgagcatattcctactccatgtacactatacctttcacgaataaccactcaattattttatgattcccatacacctatagagtgtaatacaacctgtatcccgaatttcctttacccgagtcatcctcgatctcgacctctgcaagtcataactgattcaccagtataccccgaaccgaaaccaatacaacacatnnnnnnnnnnnnnnnnnnnnnnnnnnnnnnnnnnnnnnnnnnnnnnnnnnnnnnnnnnnnnnnnnnnnnnnnnnnnncaggttctcccacttggctcaaagccacataacaaaacactcgataacatcacgatacccatactctattacttccagaatcccgcactgaaattcaactaaatcctgcataagctcatgtaacacaaaccatataatacctcaaatcatctgtaaatctcgcattcatcctcgtgatagtcaggtccactgttacaaccgatccaaactcaaatcgcacaaatataccccaatggtaaaagagaactctctccaaaacatcataaggatcatacaacctcaggacacctcgcatgagataacccacctgctctacctcaaagtgacatctctctatacccttccacagtcacgactactacgcaaccacttaatcttcttgattctgaactcatcaacaagacatgagaatctacttcactctacaactaaacacacatgagagatccctcaacacacccataactcaagaccatacgccaaatcaagacagaaatcagacaccccacagtccttgctacatctcaagtaaactcttctcgtcacattcgaacaatccgaacacatctaacagtcacatcatactcaccacacagccatttcaccgctcatcgagcgataaatttcactcatagggacattaccggacatatgagtccaaatgtacaagttaccactgaagctaccgagcttaagctacggtctaaccatggcctcaagtccaccagactggcccatcaccaaaatatcgaatacacatctcgaacctcgttcatagaatcacaagccaccgacgcataaccgatatcaagcgctcacatgcgcatacgaatgcatggaaggaattcaaagagttacgcttcaagttgaatcaatgccgtacgataaggaaagaaagatgggaaagtatatcctaaatgtcctgtagcctctcgaagataggtatggacatcatcataccgatccgcaagactctactagacacttgctcatgacttgcagaacctatgaacctagagctctgataccacctgtcacgacccaaaatccaactagttgtgatggcacctaatccaacctgctaggtaagccagttaaccactaaccaattccaataacaattaataaagcaattaagtaaagaaattatctgaatcttatacgttccccaagaactggtagtacaaatcatgagcttctaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgagatgaaataaatacatcgtctgtttgaaaaaaatacataaacagaatttttatagatctaaggctaccacgaacaagaggcagctataatcggaatgcaggtacatcttcaaatccagctcccatcgaacacggcaacatcagcagccaagatatgcacgcaaggtgcagaagtgtagtatgagtacaacagaccccatgtactcaataagtaacaaacctaaccttaggttgaaagtagtgacgagctaacaaaaagatcgggtccaacaccaatattccacaacagttcataacagcatagtacaagtaacaaaagactatctcagaaataaaagactcagttcgttcacagttccaaaaaaatgggcatttcttttcaagtatctcaggaaaaaccaaatcttttacaaaaaaaagccaaaatacgagtaagtttgaaaactgtgatttttcctaaaagtcctttcaacaaatagtaagatgtttcattttcagatagcttaaggaaagtacttctctatgcctacatgtcaagatacaagtaaaatcataaatgtccccaaaactgggtagcataaggaaatgcacctctatgcatgtatcacaagtacgcatgtcaaatgcaatgcatctcgatgatgagctcatgtactnnnnnnnnnnnnnnnnnnnnnnnnnnnnnnnnnnnnnnnnnnnnnnnnnnnnnnnnnnnnnnnnnnnnnnnnnnnnnnttcactatctcgctttatctcttactatgctcagcactctcaatcactcagcgctgtacaatacccgctgcggcgtgcatcccgatccatatttatagtcgactgtgctcactagggtgtgcagactccggaagggctccttttagtccaagcgctatatcgttgcggcgtgcagcccgatcctatagaatgtaatcaatatatcattgtggcgtgcagcgtgatcctataaaatgtaatcaatatatcgattcggcgtgcagcttgatcccaaaatatcactctcactcgggccctcggcctcactcagtcatcaatctctccagtctcactcgcgggctcacactgtcatgaaactagcccgacaataatgatataatgtatcaataaataataattgagattgagatatgatatgaatgcatggatatgcctgagtatgaaatatcaatgaaatcgatgagatgatagtaagaagcgaccactatgggtccaaacagtatcgacataatgcctaaacatgatatctagcatgattgacagcttaactactttatcacatggtgaaaataccagatatcaacaaagtaggaccattatacagtgctatgggaacaacagaatctcaattcacatagtgcacgcccacacgcccgtcacctagcatgtgcgtcaccccaacactaatcacgtaacacgtatattagggtttcataccctcagctccaagattagaagagttacttacctcgaacaagccaattccaacaccgagcaagccaagcgatgctccaaaatgccatatcccgcattccgaccttcgaacggctcgaaactaaccaaaaacaactcaagtacatcaaacaatgctaaaggaaccaatcccgatcgaaaaagatcaaatcttgaatcaaaagcccaaaatcggccaaaacccaaccggcccgcacctcgaaacccgacaaaatttagaaaatccaacaacccattcaattacgagtccaaccatactagtttcactcaaattccactccaattcgatgttcaaaactcaaaatttcatattatgaagctttaggccaaaacccccaatttcctctttaaaattcacaatccaattaccaaaaacgaaggtagattcgtgatataaaataaaaaaaatgagtagggaacacttaccctagtccacaagatgaaaattgcttcaagaatcgcctcaattcgagctccataactccaaaaatgtaaaaatgaaccaaaaccctcgataatatagcttctgcccagcgattcctcatttgcggacaattcgttgcatccacgaccaccgcttttgcggtaaaacttcgcttctgcgaaaacaactgacccaacaatccctcacacttgtggtctttaagccgcttctgcgatctcacttatgcgcacttgaaccgcatctgcggttgcgctggtgcgtccaagcacccgcaccagcgatcctcacggccagctcccctgcacgcttctgcgactcctctgtcgcttttgcaaccatcgcacctgcgcaaaccagtcgtaggtgcgatcacacaagaaccagcagctagcaaaaatcaaaaaatgcaatgaaatggtctgagcctcgtctgaaactcacccgagcccatcgggaccccgtacgtacatgccaacaagtttcataacacaatacggacctacttgaggcctcaaaacacacattaaaacatcaaaatgatgaatcacatctcaactcgaatcaatgaactttaaaatttcaaacttccacaaccgatgccgaaacctatcaaatcacgtccgattgacctcaaattttgcacacaagtcacattcgacattacgnnnnnnnnnnnnnnnnnnnnnnnnnnnnnnnnnnnnnnnnnnnnnnnnnnnnnnnnnnnnnnnnnnnnnnngcctgatccaacttccagaatcggaatccaaatccgatatcaacaagtccgctctcggtcaaactttccaaaatttcaacttccgccatttcaaggcaaattcaaccacggacctccaaatcacaatccggacgcgctcctaagtccaaaatcacccaacagagctaatagaattatcaaaattccaatccgaggtcaaatgctaaaaagtcaaacttggtcaagtctttcaaatttaaagctccctagttgagaattattcttccaaatcagtcccgaataacctgaaaaccaaaccgacgattcacacaagtcaaaatacatcatacggagctactcatgcccataaacaacctagcgaagtgcaaatgctcaaaacgaccgatcgggtcgttacatcttaccccacttaaacatgcgttcgtcctcgaatgtgccaagagttgttcccataaccatcaaattgccgtataaccttaccatgcacatacccgggggtgatcccacgttaccctatcccatacaggtccgataacacaacataactaaaatttctcaattcaacctagcccacaagccttagaatccaatttccaacatccggaatttctcataagatatgaatctcgcaacctacacactgtataagtctgaacaagttgtaccaagccgcaaccatgacccaagatacaatcgcatgatataccacataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatagtagcttcgcaaaataacccaatgccggtaattaacctcatatcaaacaagactccattctaaaacctttgtacactaccgataatgaaagaaacatgcaaaaactcttaaccatttatcagatccaccagtcgtggagctctctctcctttgacaagaatcatagcaaatttctaagccgcctttcgatattatccttccaaatataccacaatcaaatctgatagtacccatcctaaatccgacaacttcatcttatcaaatcccagctactctactgacatgccacaccaatactagctaaagccacaacccgtgcaatcagtgcaccaataagcaacattcctatcctgcaagagaacatgactcaatcacgaacatgactcaaacaagtgaaccgtcccgtaagctcgacggttgccaccccaacgcaatgctaagaacccatcacaccgtagaaccataacacacgaatctaacacaaaggatcatatctcaacataactctgccgccatgcgcgaccccatcaaaacactgatccatatgaaatacctcagccaccatgctcaaaatcaataaccacacgtaatccgaaatcaagtactcaaggtgcattaccataactatggagaagcagatgacataatgctacataaaacccgaaagaacataacccatatgccattaaccatgcaatacccaattactcatctcgctcaaattctactataaagcacaaataaaaccgcaccaggtgtgcttgtaaccaacgaatcacaactcctcattgcataaaagagtaactcacagattatttcagaacacgaataagtttaacaacaacagaatggtacatccctcaacaatagcagtgtgtagccaaccaatccggcttggtgtagaatacacatcctaattgggcctaccaatggacccccaagtcaactctggtcacccaccaatagataattaaccctccaaaagtccataacgactgaatcataacacatactatcatctggctagcttcggccacgacttcacagtccgcaaccataaaacaatctgttcctaagaaaccctagtctccaactccatagaacacacgaatcaccatatttgatcccaactccaccgcccgaatgtctaacacatctctcatatacgatcatcctacgaggaatacttttataattcttccgtgccacatagcaatatttggaaatcagcagtcgatcaaccaggagagcgccacaacaccaatgaagtatccatagatcaaaacacagtgcgcctcctgaaatgtacactctcctcaagaaataccaaaaagtaatatcattcacctagtcatctgaaaccgtccatgctgcctacgaatttatgtccttcccttcaaaactgaactgtgaccttccatatgtaaatctcaatcccacacaatacaccgcatctaccatgccatcctgtgaagagtacaagaatcttataatcaactctaagtcccaagcagaatacatacccgatcagtcagaacccttccatttgatctcatcccggagaaaatctcaatatgcaacatattcctcacgccggtaggaaatatactcctcgaaccctggtaaaaaccattaagaactcttcaaaaactatttgcacacaaccaagctatcagaaccgaatctctctaactcaacccagcctcgcaggccggcaaaaccctagagcattgccacaaaacacctgtggaggctcgccacatcataagtacccaaagaaccgattatatccattactgtgatgatccaacctactaccacgttgtcctattcctccaagtcccttccaaattgccttcaaattgatacttctccttgctggaacaccatgatccttaaccaaaatttaccacacaaaagaccttagtataaaatcacaacgccctaaggcccataagccgttgacttcctacttaagtaccccaaagcaccacaaccgcgacacccactctaaggagtgtgaacctaacactattttcttcaccttcttgatgctgaaatgcataatctacaatgttataaaaatgccataagtctcaacaccctccaatgtaactctcaatttctagccatagtaatgccaaggtacatccgggagattaatcccgacaggggccagggatattttagcgttaggcttaaaattgttgtccatttcagaatcttcatgctgacatttttcgagagattaatgaactctcttgagtaaatattattgaagtcatctttatttttaacatctatcaaaaaatggtatttatcttttgcataaattttaatttctcctttagagacaaataatcgagcaaaatcagccctaattttgtcaatggaaggtttgcctcgaagaaacttaccgatgatggtccatcggcatgtgtctgcgaggagttcatgttcttcgttgataagaacaaccaccgctttgcgttcaatcacttcatgtgctcttggtggtagtcttacttttagtcccgttcgatttctaactttgtagccctgagctcctacatgagattctagttgcgattgcttgggtattgtgtcgttttccattgctcttctttgcaaaggtggaaaagttttagatgaggaggcatctctgttaatgttggggtccgatggcattggtattttgaggatgggtgtccgaaaatgtcaatggacatgctcattgagcaaaattgggaaaaaaattagtcgttaatcactgtaaagtaaccgttagaagggaagaaagagtgggggagagtagagagaagctcacttctcactctaacatttttttacctcttgtcatcctttcgtgttaaggtttttacaaccaaccctctttataatagtctcgtttgttccgatattttttgactttatagtgaatgaccgttaaacacctataacagcatttgacgtttaaatattttttggctgttatagataaaaaattatccaaaaatcaattattttttatttttaatattacatataaaagattaaaaaattattcaaatttaaaatctcaaatgatatgcatatttcactagttaaatattgaagaaagctcatatattagtaataaattcacaactaaacatataaagatttaaactctaaggtagacattttaaaactacctagcaaaaataaattcttttaagagtgatgtaagaactttgtaattgtagcttgtttcgtagatttcattctcttactagcaacataacgcttgaattggcgaaggtttgtgtccaaatttccagcaaaaaagtattcaatagttttcacttgaagccaatctaagagtttaaaaatattccatctacatatttttttggaatttatccaatgaaaaagttatcatgtgcaaatcttcaaatattatattttatgcaagatagaaatattatttaatggaaaagattgtgtgcatatttttagagttattactagtaatcttaaagaaaatatatggttgataaagaggggtaattttacaaagagtgttttgctataaatatggttattggtgttataggtaaaaaagttgttatagagaggtaaaatataatttaaaaatcggttctaaaaaaatttaacttttatagtgaatggatattatataaggatcctatagagagatctaaccgtatatgaacaagggaagccagaagaaaaaacgacattttatgaagtgatttatctggcaactaatttatcccggtaaaaagaaaggtcacgtaagagaaagtacatttacaagtcatcgtccagcagctttgttttttttttctttttctttgagaatattgcaattgtcaaacacgaagaaaccttagttcctcacaattataccaacatttgcagattaatcaagctatgacgaataaattttgctttagctatggagtttatcacatctatcttacttttccttgtcctattttctgaagaagctgaagacgatggctccggtgagcgcatacgacacctcgttgtaaccctagccggcttagttatggtcgagccaattaagtgcggaaaattgagacgtgctttcgagccgcggatctcaaaagcggcttggtcataagctaatgctgcatcctccggactctcataagttcctagccacagtctcgcgcctctcctattcggatctcttatctccgccgtaaacgtcccccattgccgccgcctcactcctatgtagcgcctccaatcttgcggcgcttttttctcacgcgccaccataggcccctttctttcctcctcggactcggacttttcacagttttcatcacaaagggaggtgttaaagctgttttctgctgaacttgagctagggctattagacaatgcgtcatttgaaaaattctcaaaaacaattggatcattcaaaaggttctgcttgatagattcaaggaaatcaaggttagagaaagataaggtttcatcagctggattcattttcttttccctataatttttggatgactagtttaatttattgcactttcacgtacaaaatgaatggaatgtttgaaaccctactgctacttatacattttcagttttttttttcttgatatgttggtaggaacttccacgaagattacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcacccgcatattgtgctttttacattcattattgtaaaatttcaagagaaataaataatgtgaactgataatctactatatgtaatgaatattatacttccttcttgaaacgtgagtaaacaactactcacttcatttcaatttacgtgaacctatttgactgggcacggagtttaagaaaatagagaagaattttgaacttgtggtgtaaaatgaggcacatatattttgtgtggctataaattattgtataaaggtaaattatttccaaataaggaaaaaagtcatttttttttacacgaactaaaaaggaaatagattcaaataaattgaaacgggaaaagtatattaatatagtacatcatgtatgacgagatcaccctcatttccaaaaacttcggattgtttatttcaaatcactggaatataatctttgcacgtatataaaggaaagattttatttgataaacaagtttgtattcttatggtgacagcatgtgctaccaaatgtcagaaagcattctctattctaatttcggttggttgaggtaacaaattaaattacttccaccttttcaatttatgtgaactcatttgattgggcacgaaatttaagaaaagatataagacttttgaacttgtgttgtaaaataagggacatatattttgtgtggctataaatcaatgcataaatgtaaattattttcaaataaaaaaagaagttattctttttggcacggactaaaaagaaaataagttcagggaatattaaagtgttgcaggttgatagtgataattcaccttcaaatagtttgataaagaacaagcttatgagtgtaccaatagcttttctgaatttaaaatcttgtttaataatttatatcactctatgattgctggagaattcaaatatagaatgagtacaaaaatactagacgagtatgcatcaatcagcctttccccaaattcaatggccatttttcttttctttttaaattttcttttctttattgaatttactctgggaccaatcttgcagctcctgaaaataaaaaataattttttttatcaatctgcatactcccccgtccccacaatttcatcgccatctccatctaacatgaagacgccagctttcccttctttagtgttaactttcttcatttgttaaaagtacgatgaggtggctctttgttttctttatcaaatctgtcccaaaaattgcatattgttgcatcctttaaataaaatttcttactattaaatgctcttagaagaaggagaaaagaaaaccaccaccgcacatgtcactgaaagagtataacggaaaaggaagaaaaataatgcagacaagattaattagttaacctaagaaaaaaagctggacgccgtaaagaccaccacaagactttgttgacattaactactttcgttctagctcaaaattaaaaaattgtcttagaaaaaattactatcactttaggaattcaaaattaaacttgttaattgttttagattatacccttaatattaataagaatgcatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagaaaaatatcaaactactttcattatatagggatattttaataaactatacgttgtattttattattttgcttaatggatgtgaaaaaagctgaaaggtattttgatatatctatactacattataaacttatttatcctccatcgagagattgtaacttaattttatatatattatataaagtaatgtattatactacaatcttttccattttttctccctcttccatgaatttattttcactctgatgaaaagttctacccctcctaagtgacacaattttttcataatagagcattattatgcaccaacaggccagaaccttcgcccgttggtattcagccaacaggttcaaatcttcttcaagattgttcaagtgatggtgcttactggttggacctcccaagtgatagataaataaatggaagaaagcatgagaaaaaatatattgtataattgaaattatactgaaattttgaatcacacactaatttaaccttatttgggtgtgaaacgtgaagacataagcttaaactacattgacagctactaaaaaacttcgaaactttaaactcaaaactaaattttgcgaaattattatttgtttagattggatgttattgcaaacgattgaaaatattgtttggagtttatatctcaactttgagagagtatggtaaaaaattaatttggtttgggttagaattttagattaaaatttgaagaggcaaaaaataataagttgtatgtattttatatgttgggtgcacaaatgacatacaacatatatacaattaacatagttacataaaaatagtatgtattttatccagattctatacaacaaaaaattatatacaagttgcatataagttatatgtaaattacagtttttaccggattttgtacaacataaacatgtatacaaattatgtataaattgtagcttttgatcggaattgaatatattttataaaaaccttagttactttttgtaaataggaaaatctagctcaatgggtaagtattgtcctaattttgtatatataaaagtactcccaaggtaaaatgatagttaaaatgggacgaagagagtaaattgaaagaatacctgagtagtgtgtttcaataagagaaaaaagtaaatagtacttttttagttggatacggcgaatgattctcgggagacaatttgtctaatatccctaaatataaagagtatttcagatatttgaaatgacgagaaaagaaaaataaaataaagcgaaacccacacggtatgtctactgaaaataccagttaacatcatatataattaaaatattttattttaccatgtatacctactttataaatttattttacattgtatacttattgtatttcaaaataaaatattgtgtcttctaaattagaatattttggtatgtttgatttggatactgtattttaaattaggatactgtaatatgtttgatttggatactgtattataaattagaatattagtgtatgtttgatttgaatattgtattccaaattagaaaattatggaatgcttggtctgtatattgtactccaaattaaaacattatagtatatttggtatagttattgtattttaaattagaatattgtagtatatttggtttgaccattgtatttcaattaaaatattgtagtatgtttgatttgaatattatattccaaattagaatattaggatatgtttgacttgaatattgtactctccattagaataatatgatatgtttggtttatataatgcattctagattagaatattgtggtgtgttcagtttgaataatgtatttaaaattagaataatgtggtatgttcggtttggattgcattccaaattagaatattgtggtatgtttggtttgaatattgtattcttcatagaataatatgatatgtgtgatttggatattgtattccaaattaaaatattctactacgtttagttgaatattatatttcaaattagaatattgtggtatgttcgatttggattgtaatacaaattagaatattgtggtatgtttgatttggattgtaatacaaattagaatattgtagtatgttttagaatatatgagaaagctttggagatatagggtgtaattgtaaagacccgccagtcgttttgagtatataatcccgttcccccatttactgctcaagttatactttacagttgttttatgacttaccgggttagttaattcgggtccgaaaggatttcggtgtgaaatgagacacttagtctcataattgaaaacttaagttggaaaagttgaccgaatattgacttatgtgtaaacgacctcgaatatgaattctgatgattccaatagctctgtatggtgattttggacttaggagcgtgtccgaaaaattatttggaggtccgtagtgaaattaggcttgaaatggcgaaagtaaaattttttggaagtttggccggggggttgactttttgatatcgaggccggaatctgattttgaaaatttgaataggtccgttatgtcatttatgacttgtgtgcaaaatttgaggtcaatcggacgtgaattgataggttccgacgtcgtttgtagaaaattggaagttcaaagttcattaagcttgaattggggtatgattcgtgattttagcatttttttgatgtgatttgaaggctcgactaagttcgtatgatgttttaggacttgttggtatttttggttgaggtctcggggacctcgggtgagtttcagagggttaatgaatagaattcggacttagaagaaaaatctgaaagtttctgccatatgatgcaaccgcacctgcggaaattggctcgcatatgcgaactcacagaaacgagcctggcaagcgcagatgtggaccgggggctgtgaggtagtggtcacaggtgtgagggaatttccatacctacatgatcgcaaatgcgaacggaagggcgcagaagcgagttctccgcagaagtggagcgagcctcgcaaatgcgagcccgcagaagcggctctagtggaggctttggcaaaccgcataagcgattgatttctcgcacctatgagaccacagaagcggctaagtgagttgcaggtgcggaacccctggccaatatacatttcgaaggggtttcgagttttgccatttttgtactttcaagcacagtttttggggcgattttcggagagaattcaaagaaaacttgaggtaagtcgattgtgatcatttctacttcataatattgaattatcatcgaataatccgaccagattacgtgattttgaggtgtaaatcaaggatttgaacctagggatttgaaaataagattggaggatttggaggttgagttgatgtcggaatttagtaaaactggtatggttggacttttggttgaatgagctttcagattttgtaacttttgtcgggttccgagatgtgggctccacgggcaattgttgagttaaatttcagattttattggaaaattagtattttcttatggaattaattccaataatttgtattgactgaatcgaattaattgtgactagatacgaggctttcagatactaattcacgaggcaagagcatagcagaataagaaattacgcgggttaaggtaagtaacatttctaaacttagttctgagggtatgaatctccgaattgatcttatataaattgtttggaggtgacgtatatgatagtgatgaacgtgtagatgtgcaccattgaaagtttgacttgaataaatcctatgaagtcataaattaaagaatcatgttattatctgattgtttttcacgtgttagagaagttgagctgaggctcttaattgagatcatgtttaggttacatgccgatatttttgggacccatggggtcgtgttgctattaaattaaacattttaaaaatgtacattttatactaagtcatattcatccattgtgaggatatttatggatcgagctgcacgccgcagcaggccatattggctatatatatattattattatatggatcgagctgcgtaccgcagcaggccttataggatttattattattattattattattattattattattattattattattattattataatgggatcagactacacgccgtagtaggccatatcagctttatatagcgcttgggctgaaggagcccctccggagtctatacacctccagtgagcgtagatgattatatatacgggatggacttcccaaggcatggacttgccttacttatttatactgttatgtatttttactggatatggatcttgtccgtatcatttataattggggataaattaccccagggatggattggccttatacggtactgagtgactaactgtcagtcgatgtgtatatatatacgagatgaaatatccctgggctgattggccataaacagtaccgagcgaccgaattatttgtgaccagtattacatgaggtctttctactgagatgtcatacctcatatcatgcagtattgatctatttcacttgtactgagtttaactattgaacttgaaagaatgcctatatttttgtaccattatttatactagaatgtacttgcggagctcgtcactactttcagcctagaggttagtcttgttacttattgagttggttgtactcatactacactctgcacctcgtgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggatacagcgactgctaggtttcagagttatttctgttggagactatcaaagtagctgcttgacgtctgcagacttgattcccttcctctttagttattgtactattctatattttcagacagtgattttatcagtcagaatttgtatttatttagatgctcatgtacttagtaacaccggattttgggagtgattataactgtatgaggtttcttccgttgaatttaaatgttatgtttttaaacttaaaagatgtggtggtttattgagattgtcggcttgcctagtattgagatagactccatcacgacatgtgagattttgggtcgtgacaagttggtatcagagcctaggttacataggtctcacgagtcatgaggaggtttagtagagtcttgtggatcgatacgaagacgtctatacttatcttcgagaggctgtcgaacccttaggaaaagttcagcttcttgcattctatcgtacgaatttgtttattccggaaactaaatttctgttattctattctctcacagatagtgaggacacatactactggatcggacggtcagccaccaacgccaccagttagggctgcgagaggccggggccgtggtagaggccggggccgaggtagaggtcgaggtgtagctcatacatcagttgcagcaacacctatagcaccacgagttgctccagctcaggagcagattccagatatagctgagccgacaggaccagctgtgctcattgtgattccaagccttcaagaggctatggcccagatattgacagtttgcactggtcttgctcaggtggcttaggccgcacttgccacttctcaggccgggggaagtactcatacccatgttgcccgtactccagatcaggtagtgcagggacttcagataccgggggcactccccgttatggaagatgatggtcagaggagacttgagagatttgggaggcttcgacctccatcatttagcggtgctgagtcagaggatgctcagggttttctagataagtaccagtggatgcttcggacaacaggtattctggagaccaatggggtctcgttcactacttttctattttctggagcttccttcagttggtgagaggcttatgagaggtgcaggccgattggtgcagtaccacttacatggaaggagttctccgtactcttttaagagaagtttgtgccgcagtctcgtagagagaaactgcgcaggcagtttgagaagttacttcaggacgacatatttgtgatgcaatatgagatgagattttctgagttggctcatcacgcagtttggttggttcccactgataaggagaggattaggaggtttattaatggcctcacatatcagctgcggttacttatgactagggagagggtatctggtgctacttttgatgaggtagttgacattgctcggaagatagagatggtccgtagccaggaacgtttagagagggaggccaagaggcctcgtgggccaggtggtttgagcggtgtcccttcaggggtcagttttactgcggtaggggttgttcttacagacacgctcagacgggtcgtctagttcaccgtggtgcatcatccagcaatggttcatacagttctcatcagggtcagccatctctcggtgaccttctagcccagagtacgccccatgctcctttaattcatggatcatcggtaccaggttcttctggtagttattatggttctcgaggtccgcctcagaacttgccaccattcttcgaaagggagtgttatgagtgtagagagctgggtcatgtgaggaaattttgtccccgccttacttgaggtccagttcagcagagaagtcaggctactacttatgcaccagttatgccaccacctgcccagccagctcggggtggggctcagacagctaggggtcgcccaagagggggaggccgatcaggtagcggtcatgcccgattctatgctttttctgccaggccagatgctgctgattcagatccagtgatcacatgtattgtttcagtgtgccacatggaggcttctatattatttgaacctggttccacttattcatatgtatcatcatattttgctcgttgtccgaatatgccccgtgagtcttagtttcacttgttcgtgtatctacgctagtgggcgatattattactgtggaccgtgtgtatctgtcctgtggtaactattgcagaactagagactagagttgatcttttgttactcggtatcgttgatttcgatgtaattctaggtatggattggttgtctccatgtcatgctattctggactgtcacgtaaaaatcgtgacgttgacgatgccggggttgccaaaggttgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgtgagagatgttgatgtaggtactcctcctattgattcagtatcgatagtgcgagaattttcggatgtatttcctgcggacctgcagggtatgccacccgacaggaatattgatttcggtattgacttggtgctgggcactcaacccatttctattcctctgtatcgtatggcaccagctgagttgaaagaattgaaagagcaacttcaggaactccttgataaggggtttattacgcctagtgtgtcaccttagggtgcaccagttctgtttgtaaaaaataaagatggtactatgcggatgtgcatcgattacaggcatctgaacaaagttacaatcaagaataaatatcctttgccgcataatgatgatttatttgaccagcttcaaggagcgagggtgttctccaaaattgatttgagatctgggtatcaccagttgaaaatttaggattcagatattctaaagacggcattcaggactcgttatggccattatgaatttctcatgatgtcttttgggctgaccaatgccccagcagcatttatgcacttgatgaatagtgtatttcagccatattttgatttatttgtcgtagtatttattgatgatatcctggtgtactcacgtagttaggaggacacttgggtattgtattacagagactgagagaggagagactttatgccaaattctctaagtgtgagttttggcttagttcggtggcattcttgggacatatagtgtccagtgaaggaattaaggtggatccgaagaaaatagaggtagttcagagttggcccaagccatcttcagctactgagattcgtagttttctcggcttagctagttattatcatcgctttgtggagggtttctcgtctattgcatcgcctttgactaaattgacccagaaaggtgctccgtttaggtggtcggatgagtgtgaagagagcttttagaagctcaagacaactttgactacagccccaatgttggtgttgcctacatgttcagagtcttatactgtgtattgtgatgcgtcgcgtattggtctcggcgcaatgctgatgcaagacggtaggttgattacctatgcatccagacagttaaaggtacatgagaagaattatcatgtccatgaccttgagttagcagctattgttcatgccttgaagatttggcagcattatttgtacggcgtccattatgaaatgtataccaatcaccggagtctacaacatttgtttaaacataaggatcttaatttgcggcagcggaggtggttagagtttcttaaggattatgatatcaccattctctatcatcccggaaaggccaatatggtggccgatgccttgagtcgtaaggcagagagtttgggcagcttagcatacttaccgatagcagagaggcctttagccttggatgttcaggccttggctaactagttcgttagattggatgttttggaaccgaatcgagttttggcttatgtggtgtctcagtcttctctctatgatcgtatcagagaacgtcagtatgatgacccccatctgcttgtccttaaggacacgattcaacacggtgatgccaaggaagtcactattggggatgacagcatattacggatgcagggcaggctatgtgttcctaatgtagatgggttacgggagttgattctccaggaggctcacagttcgcggtactccattcatccaggtgccgcgaagatgtatccggatttgaggaagcactattagtggaggcgaatgaagaaatatgtagttggatttgtagctcgatgtttaaattgtcaacatgtaaagtacgagcatcagagaccgggcggattacttcagagacttgaaattttggagtggaagtgggagcgtatttccatggactttgtagttgggctcccatggaccttgaggaagtttgatgttgtttgggtgattgtagaccagttgaccaaatccacgcattttattccaattggtactaattattcttcggagcggttagctgggatttatatccgcgagattgttcacctacacggtgtgccagtgtccatcatttcagatcggggcacgcagtttacatcatagttttggagagcagtgcaacgggaattgggcacacaggttcagttgagtacaacatttaaccctcagacagacggacagtccaagcgcactattcagatattggaggatatgctacgcacttgtgtcattgattttggtggttcttgggatcaatttctgccactcggcggagtttgcttacaataacagctaccaatcgattattcagatgactccatatgaggctttatatgggagacggtgccggtcgccggtggattagtttgagccgggttatccagtgttccatgtatccatgctccgaaagtatgtcggggatccgtctcatattttggatttcagtacagtacaactcgacggtagtttgacttatgaggtagagctagtggctattttagaccggcagattcgaaagctgaggtcaaagaaaatagcatcagtgaaggtagaatggagaggacatccagtcggagaagctacttgggatattgagcaggagatgcggagcaaatatcaacaactatttgtgacttcaggtatgattctaaacccgttcgaggacgaatgtttgtttaagagggggagaatgtaacaacccagacggtcgttttgagtatataacccagttcccccatttattgctcaagttatgctttacatttgttttatgacttaccgggttagttggttcgggtccgtaaggatttcagagtgatatgagacacttagtctcataattgaaaacttaagttggaaaggttgacaggatattgacttatatgtaaatgacctcggatttgaattctaatgattccaatagctctatatggtgattttggacttaggagcgtgtccggaaaattatttggaggtccgtagtggaattaggcttgaaatggtgaaagttgaatttttgggaagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgactttttgatatcgacgtcggaatctgattctggaaatttgaataggtccggtatgtcatttatgacttgtgtgcaaaatttgaggtcaatcggacgtgaattgataggttccagcttcgtttgtagaaaattggaagtttcatagttcattaggcttgaattgggggtatgattcgtggttttagcattgtgttatgtgatttgaaggctcgaataagttcatatgatgttttaggacttgttggtatttttggttgaggtcccgggggcctcgggtgagtttcagatagttaacgaatcaaattcggacttaaaagaaaaatctaaaagtttctgccatctgatgcaatcacacctgcgaaaattggctagcaggtgtgagctcccagaagtgagcctagaaagtgcagctacggacagggggctgtgaggtagtgttcgcaggtgtgaggaaatttctgcccctgcgtgatcgcagatgcgaacggatgggcacagaagcgagttctccgcaaaagaggagcaagcctcgcaaatgcgagcccgcagaaacggctcctagctcgcagaaacgactccagtggaggctttggcaaacagcagaagcggttgatttcttgcacctgcgggaccacagtagcggctaagtgagtcacaagtgcggaacccttggacagtatacatttcgaaggggttacgagttttgccatttttggaccttcaagcacggcttttggggcgattttcagagagaattcaaggaaaacttgaggtaagtcacttgtgatcatttctacttcaaattattgaattatcatcgaataatccgactagattacgtgattttgaggtgtatatcgtggatttaaacttagggatttgaaaataagattggaggatttggaggtcaagttggtgtcggaatttagtaaaattggtatggtaggactcgtggttgaatgtgctttaggattttgtaacttttgccgggttccgagatgtgggctccacgggcgatttttgagttaaatttcggatttcattggaaaattagtattttcttatggaattaatttcaataatttgtatcaactgaatcgaattaattttggctagatatgaggctttcagagaccaattcacgaggaaagagcatagcggagtaagaaattatgcggtttgaggtaagtaacattgctaaaattggttctgagggtatgaatccccgaattgatgttatataaattgtttggaggtgacgtacacgatagtgacgagtgcgcagacgtgcaccattgaaattttgatttgaacaaatcctatgaagtcgtatattaaagaatcatgttattatctgaatcttttccacgtgttagagaagttgagcttaggctcttaataaagatcatgtttaggttacgtgccgatatttttgggacccatggggtcgtgttgctgttaaattaaacgttttaaaaatgtacattttgtactaagtcatattcattcactgtaaggatatttatggatcgagctgcgtgccgcagcatgccatattggtttgatacatattattattatatggatcgagctgcgcactgcagcaggccttataggctttatttttattattatgggatcgcactgcacgccacagtacgctatatgtgctttatataacgcttgagctgaaggagcccatacggagtctgtacaccccaagtgagcgtagattattatatatacgggatggaattcccagggcatggacttgccttacttatttatactgtgatgtattttcccttgacatggatcttgtctatatcatttacaattagggataaattaccccaggggtggattggccttatacggtactgagtgactaattgtttgttgatgtgtatatatatacgggatggaatatccctgggctgattggccataaatagtaccgagtgaccgaatgatttgtgaccagtattacatgaggtctttcaactgagatgtcatatacctcatatcatgcagtattgatctatttcacttgtactgagtttaactgttgaacttgtaagcatgactacatttttgtaccattatttatattggactgtacctgcggagctcgtcactactttcatcccagaggttagtcttgttacttattgagttggttgtactcatactacaccctgcacctcgtgtgcagatctaggtgctcccggatacggcgactgctagatttgagagttatttctgttggagactatcgaggtagtttcttgacgtccgcatacttgattcccttcttgtttagttattgtactgttctatattttcagacagtgattttatcagccagactttgtattcatttagatgctcatgtactcagtgacaccgggttttgggagtgattataactgtattgtgaaatttcttccgttgaatttaaatattatgtttttaatcttaaaaaatgtggtggtttattgagattgttgtcttgcctagtattgagataggcgccatcacgataggtgagattttgggtcgtgacagtaatacatttgaaatatttgatgcaatttcaaaacataggtatataagaaaagtgagttttacaaatgtgtatattatgaaatatgtaagaattttaggagaatgggatatttcccaaagcttctgctgtaagaagctacgtaaacgtttgagcaaataacttcaataatatagttgaatcacaacatgagagcaaaagagagaatacagtctagagatcagatagaaagaatgccattggtttaacctaatttaacaaatatagtggctaataaataatggatttgtatttaattagaagattatgggttacctagatgtcacgatccaaaatctcaacccgtcgtaatggtgcctaacacaccagctaggcaagccgaaatatgataaccaaggcaacatagtaacgaaattcatataaataacatatatctgaggtctcaatacaataaaactactaatacaaagtatttcccccagaaactggtaagtatggagtcatgagcttctacaacggaatacaagtctgaaactgaacaataaatacattaattatactataacaatagtgtgaaaggaaaagacaagtcaaactgcgaccaaggatgcagctctacctcgcttctagtagatagtccaacaagcaacctactgctgataactggtccccataccttgatctgcacatttaagtgcagagtgtagtatgagtacaaccaacccaatatactcaataagtatcattaataaacacggcaaggtaagagaagcacaaattattaatgatactagctatcacctgtgtagttttatcctttaaatcagtacagaacaatgttggaatcaaattataaattttagtatgaaaacatccgtgtgtgtatgtgtacaatttctcaagtactctactcagacaatatcatggcagaggtgacatgcagttaaatcagataaatgattaaggaaattacaaataaagatgaaataaaaaatccaatagaacactagccaggttccctaacatttccatatccgttccaaaccacttatcaatattctaaatattcgcgtgtacaccatcacgagagaaacatgagagggtgaccctagggggatggatccatatccacacgttgcacggataattcacgtgctaataatagaaatcgcacggacaaactcatgtgctaataatagaacccgcacggataactcacgtgttgcacaaacaattcacatgctagtaacatcaatatctagactcgcacagataactcacgtgtcaataacacaatccgtccggatggtcaaaagcacaacaacacaatctgcctgccgtggtcacaggcacccagtccaatcatatcatataggagcaaataaataagtacacatgtatgaaacgagtgaataacaaatctcatgctcgtgggctggtataaacgacatgctaacgtgtaggcatgtgaaagtgtactatcataactcaaaccaacaaatttcatcaaagaataacatttatcagtttattcagggattaaaccactatgtagcatcaaacatggctcaaatagttcacaataggggtgggcgtcggctggttcggttcggtttgttcgatttttggttttctatttggtgcagcaataaccgaaccaaaactacttcggtttcttcggtttttgttaattcgtttcagtcgattttcggttcaatttggtctgtttgatcttgtcgtattaagcttttaaatcggactactaaaaaatatgactaatttatattttagtgcaactaaaactaatacttataatatgattagccaaattatttagttgatgtaggaaatataaatttatttgaaaaaacatacttacaatataactatctcgtagaccacaacatcggcggcacgcaagtaaaacaaagatgaaagatgcattggcaaacatgttattgttattattgttgttaatatttcttctcataaaacaaatgaaaaaaaacgaactgacggcattggtgtacttgattttccattcttaggaagatatgactcagaaggtaccaaaagtaaaagattaggcggaatggataatttacagaatgtgggactttatttgactttgggtttcatattttataatgtaaacatgtggaaaagttgggctagacaacttaagaagagcccagaagctaggacccatattagaaaattttgattttccggtttaaccgaaaatagaagttgcaaaactgagcaccaaaccaaataccaaaattatagaaaacataaaccgcaaaccgactgaataagccaaaaaatcgaaattgaataaatcgaagtttacggttcgatcgattttttcggttcgatcggtattatgcccacccctagttcacaacaatatcacaatctgtgaagcatcgaagcttaaggtataacagttaaattctaggcttataagagcctaagcacaacccgaacatgaataaataaccccggtgtccgcacatgggttcatccccatgcatgtgcgcacccaataacacgtatctattacaacaattcaggcaactagtgcctcaccgagtttaaataagatacttacctcaaacaaatcaaattactccgctagaaagcccttcccacgcgtatcaatcttcggaaggctcgaatctagccaaaaataacgtaatactatcaataaaatctataggaattgattccaaatgataaagttaaaatctttaaacaaaatcaaaatgtcaaccgggggcccacgtctcgaaatccgataaaatttataaaatccaaactctaattcaataatgagtccaaccatactaaaattattcaaatccggccttaaattgactttcaaatccccaaaattcgatctatgaagtttcacaaatttcctccaaattttccaactcaaaacaccaattaaatgacaaaaataatgatggattcatgcataatagctaaattttagttagaaccacttaccccgataacttcattgaaaattcctcaaaatatcgtcacaatccgagctctctaggtcaaaacatgaagaatgaatggaaaacactcgaactttctatttctaccgaacgattttctcttttgtggctccgcacctatagaaaatccatcgcaagtgcggcttcaactcaagccaacaatctccacttctgcggtccaaatagcgcacatgcacttccgcttctgcgggcaacaagtgcttgtgcgcacacgcatatgcggaccaagtgcacttctgcgccctcaggccatcttagccaattccacttgtgcgacctctcttccacatctacgaccttgcaggtgtggaatattcctcgcaactacgcttctaggcctcctccccaaatctcgcacctgcgacgacacacatgtacctgcagacactccctccgcaggtgcgatgacactagacttcagcaataacaacatccctctaagtccaaatttcaattccttttcaatctgaatctcatccaaggaccccgggaccccatccaaatatgtcaacaagtccaaaaacaagatacaaactcaaattgtaacaccctggaaaattttgaagtacttaagtgctaattatattattttatgtacagacgaggactattaatatcatggatattaattggatatgataataaaagtacgagtcatagtataagtgatgtggggtctaaggagatccctaagtataagccaagttggaaattacatgatagactaaagttccaaatgagtacgcacaagaccaaatttgggatgcgcatatctacatatatatataaggcgttatgtgatggacaacctataaaataaaagctcttcgagtctagtttctaacgcttcacaccacttgtcatttggacactcctacaagaatttatgaacaaattcccaaaggctagatctgcggtcaattttgctattgcaaaacggttccgcggaccgcataagcatcgcaaagtggagcagagacagacaaattttgaaaaaaactattctactaccatataattaattatgcgatcacataatcgattatagtatcgcataatcgattatgctatcgcaaaatcaattatgctgcccgtaaaacgattatgctatagcataattgactttaggggtcattattggaaattttcgtatccaatccaattttgatataaggccttagggggtcattttagaaggtaaaatgtgatattttagacagaggagagagctatcttagagacaaaaagagaagacctagctattttgttcatcaattcttgctcaaggtttgaggatttcataagatcttcatctaataagtaagattctactccctagacctatattttgggatttggattaaagggtgtgagagtattatgtatacatgtatgtaccaataaggtttgtgggaagattgttgagtttaaataagtaaagattgggttgtggaatgaaggaaatcttgtagaagaaccttgtagccaaatttgcacacctagtgtttgataaaatgctcaaatgagctgaaaccatgaatatcttcctaatttgtgttcagttttgttttgtctcaaaatagattgggattgctagaattttcggaacgttgtagtaattaaaggaaagctcaaagcaaggtatgttggctaaactactctcttagaaatgaattccatgttgtccccgtaagtttcaagtatggtcttctcaagttccttattctatgttctgagatgtttccaataaattcaattgtcccgaataagcaatgtgtcgagaattatgtattcaaaacgtgttacgaatgttcctatcacattatgttatcctttgggaatatgttcaagaatgatatgtgtattaaaatgctatgtctttgagtcatgtttaaaatgaaggctatgataccaaattgtgtgagaaaatctcaatatgcataagactcttaattgctcatatgtgtacctaaagtcttgattgaaaataacttattgttgataatctataaagatggttggaagtgaaataagcgaattggggatataaagtgtggccaacgtgctaagagtgaaagttatacttgtggccaatggtgccaatggaatgaaatgatgtgagaaagattatgaaatgagctttgattcgactgttcaaaaattgacttcgaaaatagaattgcctaaaagcttatgaactcaagtgatgcccatatgtggttgttttaattaatgctatgctttgtaagtagtttctatgggttttgcgttcttacatattcctgagttgaaattgtgtattgccctttttgggaaaaagtatttcaagaataaatgatgtgttacttgtttattattttaacttgcgcttcgattgccaatcattttactccatttattggaaagaaatctattgtgtttaaaatcttcatttctaatgaatttaaagttgtgattttcggaatattctatatattgatatttatgatgatgacccatgaaaggataaaaataaaagtgtgaaatatgaaatacgaccattgtgccatgaatgaagaatcatatgtatggccaaaagaactaatgaaataatgatgttgaaagttgttgaaagtgccaatgaggctatatatagtatgaatggttatgaggtaaatgcatttgtattgttgtttcctttgtaagcaaatcaaaaaatatttttgggagtatcgatagtcactaataaagggtaggttgaaataacctaaccccgaaactacacatgccggtgtagaagtggattgtaattattcctcatatttgggatgggattgatgtgataaaagcattccccttaattgggatgagatgattgatagaaaaggatgatgtcgagccacataacattgcggtaagatggcctagccgatcgggccgtgatcgcacaccatgctgcacacatggtggtgattgtgctagaaattataattgaaattgggattgtggttgatgtctcggataagatggcctagccgatcgggtcgtgatcggactccgtgctaaaagtacggtggtattggtattgtgaataatcgtattgtaaaaggtaatattgtgaacagtggtatatcggtgctaaagatctcccaacaaaaaataatattatcttcatattttggaaattattatgttttaacttggaaattggatatcactgattgtttattgttgtttccatgatattttcttttatgttggcattctattttgaaagagaacagttagctttacatactagtactattccatatgtactaacgtcccttttgccgggggtgctgcatctttagtggattcaggtggttcatcagcgggcaactttggtcctcattagcagtcactctctattcaacaggttttggtgagccctactctattccgtgctttatgtcatcttatgttgtattttgtactatgagatatagtcggggccttgtcgccgtcactttcattcttcacttctgttatacttagaggctccgtagacaggttgtgagtggtagtcgatgttggaaattgaactacaaatgttggtatttgtcaaacatgttttttattatatttataaacttgtaatattttggcgattatgaatgaagttgctaatggaaaagaaatgggagttgttaatgaaattttttcaatgtttgattaatggagtacatctcctctttattcatggatgagtttgggtagaagaaaatctaataggcttgctcggccgggttcactcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctggtcgcgctccccgatttcgaggcatgacacaaatcacatcaaacatcaccaaaaacacgaatcatacccaattcaagactaatgaaactaataaattttcaatttctacaatcgatatcgaaacctatcaaaccaactctgattgacctcaaattttgcacacaagtcataaacgacacaacagacctaatccaacttccggaaccaaagttcgagcccggtaaccataaagtcaactctcggtcaaacttttcaactctccaaacttcaacttttctaacattcgccaattcaagccaaaatcatctacggacctgaaaatcaacatctcgacaaactcctaagtcaaaaatcaccatatggagctatcgaaaccataaaaactctattctggagtcatttacacatatttcaacatccggttgactcttccaacttaggtttccaaccttgagattaggtgtctcaactcattccgaaacatcttcgaaaccaaaccaaccacctcgtcaagtcatgtaacaacaaatgaacatagaataagcaataaatgggggaatgacgctgcaatactcaaaaagaccggccaggtcattacattctccccctcttaaacaaactttcatcctcaaatgggtctagaataatacttggagtctcaaataggtgtggatatatgctttgcatctcccgctcgttctcccaagaagcctcctcgactggatggcctctccactgcaccttcactgaaattatattctttgacctcaactttcaaacctgccgatccaaaatggccactggctccacatcataagtcaaactccatctaacagaactgtgctgaagtccaaaacatgagatggatcactgaaatacttacggagcatgaaaacataaacacttgaagaacactcgatagactaggtggtaatgcaagcttgtaagccatatctccagtcctctcaagcacctcaaaagggacaatatactgagggatcaactttcccttcttctcgaacctcataatacctttcatgggcgaaactatgagcaataccttctcccccaccatgtaggcaacatcacaaaccttccgatcggtgtaattcttctgtctaaactatgctgtgcgaagttgatcctgaatcaacttaacctttttcaaagcatcctgaatcaagtcagtacccaatagccaagcctctcacgttcaaaccaaccaaccggagactaataccgcctcctatacaaggcctcatacggagccatctgaatactcgattgatagttgttgttgtaggcaaactctgcaatcgtagaaactgatcccaaggacccccgaagtccatgacacacgcgcgtagcatatcctccaatatctgaatggtgcgctcggattgtccatccatctaaaggtggaatgttatactcaactcaacccgtgtgcctaactctcgatgcactaatatccaaaatttcgatgtgaactgtgtgccccgatctgaaataatagacatcggcacaccgtgaaggtgaacaatctcacgtatatagatctcaaccaaccgctccgaagaataggtagtcccaactggaattaaatgtgcggacgtagtcaactggtccacaatcacctaaatagcatcaaacttcctcaaagttcgtgggagcccaactacgaaatccatggtgatacactcccatttccactcaggaatctcaagcctctgaagcaaaccacccgtcctatgatgctcgtgcttcacctgctggaaattcaagcattgagctacaaactccacaatgtcttttttcattattctccaccaatagtgcttcctcaagtcccgatacatctttgcagcagccgggtgaatggaataccgcaaactttgggcctcctctagaatcaactaatgtagctcatccatattgggcacacaaatctgaccctgcatctgtaacacctcatcatccaccatagaaacctccttggcatcaccgtactgaaccgtgtctttaaggacaagcaaatgggggtcgtcatactaacactctctgatgcgatcatataaagaagaccgagaaaccacacaagctagaactcgactaggctccgaaacatctaaccttatgaactcattgtccaaggcttgaaaatccgatgcaagtgatctctcaccaacaagaatatatgcaaggctacccatacttaccgccttcctactcaaggcatcggccactacattggccttcccgggatgataaaaaatggtaatatcatagttttttaacagctccaaccatcttcgttgcctcaaatttagataagcgatcaaactcattatcaagacacacctaataccaatctgagaagcatcacaatacactgtgtaagaacctgatgcgaaggcaaaactagaactggagctatcagtcttgagcttctaaaagctctcctcacactcattcaaccacctaaatggagtactcttccgggtcaacctggtcaatggcactgcaatggacgagaaaccctccacaaagcgataataatatctggccaagtcgagaaaattctgaatctcagcagttgaagatggtctgggccaattctaaacctcgcgcatccttcgtataaaaatctcttggctctactcgtgcatctgtaagatactctttaaaggtgttaggatacggataagatgtgtcagcttgcctggcgaccataaagatgttgtccgacatcacgacacccttattgattgggtacccggccatgatggaggcgataagaactacccgcgggatcggaagatatgtctcattctgacacgggtctagtcggcttcatacaaaggtctgccacacctttgcctcaaaacgcaaagtatttgtgtgaataggcacccctattgtgatctatggtggtggtggcccaggagctgctagaatctcaactagccatgggcgagctgcatccccaagtgaaaacttctctaaatactctgtgggctcgacatcatcaaaccccaagtaggtattcaatgtgtgttggtcaaaatgcaccttgaggttcctcactttagtcatatttttcctttcatgatatgcgccacattggcatagagctcccggaaaaggtattcctttacatctaccacgctctggtgaaccacatccaccctttgcgctctcgaaactgcctcaaaactacaaggttatacctttctagatctctcaactataactatcactcaagagtgagcgaactcactggctaccactcacagaagctagaaaaggaatctaaactgatgaaccggtcctcccacacctctttcttcttcgaccgctcaaggccggcaactgtagcatctccccatcggccataatctgaaatgtcctgaactgatgtctctggtgcttgggggacaggtgtagtggaaggctcaaaagcctgactggcactctccgaaacctcggaggtgttatgtggtgaagacggctcatccctgacctgatatctccctagtgtccttgattgcatggccgactgctcatgaacttagggtgagttgcccttggagacgtccctagacgggacataagaactggtctccgagaggtctgcacctctccctctgccgactgctaacttctttctacttttaagatgttgggcaatgggtaagggtctcttccctcgtccccgagaagggtcaccccttccttttgaaatgtctctttatcctctagatcgaaccatattctgtaccaaacaaaggcgattgttagttgcaattcaatttcagacacataatgaatgcaaggacacacaagagattacagtggaaaaacacagtagaaacatgcttgcagggtagggaattgtgatccgcacaattgtcattgcgatcgcataatgggcattgcggacaatacacttttcctttgcggccccaaaaatgtattgcgatccgcacatttctcattgcggccgcagaaccattccttactatagtgccctagaccttaacttatgcggaccacacaatttcttgtacggtcagagataccaacaattacgaatatatggccgtttttcacctagggcttgagatgtttgcacaatatttacatggaaacaatatctaatcttgagaaacaatttaccaattccccttagagcagttaccagtttacccactacatatttaccccacatggttgttcaaaaagatttaatcaaacaaatggtccaaaatttcactaaaactctaaaatttaaaatatattaatcaagatgatgatgcataccagatatgaatgagtgcaagagataagtgatcaacagttgttaggcttgtgagcagataatgtaacaaacaatttcaatttagtgtgtgagcttagagaggcaaaagggaacaatgccctagcctcttctatttgtagtgatcggtttatggcaagtgaaggggaggtgagtgcggccgcaaaattccaattacggtccgcactctgttatctgagggcccatatgccctagcattttgcggtctgcataatttgttgtgcgtctgcggattctgttgcggtccgcagaatttgggttgtggccacagattggccatttctctgatggaccaacttcatagagttgacattttccacctttaacttgtgtggtctgtaatgcaatagtgcggccgcagagtaccttttggtgcagcagtcaaaattgtgcggtccgcaattcgttccacacttaacctgatttatgggtactcttcctataaaacacactcattcctacaatactcttcaaatccaggtagcacaaaaataacacctatctacaaaataagaaaagaaaagaaagagaaacatgggtttcctcccaagaagtgcctgatttaatgtcgcgacacgatgcaaattaccatcatttgaaatgaatcactgccacaacgcgaccatcactaacctttcccaaatagtgcttcacccagtgaccattgactcaaaatacctcattatttttgttcttaaagtccaatgcaccaaaagggatcacacccacaatttcaaatggaccactctatttagatttcagctttccgggaaacatcctcaatcgagaattgaacaacaaaacaagatcgcccaccttgaactctttgttatacatgtatttttcatgaaggtacttcatgttctctttgtacaaggacgaacttgcataggcatggtaccagaactcatccaattcattcaaacgtgcaaccctcaagttagcggctgcatcacaatcaagattcaatttctttaaagcccacatggctttgtgctcaagttccaccggaagatgataggattttccggacactaaccggtaaggagacatttcgataggtgtcttaaaagtagtccaataagccataatgcatcatcaagtttctttgaccaatctattcggttagcattcactgttttggacaagatactttttatctcccggttggagacttccacttgactactagcttgtggacgatagggagtcgtaactttatgagtgacaccatacttgctaagcaaagtatcaaaagccttgttgcaaaaatacaaaaccccattgcttatgatagcccgcggagtaccaaaccttgtgaaaatattcttcttcaagaacaccaccacacttcttgcatcattgttggatagagcaatggcctcaacccatttagacacataatcaaccgcgaccaagatgtaggtgttttcacaagaactcacaaaaggacccatgaagtcaataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaagatatcaatctccaaaatagtattgagaggcatttcgttcttcttcgagattccaccggcctattgacattcatcacatcttttcaccacctcacttgcatctttgtaaagaattttccaatagaaaccgcaacttagcactttggccgccattcctgatccaccatggtgaccaccataaagcgaataatggcaagccccaagaatataactttgatcttcttccgataaacatgttctaattaccccatccatgcaaatacgaaaaaggtatgactcatcccaataataatcttgacaatctcgcttgatcttgtttctttgatttgaagagaactcatccgggatgattccacacatagggaagtttgctagatcctcgaaccatgtcacctccttcattgaaatagccaagagttgctcatcagggaaaaagtcattgatttcaaggccatcatgcggccttccctcctcctccaaacgagacaagtggtccgccacttgattttcactcccttttcaatcttggatgtcaatatcaaactcttgaaactatagcacctatctcatcaaccgagtttttgaatcattcttgctcataagatagcaatgttccgcatgatccgtatgaacaataacctttgcgcccatcaagtacaagcgaaacttctcaattgcaaacacaatggcaaggagatctttctctgtaacggtgtagttgacataggcaccattcatggtcttactagcatagtagactggatgaaaaatcttgttgatgcgttgccccaaaatagccccaaccgctatgtcactagcatcacacatgagctcaaaaaggatactccaattatgagcggtgataatgggagtggttgtcaacttgatctttagcaattcaaaatctctcatgcaatcataattgaagtgaaatttagcatgtttctctaagagctttcacaacgggttcaccactttagagaaatactttatgaagcgctggtaaaaccccgcgtgacctaagaaactttgcacgcctttcaccaaagtcggaggttgaagtttagaaaaattacctcaatcttagacttgtcgacttctatgccattctttgagatcttgtggccaaggacaatgccttcctcgaccatgaaatgacacatctcccaatttagcaccaagttcatttcttcacgccttgccaatattctatccaaatttgccaagaaatcatcaaaggaatccccgaccactgagaagtcatccatgaaaacttcaaggtaatcctttaccatgtccatgaagatcgccatcatacacctttgaaaagtcactggtgcattacatagaccaaatggcatccccttgaaggcaccatagggacatgtaaaagttattttctcttgattttccagagcaataaggatttggaggaagggaagtggaaaatgatccttccttgtgactttgtttagcttgctatagttcatacacactctccacccgatcaccgttcttgttggaatcaactcattcttgttattggtgaccaccgtcaggcccctttcattgggacacattgcaccggagaagtccacgaactatcaaaaatggggtagacaacctcgacatctaaccacttgataatctcctttttgacaacttcttgcatagcctcattgagtctcctttgatgttcaatagatggtttggagtcttcctccaagttgatcttgtgcatgcaaaatgcggggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacgaatatctgccaatgtccatccaacagccttcctcctcttatgtagcactgccaatgtagagtcaacctgcacattagtcaaacaagaggaaagaataaccggtaaagtagaacaagggacaggaaattcataccgaacatgtggaggcaatggtttcaactccaaggttagaggctcttcaattgaaggttttgtaggaggtgttttcctattttcaagatccaaggaaagttttcggggtgcatagttgtacgaccccatccattgcaaagagttcacacattccataaagccatccatcccgtcattatcaaagttgagcaagacaacctccaatatatcaaccacattaatcgtggcacttctgtcatcaacaatcacatcggtcaccaggtccacgaaagaacacacttcattactatttggttgccgcatagatttacatacgtggaacaccacattttcatcacccacccgtaaagtgagttattcggcttccacatcaacaagagccttacccgtagcatggcaaggtgttccaagaataatcggcacctcacagtccacttcacaatcaagaatgacaaaatacgccggaagaatgaatttatcaacatgaaccaatacatcttcaatcactcccaatggtctcttcattgttcgatcggccatttgtaatctcatagatatgggtcttggttgcccaattcccaaagtcttgaaaaccgaatagggcatcaaattgatactttccccaagatcacaagggattttgaaagcaccgggatcttccaatataggagctattgaatgcacaattgcactcacttgatgagtgaccttgatagttttaaaattcatcgaccgtttctttgtcaccaaatccttcataaactttgcataaccggacatttgttccaaggcttcaactaatggaacattgattgagagactcttcatcatgtcaatgaactttttgaattgagtctcgccattttgcttggaaagcctttgaggatacagaggaggaggctttggcaatggtgccttagccttttgcactaccggttccggtatgtcaataacatgatccccagacgggttcacttcctcttgggtctcttccacattgtcatcaatatcaatccgcacttcatcatttgcttgcactatattgttcgtgatctcttcttcttgtaccacttgctcatcatccataaattgactttgacttgaggtgggtgcattcccaccttttctacttcttgtagtaacggccatggcatgccccgtgttgttcccaccctttgggttcaccactgtgtcacttggtagtgcctccttaggacgagaatttagagcttgagagattttccccatttgcacttctaagttgcagatcaatgtgttatgtgaggcaagttgggcatcagaattggtattcttctccatcatttgcttgaacatgttctgaatacatcccatttaattgttggaataattaggactatgggaaggataaggaggcgtgttgcttagttgttgatacatcgggggactttgagaacccgacccccgaccgccttggttgttacatccccaattgccttggttattgttgttatgtcaattcccttgattatttccaccactataatttccttgattgtttttattattccaattgcttcgattgtttccaccgctccaattgccttggttgtgagaattccaatttccttgattgttttgaggtcgccattgttgttgtcttgggccttggaagttgtttctttacccttgaaagttgttcacatattggacctcttcttcttggtcattataagagtcatattgatcaaacccactatcttcttgcaaacaattatccactctttgttgcacttgtggacccttcgttctccgtttgttcatcatcatgtttactctctccattgccttgacttgcctcgggttttgcactttttgaagtttagcctttgccaattggttcatggtagtggtcaatttggctatggcttgcccatagtcatgcaactctttgtgaatgtgaattacactgggatcaccttgtggaacattagcccgggattgccacacaggagaagtgttcgccatttcatccaaaatatcacacgcctccgtataaggcgtagtcatgaagttctcaccggcaagttgattcactacacattggttggttgtgttgatccccctatagaaaatttgttgaattatgttctccatcatatctttgttgggatactctttaaccattggtttatatcgttcccatatctcgtgtagtggttcattgggctcttgcttgaatgctagaatttcatcccgaagtatagccatttgctcgggagagaagtacttagaaataatgttctccgccagttcatcacaagtatgaatgaaatggtttggcaaacgttccaaccaatctaaagcttccccccgtagagagaagggaaaaagccttagcctcaaagtatcctcggagacatttgtttgtttactcccccaacacgtatccgtaaaccccttcaagtgtttgtatgcattttgacccgaagaaccggtgaaaacccatcgttgctcaagcaaggtgcacatcacgttggttatttgaaagttgaccgccctaatacggggaaggactattgcacttgcatatccttcattcggcaatactcggtgtggagccgctcatggtggaggtgagggtggagcgggcacattgtcataggacactcgacctcgtctattggcttgaggttcaagaggaacctcatccattttattatcctcaacgtccacatcccccaaagcaatatttctgagctcattgtttgccatggttgcacctacaatttcccaacatgttagtaacacaaaaggaaaagaagatattccaaaaacacactcaaatatatagctaacacaatttttgactcctcggtgacggtgccaaaatttgacctatcgcacacaatgcacacctcaatacaagatatgaatcggttgattgcaattatagtaacccaacaaagagtcgggatcgaatccacaaggagttatatgggagctaggagtatataatctagtgcgtgaatttgaactatcttaatttgcacttttacaaattggtgttgtttctatttctattttaaaactagagactgtcaactagaaggaataagactaggataattatttttttgttatcttttcaagtttgtaaaaagcctagggctattaccatcacctaggtgctcgcctaatgagatattaatcttaatgcttgttttgttgatcggggtgtattatagctatcaactctcaattacccattcaatacctctcgatcagagagtggttttgcccaatttggctttctcaagtcaaaatgcataatcacacaaaacggttgataatagctcaagtcgggttattactatctctaggttgaaccctttaattgggttgatcaatctctcaattgacccaatttcttgttagccaagttttcctagactaagtctttctttctcaagtagagactaaatcaaataggcatgaactaatggttgcaaccattaattccataaattaaagcatgaacgaggctaaataataaatacccaatcacaaacaagcactaaattagatacccataaggattaaacactagggttgggatacaaccctagtaaaaatctagctactcatgcttgaaatgaagaaatggaagaagaaatatcaattaaactcatattgtaaagttaaaatatttaaatctatagtaaaataccccaaaatatagaaaactttcaaaagaggccaagaaaaatggctaaaggacttgctgatgttaaaaattgacctaattttgtgaaagtcgtctatttctacaacgctagaaatttcagataaaattgtccttcaggaggttctgcggccgcacaattccatgtgcagtccgcagaattcttcatcttgcaggatctgggattctgcggccgcgaggcaatatttctgcggtctgtagatttatcaccgtggccgcaatttggtcttctgcggtccgcatctttacttctacgaccgcaatctggttttctgtggtccgcatatttacttttgcggccgtaaggcacttcttttgcgaccacacaattcttgtgcggtccgcaattttgagggtcttagactttggaaattttgcaaccctctaaagttgatctccagctcgtcatttgcggccgcacaattcctatgcggtccgcagttttctagaaagcatgatgggcttttcttcattatttgtggccgcatatggaattctgcagtccgcactttgtgagattttgtgccttttattgccttatgtttagattactcctttttgagtcgaatttcatcccgtgagtccaacttccaacattcctgcaattttgcacatttcattagtttcgggaacacaattcaacgcatttagacttaaaaaaaaagctaaaagatcttaataggtactcaaaatctccacttatcactatcatacttgggtttgaagaaaatgaagaagaaggattaattaaactcataataaaaaattaaaatagctaaatctatcgtaaattacaccaaagcaaagcaaacttccaaaaatggcaaagaaaaagggctacaatgtttacagaggttcaaacttcacctaatttcataaagctcttctatttatacaagtctgaaaatatcggacaaaaatgcccctcaggaggttttggggccgcacacttccatgtatggtccgcagacttcttcatctggaaggagctgggattctgcggccgcacaattgtgaactgcgaccgctgggcaacatttgtgcgatccacagatttagaactacagccgcaagtcactcttttgcggtccgcaatagtgcagcaaaacaattttcttcggtcgcacaaatcttgtgcggtccgcaattctctgaagctttggacttggtccttttgcaatctctctgatcttgacctttagcccattttttgcggcctcacaattcatgtgcggaccataatttggacaattgtctgctgcgttttccttctttgtttgcggccgcaggtggaattctgcggaccgcacattgtatgtttctatgccatttgttgccttgtacttggactactcctctttgagtcggatttcatctcgggagcccaacttccagcattcctgcaattttgcacaatttcattagttttgggaacacaattcaaagcttttgggctaaaacaaaatctaaaaggcactaataagcagtcaaaatccccacttatcaactcccccaaacttaagtatttgcttgtcctcaagcaaataaattagttcccacatctacaagttaagggtcatttcagcgagtcgaatgtgagccatccacacatcagttgggaccaacaattacccacactacctatgtattgtcaacaaggcgataagttaaccatttatgcacatatagttctaaagtgacatttgagcatcaaagattgactttagtcatctaggattctttctctatcatgtaggtcattgtggattctaaagtcttcctcctttacttttcggtttcctggttcacttaagaattttagcactcaatccaacgatttatgaaaggtccactcatctctctcaagagaatgtcacaagtacggcttcaagtaccataggcttgctcctcatgtagatcgccactaatgtaagatcactcagcttgagatcaaataggacttttttcgagatgtaatgaaggcttttggattagggttggatacaatctggttgagtggttccaccttccttaagcactccatcattcatttctcggctcacactttgccaattccttgatgcactttcttttccttgggggactagagatacttaacatcactctttcttgatcattacagtcatatttctccatgtttgggatcattgccttctttgaatcccttcaactcttctacttattcatttttttgcatttttcttcttttgaatttccttgcctctccctcaaacttatgtttttagccattttttcacatgagtattaaggaaagctcgggtgtcaagagagggtctcaatagaatgggtaaaggcttgtagcatgattttcaaatgagaaggctaaaggctcgaagaggttgactagggatgacatcattggtaggcaatagaaaactcaaacgggccaaggaaagcctacaatcacttctcaagccaagcaaaacttaggatttctccttaaaacacattcggggcaagttctagaccttttgcacgggtacttggactaacaccatagcaactcacctctcacgcaactggattgttaaagaggacagagttgagggcccacaacgaccatatttaagtttgaaaatcactatggttcaattaaaccattagatggttgccaaagtcaacacaagagtcacaaagtcactaactagagttatttctttcaaaaaccttatttttaaccataagcacgtagttaagtgtgttggtaccaaatgaagcacgattgactcttcgagcatgactcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaacgaacccattcccttaagaaggttgtcatgcaatcctccattgggacgagtcacccggttcacacaataactacctttggaaagaaccgtggcattaagaaaatcaaagtcttattatctactgaaatataaaaagaagctaccaaataaaaaaagctactaattcaaaaagaagctactaaattaaacactaactaataagaaaacaaacataaagaagctacaaagcaaaaattgtcgaaagcataacgaatatacataatgagggagaaagagaagatatatacataatgagagaagaagaggaaaatagtatcaagttattacaagacaaatgtctcagaatcatcaaataagatcaaataaactccaacctccctctcctccaaatagaaaaataagcattgtccccaatgcttagcaaaataagagtaaaggaagggaaagagtgaagaaaactccctttggatcattggacacatctgtgtccacagaaacatcaccaccctcagtctcatctaactggatctcatcaacctcagctctgggtgggactgggttagtgaacatctgacacactgcctcggcagtgtcagcatcaaagtctggctcctcagactggccagctgtgccaacggtgttgcaggatctgggcctgaagggtgtgggtcaatcagcatgtcaaacagaatatctccagctacatcaaccttggtcacctgccttcggagcttgtccaccgactttttactggcctagaactttctcatcttctttacttctttgcccttctcttcgatcactgacatgtgatgtactaaggtagccatgattgtgttctagttctctaggagcttcttcaatgagatgcctgaatagaagaatgtgctgcaatagtactggataagtctgacaactttgtagtggctatctgcatccagttgttaaggctcgccaatgtgtaggagactcgcaacggagaaagttgagcagtaggtatgggcaccggcttcaaagctgaagtggaacctgtaacaggaactgtagtgggaatataagatggtggtggaggcatagctgtgacactagatgaaggctcgaccgaagtggatggaacattaacttcctctgcaactaccaccgatggcccatcagtttagggtaggacgtgtcagcttgctgagtgatcacagatatgttgaccgacatcacgacacctacattgatagggtacccagccatgatagaagcatctagaatagcccgagggatcagaagataggtctcattctggcacgggtctagtctgctatagacaaaggtttgccacccttttgcctcaaagctcaaagtgttcccgtgaatagaaacccccgctgtgatccatggtggtggtggcccaaggactactagaatctctgctagccaagggagagcttcatccctaagaacacatttatctaagtactatgtgggctcgacatcatcaaatcccaagtatgtgtttaatgtgtgctgatcaaattgcactttgaggtttctcactttcgtcaccgttatcccatttttgatatgcgccacatttgcgtagaattcccggacaaggtactctttagcatccaccacgctctaggtaaaccacatcctccctttgcgttctctaaattgtctcaatacttccgggttattcctctccagatctttcaactgaaactgtcacgcaagagtgagcaacctcactggccatcattcagggaagctagagaaagcatccaagctaataaaccggtcctcccatacctctttcttcctcgaccattcaaggctggcaactgcagcatctccccctctgtcatcaacggggatgccctgaactgatgtatcggtgcctcagtgacaggtgtattggatgtctcagaagtatgactagcacttttcgatcccttggaagtgctatgagatgaggacgactcgtccctgagttgatacctccttagcgaccatgactgaacggccggctgctcttgtacagaggaagagttgccctttgattcttccctaaatgggacataagtgctggtctcagaaaggtctgcacctctccctctgccggttgtaagtttctttgtgattgtcttttgtaggccgatgggtaaagcactcttgcctcgaaccctgaaagatacacctcttcctttcgaagtgtcgcctctatctctaaatcataccattttctgtaccaagcaaaggcaattattagttgcaattcaagctcagacatacactgagttatgtaaggacacaccagaagacacagtgaggaatacagttggaatatgcttgcaggatagggatctatggttcgtacatttatcattgcggccgcagattgggacttgcagatcgcacaattctctcttgtggccgcagatgtgaagtgcagaccgcatagtttttcttgtagccacacattgaagcacaaatattacacttctctgaagatagtaaaatagatattttgcggccgcaatggaaattcctagagttttacacttctctgaagacagggatctgcggtccgcacaattttccttgcggacacagacctattcattcctagagttaccctagactctacttctgtggaccgcacaatttcttgtgcggccgcatcaagcaattatgaacaggtcagtaatgttatcttgggcttgcaatttttgcacaatttttaacatggaaacaacgtacaagcatgaaaatctattgacccagttcccatagagcatgtactagttgaccactacagatttacccccacatggttgtacaatttatttctactaacaaaaggcctaaactaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatactataaattaaactaaaaattgaaaaattctaacaagtaattaaagcataccagatatgagtgagtgcaagaaatgggtgttcaacaattgccaggcgtgtgggcagatgatttaccaagaggattcaaattggtgcaagttttgtgctcagagagagaaaagggtaacagtagccctagccctcttatttatatgcttgaagttcagaaggggaaaaggtgtgagtgcggcagcagaattccagttacagactgcactctgttacctggtgagattaaacctttgttttgtctgcggtccgcaaaacctttgtgtgcggccgcagatccttgttgcggaccgcaaattttgtgttgccgcggtagatcggccatttttctgacaggccaacttcagagagctatcattttccaccttcaatttgtgcggtccgcaagttaattgtgtggctgcagagtaccttttgttgtagcaaccataattgtggagtccgcacaatgcaactgcagtccgcaattctttcacacttaaccgaatttctggccacaattcctgtaaaacacactcatccctgtagcacacttcaaatcaagtaagcgcaaaaataaacataactacaaaagaaacaaagaaaagaaaaagaaacatgggttgcctcccaagaaagggcatgatttaatgtcgcgacacaacgcagagtaccttcagttgaaacgaatcaccgccacgaagtggctatttccaacttttcccaaatagtgcttcactcgatgtccattgactcagaatacttcattgtttttgttcttcaagtccaatgcaccaaaaggtgtcacacccacaatttcaaaaggaccactccatttagactttagttttccgggaaacatccttaacctcgagttgaacaacaatacgagatcacccatcatgaactcattgttccaaatgtatttgtcatgaagatatttcatcttttctttgtacaaggacgaactttcataggcatgataccggaactcatcaaattcattcaaatgtgcaaccctcaagttagcggctacatcccaatcaagattcaacttctttagagcccacatggctttctgctcacgttccaccggaagatgacaagcttttccgaacaccaatcggtatggagacattccgataggtattttgtaagccatccgataagccataatgcatcatcaagcttcttggaccaatccgttcggttagcattcactgttttggacaaaatactttttatttcctagttggagacttccacttgatcgcttgtttgtggatgataaggattcgtgactttatgagtaacacaatacttactaagtaaagtgtcgaaagccttgttgcaaaaatgcaacccctcatcgttatgatagccctcagagtaccaaaccttgtgaaaatactcttcttcaagaacaccaccacacttctcgcctcattgttgggtagagcaatggccttaacccatttagacacataatcaatcgcaaccaagatgtaggtgtttccataagaactgacaaaaggacccatgaagtcaataccctacacatcaaagatatcaatttccaaaatgatagtgagaggcatttcatttttcttcgagattccacaggccctttaacattcatcacatcatttcactaaatcacttgcatccttttaaagagacgggccaatagaaactacaacttcacactttggtcgacgttcttgctccaccatggtgaccaccatatggcgaaaaatgacaagccccaagaatttcaccttgctcttcttccagtacacatcttctaatcaacccatccgtgcaaattcggaaaaggtatggttcatcccaataataatcttgacaatcccgtttgagcttcttcctttggtttgaagagaactcatccgggatgattccacacacaaggaaattcctagatccacaaaccatggaacctccttcattgaaatagccaagagttgctcatcgaggaaggagtcattgatttcaaggccatcatgcggcctcccctcctcctccaaacgagacaagtggttcgccacttggttttcactcctttttctatcttggatatcaatatcaaactcttgcaacaacatcacgcatctcatcaaccgatctttggaatctttcttactcatatgataacgaagtgccgcatgatccatgtggtcaataacctttgcacccatcaagtacaggcgggacttctcaattgcaaatacaatggcaagaatctatttttccgtaatagtatagttgacttgggcatcattcattgtcttactagcatagtataccggatgaaaaatgtaaggcctcgtaaacattttctaatgatttaagattttaaagtgcgccaacggtatttgggaataatgtatttgagtattaaagaagacctatgtgatagagccacaacattttgaattgataatgtatgtttaaggagtgttggaatatactaaggagttttgtgaatggaaagaacttgcgtggaacaagttggatacattaagtggaaaggattttttaactggcataagatccgacttcaaatgattataactccctcaatataatggctaaggtgttgatctacctataaaattaaagccctttgagtctcatttccaacgcatcaaaccgtttgccatttggatatttctacagaacgttgtggctattttactagacctatgtcatatgcacgcccagatgcgcgaccacgcatatttgggagtttctgccttgtgtgcacgtccagatgcatggccacttgcccaggtgcgcggctgcgcacgtaggagcccattaaataacccaaagaatgggtagagagaggggctaagtcatttcttcaagactagggctttctctccatcacccatccggccaaggcttccaatacactcctaaggtgagtttttaagtgtgtttttatgattatttcacttctcaatcactagttacaccaaggttttgattgaattccatagaatttcttcaaaatctcaagaataccccaaaagttatttttcaaaatttggtctacaagaggtatgtccaccatctctaactaatctatggtgattatttatgtatgaattatgtgttaggacttatgggatggttggaggccacaaatgcctaacctaggttgtgttggtactgtagagattgtaaaatgaattaattgataagatttatgggttgggagtgaattgttgggcatgcatgcatgtgctagagacggttgtaaggtgaatcattggtgtggaaggtggttgttaggtgaagaaatttccattggaggaggttgtagaaagatatgcacactaaatgtttaataaaaagtctaaatgacttaaagtatagaaatcttgctaatgatggtgcaattgtgttgcattgttgtagattgaagttgtttagtatggtggaacatcgtagtattattaaggggcgaattccaggtatgttggctaaactactcttttagaaatgaatttcatgatcttcccgttagtttcaagtattgttggctcaagttcaaaattcccatgttccgagttgttcctaataaattcgattatccagagtaagcaaagtgtcgagaattatgtatataaaatgtattccgaatgttcctagcacattatgttatccttcgggaatatgttcaagtataatatgtgtattaaaatgttatggctttgagtagtgtttcaaatgaaagttatcatgccaaattgtgggagaaaaactcgatgtgcttaagacccttaattgctcatatgtgtacctaaagtcttgattgaaaatgacttgttgttgataatgtataaagatgctcgaaagtgaaagaagtgagttggtgttagaaattgtggccaccgtgccaagaatgaaagttatacttgtggccaatggtgccaatgcaatgatatgatgtgagaaaagttatgaaatgagccttgatttaactattccgaattgacttcgaaaatagatttgcctaaaagcttatgtactcaagtcatgccaaaatgtggctattttatctaatgctatgctttgtaagtatttccaatatgttttgaactcttatatattcaggagttgaaatggtgtactgccctttttggggaaaagtatttcaagaataaatgatgtgttacttgtttatgatttttaaacttgtgcttcgattgccaatcattttactccattttcttgaaaagaaatccattgtgtttaaagccttcattactaaagaacctaaagttgtgatttccaaaatattctatttgttgataattatgatgatgatccatgaaagggaagaaatgaaagtgtggaatatgaaatacggccattatgccatgaaagaagaatcatatgcatggacaaaatagccaataaaataatgatgttgtaagtggttgaaagtatcaatgaggctatatacggtatgaaaacttatgaggtaaatatatttgtattgttgtttcctttgtatgcaaatcaaaaaaatatttttttggagcatcgttagtcaccgagaaagggtatgtaacaacctaaccccgaaactacacgtgccggtgtaggagtgattgatgggtaaatccccatattgatatgattaaattattccccttaaattgggatgatattgatgtgatgatattattccccttatttgggatgagattgatgtgataaaattattccccttaattgggatgggatgattgatagaaaaggatgatgtcgatccacacgacattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccgattgggtcgtaatcggacaccatgctgcacatatggtggtgatagtgctggaaattttaattgaaactgtgattgtggttgatgtctcggctgagacagcctagccgatcgggtcgtgatcgaagaccatgcttcacacatggtggtgattgtgctggaaattgtaattgaaattgtgattgtggttgatgtctctaatgaggtggcctagccgatcgggtcatgatcgaaattcgtgctaaatgtacgatggtattggtattgagagtgatggtggttgatgtctctaatgagatagcctagccaatcgggtcgtgatcggactccgtgctaaaagtacggtggtattggtattgtgtgtattggtattgtgaacggtgatattgtgaacagtggttatcggtgctaaagacctcccaaccaaaaagaatattatcttcgtaattttgaaattattatgttttaacttggcatttggatattattgattgtgacttgttgtttctattaatttccctttcttatagtggcattctattttgaaagaggacagttagctttacatactagtactattccatatgtactaacgtccatttttgccaggggcgctgcatcttcaatggatgcaggtggttcatcaacgagcagctttggtcctcgttagcagccactctctattcagtaggttttggtgagccatactctattccgggcccgatgtcatttgagttgtacattgtcctttaaggtatagccggggccttgttgtcggcacttccatactactcttctgttgtacttagaggctacgtagacaagttgtgggtggtgtttgatatgggaaattgaactaaaagtattggtatttggcaaacatgtttttcattaaatctataaatttgtaaaaatttgaaaattatgaatgaagctgctaatgggaatgtaatgggagttgttaatgaaatctttttagtgcttgattaattgagtgcatctcctctttattcatggatgagttggggtagaagaaaatctaacatgcttgctcggttgggttcactcggttgagcgccggtcgcgctccccgagtttggggcgtgacaaaaaatcttgttgatgtgttgccccaaaacagccccaaccactacgtcactagcatcacacataagctcaaaggggacactccaattttgagcggtgatgatgggagtggttgtcaacttgaactttaacaattcaaaggctctcacgcaatcatcattgaagttaaacttcacatatttctctagaatcttgcacaacgggttcaccacattagagaaatctttgatgaaacgccggtaaaacctcgcgtggcctaagaaactccgcacacctttcaccgaagttggaggtagaagtttagaaataaccttaatctttgccttgtcaacttcaattccattttttgagattttgtggccaaggacaatgctttcctcgaccatgaaatgacacttctcccaattgagcaccaaattcgttgcttcatatcttgccaacactttatctaaatttggaagacaatcattaaactaatccccaaccaccgagaagtcatccatgaaaacttcaaggaagtcctctaccatgtccgtggtgatagccatcatacacctttgaaaagtcgtcggtgcattacacaaaccacatggcatccgcttgaaggttaaagtaccatagggacatgtaaaggttgttttctcttgatactccggagcaataaggatttggttgtagaccgcatacccatcaagaaagaaatagaaagcacggccgaccaacctatcaagcatttggtctaggaagggaagtggaaaatgatccttccttgtgactttgttgagcttatggtagtccaaacacactctccaaccgattaccattcttgtaggaatcaacccattcttgtcattggtgagcaccgtcatgccccccttctttgggacacattgaaccggagtagtccatgaactatcggaaatgaggtagacaaccccggcatccaaccacttataatctcctttttgacaacttcctgcatagcctcatttagtctcctttgatgttcagtagatggtttgtcacattcctccaagttgatcttatgcatgtaaaatgcggggcttatcccccgaatatccgccaatgtccatctaatagtcttctttctcttatgtagcactgccaatgtagaatctacctgcacgttagtcaaacaagaggaaagaataactggtaaaataaaaacaagggccaagaaattcataccgaagatgtggaggcaacggcttcaactccaaggttggaggctcttcaatgaaaggctttgtaggaggagttttcctatttttgagatccaaggatagtttccggggtgcataattatatgaccccattccttgcaaagagttcacacattccatgaagccatcgatcttgtcatcatcaaagttgagcaatacaacctccaacatatgtccaacattgattgtggcatttgtatcatcaacaataacaacggtcactaagaccacaaaagaacacaccccgcatagacttgcagacatggaatatcactttttcatcacccacctagaaagtgagttctccaacttccacatcacaaagagccttccccgtagcaaggaaaggtcttccaagaataatcggcaccttataatccacttcacaatcaagaatgacaaaatctgccggaaggatgaatttatcaacacgaaccaagacatcttcaatcactcccaaaggtctcttcattgtacgatcgtccatttgcaatctcatagaggtgggtattggttgcccaattaccaaggtcttgaaaatcgaatatggcattaaattgatacttgccccaagatcacaaagagctatagcaaactcggcgcttccaattgtataaggaattgtgaaagcacatggatcttccaatttatggccattgattgcacaattgcactcacttgataagtgaccttgatagtttcaaaattcattgaccaattcattatcacaagatccttcatgaactttgcataaccgggtatttgttccaacgtttcaactaatggcacattgattgagagactcttcatcatttgaatgaactttttaaattgattcttgccattttgtttggcaagtccttgaggatatggaggtggaggcttaggcagtggtgccttagccttttgcactaccagttccggtatgtcaataacgtgatccctagacgggttcaccttctcttgagtctcttccacactatcattaatatcaatctgaacttcatcatttgtttgcaccacattgttcgggacctcttcttcttgtaccacttgctcatcatccacaagttgcctttgacttgaggtgggtgcattcccacctcttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtaacggccatggcatgccccgtgtcattcccaccctttgggttcaccatcttgtcacttggtagtgccccttaggacgagaattgagagcttgggagatttgcctcatttacacttttaagtttcgaatcgatgtgttgtgtgagtcaagttgggcatcctaatcggcattcttttccatcattttcttgaacatattctcaatacgccccatctcattggttgaagaactatgaccatgggaatgataagtaggcgggttgttcggttgttgatacatcgggggcttttgaaaacccgaccctcgattgacttgattatggttccatgagtgtctactaaaattaagatagtgaattaaataatcaaaacccatgagtgtctactaaaattcccaaaaccctgtgtcacaagtgcacacgcatctagtagaatatacaaaactctctaagagctactgtctgaaagaaaatataccaaaatgataaaacataataagaaaaggctccgggtgtttcagaatggagcatgagaagaagctcaccactaagcctccgggtaatgcgaatatatgcccggacgaactccagatgcacctacctcagaacctgcacatttttgtgcagaactatagtgtgagtatgtaaacaatgtgtacccagtaagtatctagtctaacctcaaaaaagtagtgatgaggggccgacatcgacacttactagagggcaatatatataatgtacaaggatatttaataggcatgaaatacaacattagtaatggaatcaaatataacatgctaatcgcaacaagtaaggactcaacatgtatttataaatcctcgaatcataaaagacatatgaagtataatcggactccgagtgacaatacgtacgagttatgccgaggtcgtatggctcgatccataataatcgtgcacgtacactaccgaggtcgtatggcccgatccgtggatgcatcccttatatatatatatatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggccgacatcgacacttactagtgggcaatatacataatgtacaaggatatttaataggcatgaaatacaatattagtaatggaatcaaatataacatgctaatatcaacaagtaaggactcaacatgtatttataaatcctcaaatcataaaagacatatcaagtataatcggactccgagtgacaacacgcacgagttatgctgaggtcgtacaacccgatccatatatatatatatatatgtatatgtatataatttccatcaataattaaacattccccaatctctaagtaatgaagattgatttaacataatctttaaccaagttgttttcttattaatacaagcaattaaactagagggttaagttcaaatagtgcaagtaatagcatgataaatgcctatgtctaccggaacataagatgaatttagctatgcacggacagtagcaaataacaatttaaacacctatggggttaatttcctcttacaaggttatgctagagacttacctcgttcccaagtccatttttcggtccacaattcactctaaaagcctcaagtcggtgccgaacaatctgaaactagctaaaggttgtgcaaactaatcaataattgctcaaaggtttataatttaactattagagtgattactcaacacaattttgaaggttcccaaaattcacctccgaacccacgtgcccggattccgtatatgttcgtaaataaatgttactcataaccttacgaacacaaatatataatttttacccaatctcgtaatcatttacgttgtcaaatctcatttttatcaaaatctaggtttttcaacaaactccaaaaattttcacattattcatgttaagatctactcgtaatctaggtattaaactcacattgtgtagaatacacttacctcaagatgctagataaaaatccctctttcaaaagctccaaaatcggctaataaatgagagaaatgaaaaaaatggcaaaaatcccaatttttattaagtcactgcccaagtctgacctcttagcgatcgcgaaggcaaaagtcacgcacccaggaaaactcccctacactattgcgagaagccactcacaaacacgatgcactgagccgcccactcatgatgaatgtgtgcctgcattcctgaacgcaaaaggaaaaggagtcgcttaggcccaggcccaggccttctacgcgaacgtgatgagtcaccctcgaacaagaaggccactggttctaagcctccgcgaacgcggccctttcttcgcgaacgcgaagagcaaaaacgtccagtacccaaatccttcatcgcaaacgctatgggcctttcgcttttgcgaagaaggaagccagaactagcacaccagtagttttggaattcgctccgggtagtccaaaacacacccatgcccctcgggaccccgtccaaatgtaccaacaagtctataatcataatacggacctgctcacaccctcagaatacataaaacaacatcgaagcacccgaaatccattcccaggctcgaaatcccatacgggcctcgataacaccaaagtctactccaaaccaaatttaaagaactagaaaaccttcaatgaaccaactttaaacattaagcgctgaaatgctcctggatcacccgaaaccctgtccgaacagatgcccaagtctaaaattatcatacaaacatattggaaccataaaatcccggtccctaggtcattttctcaaaatgtggactcaagtcaaacttggccatcatatgccactattaaggaactaagtgttacgattttaacctaaacccttccacacccaaaccaaccatctccgtaagtcatgaaacagtaaaagcacatacgggaagtcttaattaagggaacgagaatctagaaagaaaaagaaccagtcggttcattatattctccacctcttaaaaaaaatgttcgccctcgaatgggtctagaattatacatggagtggtgaataaatgtagatatctgctcagcatatcctcctcggtctcccaaatcgcttcctcaacttgttgacccctccacttgacctttaccggaaaaagtttcttggacctcaactggcgaacctacctttcaacagtagcaactagctcctcctcaaaacccaagctcacatctagctgaaccgtgttgtaatctaacacatatgacatgtcggcatagtacttccagagcatagagacatggaagaccggatgaactcccgatagactggaaagcaaagcaagatactaagcaacctccctaactcgccccaacacctcaaatgggccaatgaaccttgggctcagcttgcccttcttcccgaatctcatgatacccttcatcgacgagactttcaagagaaccttctcgcctgccatacatgataaatcacgagccttctgattttcgcaaattttttgtctggattgtgctgtgcgaagctgcttctgaatcaactttaccttctccaaggcatccttcactaaatcagtgcaatataacctagcctcgccgggctcaaaccacccgatgagcgaactacatcgctgaccatataaatcctcaaatggagccatcagtgctggactaataactattgttataataaaactcgtccaaaagcaagaatcaatcccattaccttgatggtaggctagaaacccatgttttaatcatagtttgcactctaatcactatattttacttgtggttgagcttaattaatggtgatttgcgcttattatatgttttatgtcttgtaggaaatgattccgagctattaagataatttggagctaatttgaacaagttgaagatttgaagtctgagtaaaagcccaagaaattaagttggtatcacgttcgggggtcgagtaacaagtctggatatcaaaaagtgcacgaaagaaattaatctgataaaattacactaccacgctgcatggagtgtcgtgaggcgcggcgcagtagtgcaaagtggcgtgtctaaaaaaatatgctctctgaaaatttacactagcgcgaggcatagcgcaacacattagtgtattttcacggtctactttttccacttcgacttgaaaaggatagtttcatccgggcccattcctatatggtataaatacaccaaaaatacaattttagaggacttttggtcttggaagctttgggagagcattgaaggctacaagacacgagatttcatcatctttccatcaattcaatacaggagtttggattgtaacgattagattgatgctttctcactctttaattatatttgtgatgacttcttccataattatggagtagtttatcttagggttttacattgcagcgtatgccttaatttattttggtgattctttgaagtaatcgagagagatttttgagttaccatttaaattaagattgagaaatattcacgagaagtttctattagatcatttctaccaatagattcttggaagtttcaccacgcttcacattagtttatttaaaagatttagatttaatcgagaaggagtctgaatcgaaagtataagctaatcacctattgaattcgtgagaatcgatagaacctcaagagtgaaatataacagcatcatatttagaataacaatcttgcacctatcatgtcaaaacccttatttctcacattgataagaaacaaattctgctaatctctagttctttgcagtcaattgtcaattgctttactttagtagttaatcatagttcgcaatcattccaatcaagttttgatcatcctgaatagcagttaaactataaattactagagcattgtttaaatccaatccatatggagatgataatcatactatactatctttggctagcgagcatcaattttgtgttgtgttttgagacacactctgagcatatcctgtagaatttgaactttttgctgcgactgcccatcggtctgcgaatgaaaggttgtgatgatctctactcgggtgcccaactcactttgtactgctttccaaaaatgcgaagtgaacagagggcctctatttgtaatgatggaaacatgcacaccatgcaaccggacaatctcctgaatgtaaatctgggccaatctctctaaagaatacgtagtcacaactggaataaagtgtgtcaccttggttagcctattgacaatgacccaaatggcatcaaacttccttaacatccgcggaaacccaactataaagtgcatagtgatccgctcccatttccattccggtataaccatttgctggagtaggccacttggcctctggtgctcatacttaacctactggcaatttagatacctcgctacatactcaacaatgtccttcttcatccgccgccaccaataatgctgcctcaagtcgcgatacatcttcataggaccaagatgaatagaataccgagaactatgtgcctcctctagaatcttctccctcaatccatcaacattaggaacacataagcgaccttggagtcacagaacgccatccttgccaatagtaacctccttggcaccaccccgtagtaccatctctctaagaaccaaaatgtgcagatcatcatactgacgagccttgatccgctcaaataatgaagactgagacaaaacacatgcaagaactcgactgggctctaaaatatccaacctcataagtcttttagctaaggactgaatgtccaaagccaatggcctttactctgctgaagtaaatgcaaaactacccatactctcggcctttctgctcaagtcacccgcaaccacatttgccttgcactggtggtaaaggatggtgatatcatagtcctttagtaacgcaagccacctgcacggcctcaagttaagatccctatgcttaaacaaatgatgcaagctacgatgatcggtattgacttcacaggacaccccataaagataatgcctcgtgatcatgagaacgtgaactatcgcggccaactccaaataatgtacggggtaataattctcgtggggcttcggctgacgtgaagcgtatgcaataactcgcccctcctacatcaatacacaacccagtccaatgcgtgaagcatcgcaatacacaatatacatccctgaactagaaggcagtactaacacaggtgatgtagtcaatgctatattgagcttttgaaagctcaccttgcaatcatcggaccataggaacagagcacctttctgggtcaatctagtcaacggtgctgcaatagatgagaagtcatccacaaaccaacgataataacttggtaaccccaagaaactcttgatctcgattactgctcatgcttctccacactacgcaagtagatcaatatgtcatcaatgaagacaatgacgaatgagtgaagatatggcctgatcacccagttcatcaaatccataaatgtcgctagggcattggtcaaaccgaaagacatcactagaaactcatagtggtcatacctagtccggaaaggggtcttcggaacatccgaagcatgaatcttcagccgatgatacccagatctcaagtcgatcttagagaacaccctagcaccctgcaactggtaagacaaatcatcaatacggggcaacatgtacttgttcttaatgataattttattcaactagcagtaatcaattcacatcggcatactcccatcctttattttcataaataacaccagtgcaccccaaggcgacacatttggctttgatgaacccccttgctagcaactcctcaagctgctcctttaactatttcaactcttttgaagccatgtagtacggtgaaatagacataggttaggtacccgatgccaaatcaatactgaaatcaatatcacgatgtggtggcatgcctggtaaaacagaagggaacacatcggagaactcccgtaccacgggtggtgcgggcactgaatcgatcgtaggagtctctgcagtagtatctcgaacataagctagataagccaaacaacccttcttgaccatgtgtcgagcctttaggagagagataacccgactagatgcactgatagatgaacccctcgactccaatctaggcaactctagcattgccaaggtaacagtattggcatggcaataaagaatgtcatgatatagagacaatcaatccatgaccaggatgacctcaaagtcagtcatatcgagcagcaggagatccattatggtctcataaccacagaaagttacaatacaggaacggaagactcgatccacaataacataatcgcccatgtgcgtggacacatatacaggagcacccaaggtctcacgagagacatccaaataatgatcaaatagagaagaaacatatgaatatgtagaccctagattgaataatactaaagcatccctactgtcacgccccgacctcggggagtgcgatcggtgctcaaccgagataccccggtcaagcaagcctgctagatgccttctacccaacctttcccattaaaaatataagaatcagtcaccagaaatatacatgagaggagtcaagtgcttccattcttttccattaatcaaggagattcatttacgacttccaaaatattacaagtttatatatatgatgaaaaatatgttttccacataccaacacttctagttcattacccaacatcaaacactacccacaacctgtctacggagcctctagatacaacagaagagtagtatggaagtgccggcaacaaggccccagttatacctcaaaggcaatgtacaacatcaaatgacatcaggccgggaatagagtagcgctcaccaaaacctgctgaaaagggagtaactgctaacgaggatcaaagttgcctgctactgaaccacctgcatccattgaagatgcatcgctcccgacaaaagggacattagtacacatggaatagtactagtatgtaaagctaactgtcctttttaaaaatagaatgccaatgtaagaaagggaacaccatggaaacaacaattaacaatcagtgatatccaaatgccaagttaaaacatactaatttccaaaatacgaagataatattatttttggttgggagatctttagcaccgatataccactgttcacaataccactgcacttttagcatggagtttgatcacggcccgatcggctaggccgtctcatccgagacatcaaccacaatcacattctcgatcacaatttcaattataatttccaacacaatcaccaccatgtgtgcggcatggcgtccgatcacgacccgatcagctaggccatctcaccacaatgcggtgtggatcgacatcaccctattctagcaatcatctcataccaaataaggggaataatatcatcacatcaatctcatcccaattaaggggaataatttcatcacatcaatcccataccaattaaggggaataattttatcatatcaatacggggatttaccccttaatcactcatataccggtacttgtagtttcagggttaggttgttacctatccttcctcggtgactaacgatactcctaaaaatatttttgatttgcatacaaagaaaacaacaatacaaatgcatttacatcataacatttcataccgtatatagcctcattggtacttccaaccacttacaatatcattatttcattggctctcttgaccatacatataattcttctttcatggaacaatggatgtatttcatattccacactttcatttctttcctttcttgcatcatcatcataaatatcaacaaatagaatattccagaaattacaactttaagttcgttagaaatgaagaatttaagcacaatagatttctttaaaagaaatggagtaaaatgattggcgatcgatgcgcaagtaaaaatcataaacaagtagtacatcatttattcttgaaatacttttccccaaacagggcaatacaaaattttcactcacaaatatgtaagaacgcaaaacacattgaaaatactcacaaagcatagcattagttaaaacaatcacatatgggcatgacttgagtacataagcttttaggcaattttatttttgaaataattttggtacagttgaatcaaggctcatttcataacctttcacacatcatttcatttccttggcaccattggccacaagtataactttcattatcggcacagtggccacactttacattttcaactcacttctttcacattccagcatctttataacttatcaacaacaaggcatttcaaatcaagactttaggtacgcatatgagcaattaagagtcttaagtacatcgaatttttctcccacaatttggcatcataactatcctttgaaatgcaactcaaagccataccattttaatacacatatcattcttggacacattctcgaaggataacataatgtgataattggaacacaattttgaatacatacatctttcgatactttgcttactcgggataatcgaatttattaggaacaactcggaacatgggaattaggaacttgagccagccatacttgaaacttacgggaacattttggtattcgattctaagagagtagtttagccaacatacctcctttgagttttccttagattactacaatgtcccaaaaatcctagcaacttcaatctattttgagacatgacaaaattgaacacagattaggaagatattcttggtttcaactcatttgagcattttatctaacattaggtgtgcaaattttactacaaggttcttctaaaagattttcttcactccacaacccaatcgttacccatttgagctcaacaatcttccacaaatcttattggtacattcatgtataaataatacttcacacccaagaatcatatccctaatcaaccatcttctacccaaattcgaaattgaaaagtagggtttggaaccttaccttttagatgaagaacttgagggatttcttgttggatttcaaggcttgagcaagatttgatgaataagggcttaggaatttctcctcccactctcgggaactttcccctctctaaaaatatcagattaaccatccaaaatgaccctaagatcgttttataggaactagggtcgggttatgaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacggaccctccaaaatacgaaccgggctacaaaccaggctaggcacgctctgtagcgagctacagaccaagtttttacgaggcttcttgagggatataacacggtctagcgcgctacagacctcgcttcgcgagggttatagcacggtctagcacgctacagacctggcttcgcggcggttatagcacggtctaacgcgctacagacctagcttcgcgtgggttatagcacggtctagcgtgctacagacctggattcatgaggattatagcacggtctggcgcgataagagctggtggcgcgaggtcaaaatgattcaactcccctaacacattgtttaacccaaaaagttcgaaaatacaataaattagcctaccttggcaccacggaaccttaaattccttagcgaaatttttaggggccttacattctcccctgctaaggatcattcgttctcgaatggggagtagagtccgtcctcaaacacttaacataaatcatttcttcttccacacatcttaagctcccaaatttgagtaactcccaaatttttcagaaatttcgtcagagtctcctctgcaattgggccttaccatctgccagaaaatcaccataaccaccctatcaacacatccacaactcgacaaagaaatacaatgtatatcaataacactaatctcaacattacaggcattatattattaagagtgatatctggacatgtgctgcacatatttaaatcataacacatagaaagtatctttcgattcacaatcatttgactatacaatagagtgagaacattttttttccttaacactttcggccttcgaggtggcctcctcgactcatagacttcgccataatactcgactgaggctatcccaacttccggacttatttaacaaggatgacaattaagtacctctcgtaggccaattatccaataacttcacctttactaggttccaccgaaatgatagacaaaggattttcaactaccttcttagacatagacacatgaaacgccgggtacatgaaggacaatgatggggaattatcatactcatagttcggcatatttccttcaagattttataaggcccaatgtgacttcacatactttacctttattagcaattcacataacatcctcatggagaaaatatttagaataattagttcactttcttcaactctaaatctctacgccgaacacccaaactaaacctttggcgacctccaacaattactctaagatgtgatggcttgaatataaccataaaacttcttatccaatatatttgatcacgagattatgcttcttttttgacatgtttgaaccttcaacccccgtaggtttactataaataggaacaacgagatttgatattgggttggaattattcaagatccatcaatgtgctgagcagggtatttcgggaggttatatcctagagacataaaggttactatcgatagcgctgacatggttattcgttgtgatgacatcattaattcgacacatgaggcataaagtttcctagtagacgttgataaagtgggaaccatgtgcatgatcttaagatgtaaaagaagtgagtcattgtagacatgtgatatatgggaggcattatcgggaggataaagacattagcatcagttattcttggaagactatgagttatgaaaagtacaacaacaattgtttcattccctatgtgccttgttcggcaatagtaagccttaagaagaaataaccaagtacgtgacaccaattgccttcgtgagtgtaaggaaaattggtttaactcaaattagaatattctagcaccttgaatgtgatatgggtttcaaaatacatgaagttgcattatgctcctaacagtaactagcacaaggaatctatgccacaagcccatgatgttgaaaaggaagttgaacacttgcgagattattatcgttctaacaacttaacccttcataatagttgatcctatatgagaggaccagagatacggcaaaattttctttcaaatcaatatactcatgctatgtgctagaatcctaaacatccacctgaggttaggagggaaaggtcgcggtaaggttacttaactttcaaccatacacgagtgaaaccatgtagctaggacatcttaacagtggggtgaaatcatgtattggttagagagaatgaacactttgctatgagctagacatgtttttgccataataactctcaagctataataccaggcactatcatgggcaattacaatacaaggaacaaactgagttactcactaaggcatgatctaggtggacatgaaagtcatactgagatgggcgaacaaaaagatctttctgtgacgaatttatgaaaatctcaaatttcccagaaactttatacggacaagtgacccctttcaattgacatgtatacatatgataggtgctaagatattctctcatgctactagacagcaaaaaggattcatgataatattcacaaagtagtaaagtgattgttccaaccataggagccaaatacaccggagataaaaagagtggctcaagaaggatctcaacactaggccgctatacattggatttgataccacataggtaaactttatgactgtgcatgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagcagatattacccatttgaatcaaaatgttctgtaagaaattcatcaggtatagtcccttgtcgagaatttaggaaagcaagtgggaagtattaatcctagagttataactcaattcaaggacagaattatagaactcaattcctcaagaggtcgtaaataagagaattgtgatcaataggcttcacgaatattgcgtctcattcaaagagtaggtacatgcaatgttttgtgattcaacgatttggttaagaccatatctatgtaggcccctttaatatggatgtacatatacaacaaataaaataatgtggtgttcacaatgaggtagaaatgagtgatttacttggtgattttagattgatagggaagtaccttaactgatgccccttgactccacatccgtaacatacattggtaccatagtgacatacccctcaatgaaatcttttacacttcacacaatgaggatgaggtctgttaaactaactcgcaccaccgacctgatatttaccctttttgcatacatcaaaaattttcccctatccttcctccagaacccctatgacgggactaacaatctctatatcggttttctgtgtggggctttggaattcctcaagcctaccacccctaacacggcaaaaatatttctttcccgcatatcgggtagaccgggctaggtgtacccaacctagtgaatttgttcttcttgtgccccctgtttccaaaaccataacatatttcaatagtgaccaaacataaactcaagtggtggttcttacaaatcaaacaatccggcttattagagccgacaatcctctttcgtttcttaggttccctcaccacatgatctggtggcgcagtgacattaatatgaacaaggacgcttcccctagtaactagttctttcatttgctcctcgttgcctcgaactcatgggttactcatctggaaaatgagacatgacgaggaaattaacttcttattttgagcattaccgcacaatctggaatactaaataagggtgacattcctaaatgcccatatagcctcctaattatagatgtggtcgataacacaccgataagaaggattctactagacacggctctgagatatcctaggacactttaaaaccttaggctttgatactaagtttgtcacacctcgacctcggggagcgtgaccagcgctcaaccgagataccccgatcgagtaagtctaatagatgccttctacccaaccttgcccattaaaaatataagaatcagtcaccagaaatatatatgagaggagtcaagtgctcccattcttttccattaatcaaggagattcatttacgacttccaaaatattactagtttatagatatgatgaaaaatatgtttgccacataccaacacttctagttcattacccaatatcaaacaccacccacaacctatctacggagcatatagtacaatagaagagtagtatggaagtgccggcaacaaggccccgactatacctcaaacacaatatacaacattaaatgacatcacgcccggaatagagtagggctcaccaaaacctgctaaagggagtaactactgacgaggaccaacattgcccgctgatgaaccacctgcatccattgaagatgcagcgccccggcaaaagggacgttagtacatatggaatagtactagtatgtaaagctaactgtcatctttcaaaatagaatgacaatgtaagaaagggaaaaccatggaaacaacaatcaataatcaatgatatccaaatgccaagttaaaacatactaatttccaaaataaaaagataatattatttttggttgggagatctttagcatcgatataccactattcacaataccatcgtacttttagcacagagtccaatcaagacccgatcgggtaggccgtctcatctgagacatcaaccacagtaacaatcttgatcacaatttcaattataatttctagcacaatcacaaccatgtgtgcggcatagcgtccgatcatgacccgatcggctaagccgtctcaccacaatacggtgtggattgacatcacccttttatagcaatcatctcatcccaaataaggggaataatttcatcacataaatcttatcccaattaaggggaataatttaatcacatcaatctcatcccatttaaggggaataatttcatcagatcaatacgggaatttacccctcaatcactcctacaccggcatgtgtagtttcggggttaggttgttacctacccttcctcggtgactaactatactgcaaaaaatatttttgatttgcgtacataggaaacaacaatactaatgcataccttataacttttcataccgtatatagcctcattggtactttcaaccacttacaatataattatttcattggctctcttggccatacatataattcttctttcatggaacaattgccgtatttcatattccacactttcatttctttcctttcctcatcatcataaatatcaacaaatagaatattccggaaatcataactttaagttcatcataaatgaacttagtatgatttcttttataatgaacttaaagttatgattaatggagtaaaatgattggcgattgatgcgcaagttaaaatcataaagaagtgacgcaccatttattcttcagatacattttcccaaaaagggcaatgcacaatttccattcacaaatatgtaagaacgcaaaacacattgaaaatactcacaaagcatagcattagttacaacagccacatatgggcatgacttgagtacaaaagcttttaggcaattctatttttgaattaattttggaacagttgaatcaaggctcatttcataacctttcacacatcatttcatttccttggcaccactggccacaagtataactttcattattggcacggtggccacactttacatgttcaacccacttctttcactttccagcatctttatagattatcaacaacaaggcatttcaaatcaagactttaggtacacatatgagcaattaagagttttaagtacatcgagtttttctcccacaatttggcatcataactttcattcgaaacgcgactcaaagccataacattttaatacacatatcattcttgtacacattcccgaaggataacataatgtgataattggaacatattttgaatacatacattcccgaagatgttcagtatttattattcaaaatgcagtatctatttacttcgggaatagcgcgctatattttgaatacatacatctgaagtctgtggacgctggcagatataccttgaagtctccatgtacagtccaactcactagtatttggcatggtaggaaaaacctggatctgcacaaaacgatgtgcagagtgtagtatgagtacaccacaacagtacctcgtaagtgccaagcctaaccttggtagagtagtgacgagtttagcgtatcatctatatatacataaaaaacaattcaaaccttatatataagtgtaacatttgcccctagttgggggtggtcatcagaaagagcttaattttcggaatcaagtctcctgctaacatatattataaagcattagatcgagaatgaagcttgatgacaagaactcagatctaaattttgattataacggtataaaattagacgttatataaaattagaaacgctatcaaaatgcaaaataaaataaataaataaaatgcaaaattcgctgcatcgaagaacattgtacgtcattgcattatcatattgagaagttgctcctttttagttgtaataattaaatcaaatacaaatatttttataagaatgcagagatattaatcaacttcacatgacacaaagttatatgataatattaccttattgaaaaagtaattgcatctcttcatttggggtcattcagagttttttagacgagttcgacataagtttgggatttgaaaatatggattagtttcttaagctcaaattgaggtgtgattcatggttttgatgttattttatgttatttgagacctcgagtaggtccgcgttatgttttaggactttttggtgtaattggaccaggtcccaaggtgctcgaatgagtttcgaatgagcttcggattatcttggccttagttggcattcctgttattatatttccgcacctgcgaggtcaagtccgcaggtgcgagtccacagacgcggatgcctatttgaagatgcagacctgggggggcgcatcttggttctcagatgcaagttaggtaagcgccctactggttaaaagaaaagtaaggcagaagatataataatatttgaaatgactgagaatttaaataacgagaagcttcagaaattaatagcacagcaaaatagaggtaaacaacaggggcgctctcgaggtaccacctcgtagtcccaaatgtaaatatgcaacacaggggggacctcctgaggaaccgcctcatattcccaaagtaaatatgcagtgcatgggatctcctgagaaacctcctcgtagtcccaatgtaacaccccggaaaaattagaagtacttaagtgctattaagaaagtcgatgtgtgctaattatattattatgtgtaaagacgaggactattaataggatggatatcaattgaatatgataataaatgtaccaggcatattataagtgatgtgggggctaaggagagccctaagtccaagtcaagttggaaatttctggatagactaaagttccaaatgagtacgcacaagaccaaactttggacgagaataactacatatttataaggagttatgtggtgaatgacctattaaattaaatttatttgactctagtttctaatgctaaaaaccgttaatcatttggacattcctacaagaggttatgaccaaattaccaaaggctggcggaggagtctgcggatgcgaatcatccgaggccgcatccgaaagacaagctagcagtgaagtgcttccatagcattatggtccgcatcggagattcaaagaggagtgaagtggggatgcgaagcatccagggtagcatccaaaacccagaaatctgggcctattaatacaatacaatttcggggttcatttttcccatttcatttgaacgtattttggagctcttctccactctctctcaagaccaccaactcccctattattcaaggtaatcaatccacattatgttggtgtgaaattccataatttctacactagtattgataattcttctcataaaatacttagatcttcaagaaatttcttcaagaactcaaagaagggttttgcaagatttcttccaaaatgtaatcctacacccttagacttacatgtatggatatattatgtgaatatgagtatgaattaagtattggaacttatgatatggtgattaaaaaccataagtatccaatttaaatacataaccattgtagagattgaaagttgattatttgatggaattttgttggttaggtgtggatgatgaattgtgtaaaaatgatggtaggatatattgttggtaaatggtagtagttggatgaactaattctatggttaagagatgtagagattcatgcctattatgtgtttgataaagtgcctaaatggcctaaattatggaatttgttactaataatggtcccattggatgttgttattgtagattaaagttgcttagtattgtggattgttgtagtatcattaagggacgaatttaaggtatgttggctaaacttctatcttagaattgagtcccacgatgttcttgtaagtctcgagttattcattataaattacctattccaaataagttttgtgttgaaaggtatatgttcaaaatgtattctgggtgctcttatcataggatgttatccttcgggaatgcgttcaaagcatgagttgggtattaaaatgttatgacttcaagtcgtgtttcaagtcaaggctaatatgccagattgtgtaagaaatctcaaggtgcttaagactcttaattgttcatatgtgtactaaatatcgtgattagagattttttgttgtcgataatctataaagatacttgaaagtgaaagtagtgagtagtggatataaagtgtagacagcgtactaagaatgaaagttatacttatggccaatagcaccaataaaatgaaatgatgtgtgaaagattatgaaatgagccttggttcaactattccaaattgactccgaaaatagcattgtccaaaagcttatgtgctcaagtcatgtccaaatgtggttgttctaactaatgctatgcttcgtaggtatttccaatatgttgtgagttattacatattcatgagttgaaattatgtattgccctttttggggagaggtacttgaagagtattctataggatgatgattatgatgataatccttgaaagaaaaaaaattaagtgtagaatatgatatacggccacagtgccatgaatgaaaaataatatgtatggcaaagggagccaatgaaataatgatgtgtaagtagttgaaaatactaatgaagtgatatatgatgtgaaaaggttatgagatgaacatattcgtatttttgtttccaatgtgctgtaagctccaacgccctcatgaggagaggctaaggtgttcctaaatatttcaaatgttcttgatgtcctgtgatcacccatggcaagtacaagtaagtgatagtataaacatgaaatgtggccgttttccaaaatgagaattatgaggtgttatatgtcccaatggcttcaatcatagtatgtatgcttctaaaataattaatgtaaatgacttcgatgttaagtccccaagaatcatgaacatatctaatggaattaagatgacaagggagtatataatgaggtggaagagggatgtcctatgctaagtgacgataaatgttatggaaaacgtatatgggccatgtgccattgaaattgacttattgattttaccatacatgtgctaatataatgaggtgtatttctccatgatgagcatgaatatgaacatgaagtgttccaatgatccgggaacttacgacctcaaaagtagcgttattcatgtagctttgggtttttatatatggtcatgtgcataatgatcctctatttttacgcaattatgttatacccccattggggagaaagttttgtacggattcaatgtgatcaaattctaattcacatatgacaaaatcttatgaacttatattattgttaagatcaaaggtgccaaaggatatgatttgaaaggaaatcttttgtactaactattatcgtttgagaatccaaattgtgatattgtggttacacctccacccgcatatattggggtgaggcggcagagccaattttgtagggattgtagtattatgatacacctccacccacatatattggggtgaggcggtagggccgctttgtgtaaggattatgatattgtgatacacttccacccacatatattggggtgaggtggtaggactactttgtgtaaagattatggtattgtgatacacttccaccagcatatattggggtgaggtgataaggccgctttgtgtagagattatggtattgtgatacacttccatccacccgcatatattggggtgaggcggtagggccgctttgtgtagagattgtggtattgtgacacacctccacctgcatatattggggtgaggcggtcggccgctttgtgtagatattgtggtatcgtgatacacctacacccgcatatgttggggtgaggcggcatggctgctttgtgtgaaggtagttatagtggatccccgacttaatatctatatttttaatggaagctcttaataaattttcttgatgttaacggctatctaagcccttttactattaccatgattcatcatattcatgttgtatttccaagcccttgaataggcgtgtttgtattgtgtaagtaaacattgtgaacggtctatgaaacacacaggtttattgtataggtgatactgtgaacggtctatgaaacacacatatgtattgtataggtgatactataaacggtctatgagatgcataggtgtataatatgatatgtgaacactaaggacggtctatgaaatgtatatgtgtaaaataagggaggaggtgccactttcattggccttgtttgtacatgttgttacaattacattatattatgtattccacgtatagtgcatatggctcagttgatcctaaaagaaatttacaatgatgcaagtataataagacttgaaatgtgattatatgggctgtttcatagtttcttgatgtactttatttgcctcttatttgagttaccatattttcatatgttgttttgactgccttacatacaagtactattccacatgtactcatgtcccttttgccgggggcgctgcatcttttaatggatgcatgcatacttctacaggatgatatggatctttgatagggattttcttcactgctcagcttatggtgagcccgctacagttctagtgggtgtttgggtctagttcattttatgtatttaggtatctattgtcatagaagctccatgtacagtgtgggtcatgtaattaaagatttgagttttgtcatgtatttatgttcacattatttacagttatttataaagctatgtaaccatcatgagaaagaaattatggaccactgagtcaaatgtattcaatatgaaagttaaaatctaattatgttatggtaaatcatgcatgagtaatgatgagaggttaatgtaaattaggtttgctcaactgggtttactcggttgagcgccggtcgcgctccctgagttcggggcatgacacccaaagtaaatatgcagtacagggggatctcccgagtaactacctcgtaatcccaaagtaaatatgaagtacaaggggatctcccgagcaatcgcctcgtagtcccaaagtaaatatacagtatagaggggtatcccagggaatcgcctcgtagtcccagagtaaatatgcagtacatggggatctcccgaggaaccgcctcgtagtcccaaaattaatatgcagtacaaggggatctcccaaggtatcacctcgtagtcccaaagtaaatatgcagcagataaccgaaccgaaggaacaaagaatttacagcaagacatcttacagttacagatttaattcaaatgaggggaagcaggtaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaggcatgtatacatgtgatactaggctaaacatgatcactacatatgctaaggtaattcagttaaggaatttaaaagaagacaactcaacgagaaccgaaatttccacattagcccgtgtatgcactcgtcacctcacgtacaggtgctcacatattacaaattgtcacaacaatatcaaatcctaaggggatttcccccacacaaggttacacaagtcacttacctcaaatctcgctcaatcagtcaagtagtatgcatttccctcgattttccaactttgatcagctcgaatctagccaaaacaatttcatactataaatataactacaaggaactaatttaaaatttgaaactacgaatttagcaaaaattgaaaattcggcccaaaaggtcgacccgggcccacgtctcggaatcggataaaaaccacaaattatgaacacccatttgacaatgagtccaaccatactagtttcactcaaatccgactctaaatcgacattcaaatctcaaaaattcattgtatgaagtttctacaatttttcccaaatttccatctcaaaatactaattaaatgatgaatataatgatatattcgtgtatattaaccaaatccgagttagaatcacttaccgatgtgactttcttgaagaaatccacgaacaatcgccacaaaccgagctcctaaactccaaatgtgaaataatactttaaacatcgttaatatagtacaaaattagatctcccattgtgctggccaatttttgttttgttgcggtccgcacatttaaggtctctgcggccgcaacccaaattgtgcagtcgcagttcagcagcatttgcactaccatgctttagtaaattgaccataactttttgtacaaatgtccaaataataaatagtttacttttctgaaaactatactcaaaggtctacaactcttttttggatcacctccaaattccttttagatcaaagatataagcttccgaagtcagaccatcgaacctatagattctcctttctgcaaccgcaagaggatttctgcagcctcaagaggatttctgcagtccgcaattttcctctgtagaccacaattttcctccaaggtccacaattatcctctaaggcccgcatatgaggctttgcctcagcactccaaaatgtgcccccgcactccaactgttcccagagcatcaccagagtgccgaaattcccaaactcgttcaaaacgcaccctgaaacacacccgaggcccccgggacctcaaccaaatacaccaacaagtcctaaaacatcgtacaaacttagtcgagcccttaaatcacatcaaacaacactaaaaatacaaattgcgcatcgattcaagcctaataaaccttaaacttcaaacctctacatccgacgccgaaatctatcaaatcaagtccgattgacctcaaattttgcacacaagtcataattgatattacggaccaacttcaacttacggaatcagaatccaaccccgatatcaaaaagtccacttccgatcaaactttctaaaattcatcaaatttccaactttcgccaattgacgctaaaatgacctacggatctccaattcaacattcgaacacgctcccaagaccaaaataccactacggatctattgaaatcgtcaaaactccattccgaggccgtcttcatatacttcaaactacggtcaatatttagaacttaaacttccattttagggattatgtgttccttttcactccgaaaccaaaaacaactcctccccgcaagttacgtaaccacaaaatgaagtagagggagaagtaaataggggttcagggctaatactttcaaaatgaccggccgggtcttacaacctccccctcttaaaacaaacgtttgtcctcgaacgagtatagagacataccttaactggtgaaaaaatgaggataacggctgcgcatatcatgctcggcctcccaagtcgcctcctcgatcggatgacccctgcactgcaccttcactgatgcgatgttctttaacctcagctttcggtcctgcatgccccaaaaggccactggctcctcaacataagatagatccttgcccaactggactgagctaaagtttaacacatgagacggatcgtcgtgatacttccggagcatggaaacatgaaacactggatgaactgcagagagaatagtttgtagtgcaagtctgtaagccacctctccaacactctcaagaatctcaaaaggctcgatatacctagggctcagcttgcccttctttccgaacctcataacaccctccgtgggtgaaatgcggagcaagacccgctccccaaccatgaatgcaatgtcatgaaccttccaatttgcataactcttcttcctggactgggctgtacgaagtcgatcctaaatcaatttaaccttttccaaggcatcctgaatcaaatatgtacctagtagtctagcctcacccggctcaaacgaacccactggagaccggcaccgtctaccatacaaacctcatacagtgcaatctgaatgctcgactgataactgttgttgtcggcaaactccgcaagtggcaagaactgatcccaggcaccaccaaatcaatcacacacgcacgaagcctatcttcaaatatctgaatagtgcgctcagactatccgtctttctgagggtgaaatgttgtactcaactccacatgagtaatttcacagtgcacggctctccagaaccatgatgtaaactatgtaccccgatcaaagatgatatataccggtacgccatgaagtctaacaatcttacgaatgtaaacttaagccagatgctttgaagaataggtaataaccataagaatgaaatgagctgacttggttaacctatccacaatcacccaaactgcatcgaactttctctaagtctgtgggatcccaacaacgaaatccatagtgatccgttcctacttccattttggaatctccaacttctgaccggttgctgatgctcaaacttcacctgctgacaatttaggctacgagctacatatcccaccatgtccttcttcatctgcctccactaatagtgcttcctcaagtcctgatacatctttggggcacctgggtgaatggagtaacgcaaattgtgagcctcttgaagaatcgactaacgcaaaccagctacattgggcacacatagcctgcccaatatccgtaatacaccgtcatctccaatagttacttccttggcatcattgtgttgaaccgtgtccttaaggacaaacagatgggagtcatcatactgacgatctctgatacgatcataaatagaagactaagaaaccacacaagccaaaactctgctcggctcggaaatatccaatctgacaaactagttggccaaggcctgaacatccaaggctaaagtcctctctgctactggtagatatgctaaacttcccaaactctccgccttgcgactcagcgcatcggccaccacattggccttcccgggatgatagagaatggtgatctcataatccttaagcagctccaatcatctccgatgccgcaagttaagatccttctgtttaaacaaatgttgtagactccggtaatcagtgaaaacctcacaaggaacaccatacaaatagtgccaccagatcttcaagacatgaacaatagccgctaactcgaggtcgtggataggatagttcttctcgttcaccttcagttgtctggatgcgtaggcaatcaccctaccatcctgcattaacaccacaccgagaccaatgtgcaacgcatcataataaaccatatagaaccccgaaccagtaggcaacaccaacactggagttgtagtcaaagtagtcttgagcttttgaaagctctcctcacaatccttggtccacctgaacggagcacccttcaggctcaacctagtcataggtgttgcaatagacgagaaaccctctaaaaatcggcggcagtaccccgccaaaccaagaaaactctggatctccgtagctgaggatggtctagaccaactctgcactgcttcaatcttctccgcgtctaccttgctcctctcattcgatactacattacccaaaaattccactgaatctagccagaattcacacttcgaaaattttgcatataacttcttctctctcaaggcctgaagcacagtacccgggtgctactcatgatccttctgactctgggagtacaccagaatatcgtcaataaacacaatgatgaaggagtcaagataaggctgaaatacactgtttatcaagtgcatgaatattgctagggcgttggtcagcccaaaagacatcacaaggaacttctaatgactataccgagtcctgaaagcactcttcgagatatctggctcccaaatcttcaactaatgatggactgaatgcaagtcgatcttagggaacactctgtcaccttgaagctgatcaaataggtcatcaatacatggcaatggatacttgttcttcattgtaatcttgttcaactagcgataatcaatacacatttgaatagaaccatgcttattcattacaaacaagacacgagcaccccaaggtgacacactgggtcgaatgaagcccttattgagcaactcttgcaactattcctttaactcctttaactctgttggggtcatacgataaggtggaatagaaatgggctgagtgcccggtaacaaatcaatgccaaagtcaatatctctgtcaggcggcatgcccggaagatctgctggaaatatgtctgcaaactccctcactaccggaactgacttgacggtaggagtatcaacactaacatctctcaaaggccagatatgcatcacaacccttctcaacctttcgttgagccttaataaatgagacaaccctgctaagaacatgatctaaggtacctatccactctagccatggtagacctggcatagccaacatcaccgtcttagattgataattgaggatagcaatatagggagacaactagtccatgccaaaaataatatcgaaatccaccatacggagcaataataaattggttcggtctcaaaaccaataagaacagtcaaatacgactgatacacattgttaacaataatagaatcgcccataggtgtagacacatagatatgtgaactcatagaatcacgggatacacccaaatatgaagtacaataagatgacacgtagtaataagtggatcctggatcgaataagacatttgcatgtctatgacagaccggaacagtacctgtgataacagaatctgatgcaactgcgtccgtcttagaaggaagggaatcatatctggcctagcctccccctctagggcgaccgctacctgtctgacctctacctctagctggctgtgcaggtggggtggtagttggtgttgtaaccatagcctcaggacctagtggagcacgcggtgcctgagaaatctatggaggtgcaaccctcctgaatttagggcaataccttaccacatgacaagtgttgccacactcaaagtaagctatcggagggcgtgactgctatgactggctcgggcctgatcgactggactgatcactgaaagcatcccgtacaagagacacactagacactggcagtgcatagtaaggactggggcccagtagtggtcggagcaccgctggcgactggaagtgctgaatgaacagggtggcccatataacccctgccccaacgagctaccgctggggcatgagtaccactataagccagactttcgagaccttttggcctctctcttgtctctatcccgagtaagcataccctctaacctcctagcaatccctattacctgctggtacgcaatatccatctctaactctcgggccatgctcaatctcatactgggtctgagcccctcaaaaaatcgatgaacccgctctcgaacagtaacaaacaaggccggtgcatgcctagccaaatcactaaatcggaccgcatactctaacacggtcatagaaccctgacgaaactgctcaaactctacacaccaagaatatctgagactctggggaacatacttcctcaaaaacctatctgagaatgagtccaagtgagtgaagctgcctcagccagactatccaactcatatgcgcgccactactaatagaccgttcctccaagctggaatgtagtgaaagaaaccccactagtctccgcaacacccatagtatggaggatacggtggcactcttcaagagaaccatgggcatcttctgacgccaagccactgaaagtaagagagtggtacttcttatacctctcgggtctgagctgctccacctcaaaaactactgccctaacctcgggctgaactggggctaccggctacatcggtatgatctctagaacctagtcggcctgaacccgctgctctggggtacccgtctatgctcttcccctggcctgagatgtggcaagagaaagcggtatcaatcttgcttgatccaaggtgctgaacatgcttagaaattggctactgtctcctggagggctggtgtagtaacaggcgtctcaggttcctgcccttcaacttgagctactggtggctcctttgtcgcagttcgtgcaggtgctctgcctgcaccacgtagacgtcctctgcccctaccccgaccttggtatctcacgactctagcagggggcatgggtgtctggtcatccgatctagttgtacgtgttctcaccatctatgagagaatagaaagacaaaaatttagagtccgaagacaaaatctcgcacgataaggaatcaaagaagtgaagctttttcctaatagttctgtagcctccagaagataagtacagacgtctcggtaccgatctgcgagactctactaaacctgcttgtgactcataacacctataaacctagtgttttaataccaatttgtcacgacccatttttttttctacaggatgtcgtgatgacacttagtctctacgactaggtaagcctacaatttgcgaaataactaaataacaataggaactcaaatcctaacacatgatctataaatagaaactacattttaaataattgcaactcccaaaacccgatagaaataagtcacaagcttctaagagaaaatactaagtgtttctatacatcaacatgatataccgacagatataccttgaagtctgcggataaggatagagggggactccgaggtctgcgtacgctggcagatataccttgaagtctccacgtacattccagctcactagtatctggcctggtaagaaaaacctgggtctacacaaaaagatgtgcagagtgtagtatgagtacaccacaactatacctagtaagtgccaagcctaacctcggtagagtagtaacgaggtcaggtcagggccctactggtttaaaagaaaagtaagctagaagatataataatatttgaaatgactgagaatttaaataacgagaagcttcagaaaataatagcacagcaaaatagaggtaaataacaggggcactcctgagataccgcctcgtggtccaaaatgtatatatgcaagacaggggggatctccggagaaaccgcctcgtagtcccaaagtaaatatgcagtatagggggatctcccgaggaaccgcctcgtagtcccaaagtaaatatgcattacataggcatctcccgaggaaccgcctcatagtgccaaagtaaaaacacagtacagggggatctcctaaggaatttcctcgtagccccaaaataaaatgcaatacagggggatctcttgaggaatcgcctcgtagtcccaaagtaaatatgcagtacagggggatctcctgaggaaccacctcgtagtcccaaagttaatatgcagtacaaggggatctcccaaggaatcgcctcgtagtcccaatgtaaatatgcagcagataaccgaaccgaaggaacaaagaatttacagcaagacatcttacagttacagatttaattcaaatgaggggaagcaggtaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaggcacgtagacatacgatactaggctaaacatgatcactacatatgctaaggtaactcagttaaggaatttaaaagaagataactcagcgaggaccagaatttccacattatcccgagtacgcactcgtcacctcgtgtacacgatgctcacatattacaaattgtcacaagagtaccaaatcctaaggggattcccccccccacacacacacacaaggttagacaagtcaattacctcaaatctcgctcaatcagtcaagtagtatgcctttccctcgatttttcaactctgatcggctcgaatcaagttaaaattattttatactataaatataagtgcagggaactaatttaaataatgaaactacgaatttagcaaagaatcaaaaatttggtccaaaatgtcgattggggctcatgtctcggaatcgggtaaaagtcacaaataacgaacacccattcgcccacgaaacaaaccatactagtttcactcaaatccgactctgaatcgatattcaaatctcaaaaatttgttttatgaaatttctacaattttccccaaatttgcatctcaaaatactaattaaatgaagaaaacaatgatatattcgtgtatattaaccctatccgagttagaatcacttacccccgatgaatttcttgacaaacccacgaaacatcgctacaaactgagctcccaaagtccaaatgtaaaataatactctaaccctcattcatatagtacaaaatatgatctcttattgtgctggccgcaaattcttttgtgcggtccgcacctttaaggtctctgcgaccgtaacccaaattgtgctcgcagttcagcaatatatgcactaccagtctttagtaaattataataactttctgtacaaatgtctaaatgataaatattttaactttatgaaaactagactcaaactactacaactttcatttttggatcatctccaaattccttatagatcaaaagatataaccttccgaagtcagaccatcgaacctgcaagaggatttatgcggtgcgcaatgttcctctgcgatccgcaattttcctctaaggtccgcacatgagactttgcctcagcactccaaaatgtgcccccgcactccaactgatcccacaacatcatcagagtgccgaaatgcccaaactcattcaaaactcaccccgaaacacacccgagccccccgggacctcaaccaaatgcaccaaaaagtcctgaagcaacatacaaacttagacaagcccttaatcacatcaaacaatcctaaaaatacaaattgtgcattgattcaagcctaatcaactttaaacttcaaacttctacatctgacgccgaaacctatcaaatcaagtccgattgacctcaaattttgcacacaagtcataattgacattacggacctactctaacttccggaattggaatccaaccccgatatcaaaaagtccactcccaatcaaactttccaaaattcatcaaatttccaactttcaccaattgacgctaaaatgacctacgtacctccaatttaacatctaaacacgctcctaagaccaaaatcaccctacaaaactattggaattgtcaaaactccattatgaggttagcttcatatacttcaaactacggttaatactgagaacttaaactttcattttacggactatctgtcccatttcactccgaaactaaaaataaatactctcggtaagttacgtaaccacaaaatataaatagagggagtagtaaataggggttcggggctaatactctcaaaacgaccggcgggatcgttacacctggcttcgtgagggttatagcatggtctagcgcgctacagacctggcatcgcaagggttatagcacggtctggcacgctaggagctggcgatgcgaggtagaaatgatttaactccccaacatactgttcaacccaaaaagttcgaaaatacaataaattagcctaccttggaaccacagaaccttaaattccttagcaaaattttcttaggccttacacctaccgtagacagaaataaaacctatgatcacggcatttgaggctactgcatctggtctagctagaaaaacatggaacctagatggaacgccaccttactggcctcgacctctagggagacccctacccacctgccctccgcctatggcaagccggtgcggcatctggtgcgttaatcatggaatgatggcccagctggccatgctacactaccttgccccggatcttggggcaagatctcctcatgtgaccaagcttccctcactcacagcaacctctcggtgcggaagatgactgaacctaagtctgaccccggggacctgaatacctactggaaggaccctgaatagccagtggactataggagctctctaggatagcactaaaatatgtccacacaggtgcaacccgagaaggcggtggtgctgaataagtgggtctactggattgacccctcacaaactgacctctgcccctagacaggatgtcgttgaatcctccagaatgctgaggcctcttctcccctatcgtatacaatcgtctctagctgcgtataccctcaatccgccgatctatctccacaacctgctcgtaaagagtccttatctctacctatcgggccataataacctgaatatcataatgcaatcccgcaataaaccttcgcactctctctgcattggtggggagtatcataagtgcatggtggaataacttagaaaatctcgcctcataatcggtcacatacatctgaccctgttagagccgctcaaactaaccccatagctcttctctctgagaggttggaatatatctctccagaaagagacatgtgaattgatcccaagtcaagggaggcaaacgtgctggtcttcaaagaagataggaccgccaacatctatgggccttgccctccaactgaaatatggtaaagtccaccctgttggactccaatactctcttgttgtgcatcttgtctctgcagcttgtccctccaatgttgcaggcacctcacgctgctccccaatgacatgatcctccattggatcggctggtggtatgatgggagaaactctaggacaccctcatcctctagcaggagctggagctctcccccgacctctacctcggcctctagaaatagggggagcagtccctccaccaataggtacatgcgttctcaccatctgtgagagaataagagaaagatacttagaacaacatcaactacacgataggagacaaagaaaaagaagtttcctaataccctatagcctctcgaagataagtacggacgtctcctcactgatcagcaagactctattaggaccgcttatgacttgtgaaacctatatgaaactagagctctaataccaagttgtcacgacccaattttcactataggtcgtgatggcacccaacgtcaccgctaggtaagccaactatgaactacccatttaattcctcatttgaatatttttaaagtctttagattttttatttaacacgagaacaattagaaagtgagcatagtaatgtaaagcataaactaaatgggaaagtaagatagtgaattgaataatcaaaacccatgagtgtctactaaaattctcaaaacccggtgtcacaagtgcacaagcatctagtaaaatatacaaaattctctaagaactactgtctgaaataaaatacacagaaatgataaaacattataagagaaggctcatggtctgcagaaaggagcatgagaagcagctcaccactaagccttcgggtaatgcgaatatgcgcccggacaaactccagatgcacttgcctcaaaacctgcacaatttgtgcagtagtgtagcgtgagtacgtaaataacgtgtacccaataagtatctagtctaacctcaaaaaagtagttacgagggttcgacatagacacttactagtgcgcaatatgcataatgtacaaggatatttaataggcatgaaatacaacatcaataatggaatcagaggaaataattaaacgatcctttaatcaaaatagcaattaaaagtccccaaatataacatgctaatctcaacaagtaaggacttaacatgtatttataaatcctaatcataaaagacatatccagtataatcggactccgagtgacaacacacacgagttatgccgatgtcgtacggcccgatccataataatcgtgtacatacactaccgaggtcgtaaaagaattgtgcatttacaactccaaggtctttagattatgaattgtgcatttacaactccaaggtaagcccataagagaatataattttcatcagtaattaaacattccacaaaatctataattaatgaagcttgatttaacataatctttaaccacgttttttcttattaatacaagcaattaaactagcaggttaagttcaaatagtgcaattaatcatgataaaggtttatgtctacccggacataacataaatatgatctacgcacagaatctcgtcacttcatgcggtcatagaacccacaattagtagcaaataacaatttaaacaccgatgggtttcattccctcttacaacgttaggcaagagacttacctcgttcccaagtccacttttcggtccacaattcactctaaaagcctcaagtcagtgctgaacaatctgaaactatccaaaggttgtacaaactaatcaattattgctcaaaagttcataatttaactataagagtgattacccaacccaatttggaaggttcctaaaattcacctccggaaccacatgccccgattctggacattttcataaataaatattacccataacctcacgaacataaatatataatttttacccaattccataatcattttcgtggtcaaatcttattttagtcaaaatttagatttttcaacaaactcctaaaattttcacatttttcatgttaagatctactcgtaatctaggtattaaactcacattgtgtagaatacacttacctcaagatgctaggtgaaaatccctctttaaaaagctccaaaatcggccaataaatgagagaagtgaacaaaatggccaaaatcccgatttttattaagtcactgcccaggactgccctcttcgcggtcgtggttgtccttcgcgatcgcaaatgacaaagtcacacaccacgaaaaattccccttagcgattgcgagaagccacttgtgaaggcgatgcattgagccaccaactcatcgtgaacacgtgcctccattcgcaaacacaaaaggcaaaggagtcgcccagcctttctaagcgaacacgatgagtcacccccgaacgtgaaggtcactggttccaaacctccgcgaacgctgccctttctttgcaaacgcaaagagcaaaagcgtctagtccccaaatccttcatcgcaaatgcgatgggccttccgcgttcatgaagaaggaaaccagaaccagcacaccagcaagtttggacttagctccaggcaatctaaaatgcacctgagccccccctcccccccccctccccccacgaaacacccatccgaatccaccaacaagtctataataataatacagaccttctagaaccctcagaacatataaaataacatcgaaactaagaatcgcacccccaaaaccaaattgaatcaacttatgaaattcaaacttcttcactagctccgaatgcgccgaatcacactaagactactcacaatcacaccaaattttgcgtacaagtcataagttaccatacaggcccattcctaggttcggaatcccaaacaggccttgataacaccaaagtatactccaaaacaaatataaagaactagaaaaccttcaatgaaccaactttcagcattaagcgccgaaatactcctggatcacccgaaacccagtccgaacacacgcccaattccaaaattatcataggaacctattgaaactatcaaatcccgattccgagattgttttctcaaacttgggctcaagtcaaacttggccattagaggccactattaaggatctaagtgttctaatttcaatccgaacccttccaaacctaaaccaaccatctttgcaagtcataaaataataaaagcacatacatgaagtcttaattaggtgaacagggatctagaaagcaaaatgatcggtcgggtcattacagataccaacttgtcacgacccaaaatcccaacctattatgatggcacctaacacaccagctaggcaagccaaaatatgataatgaaggcaaccgcataatgaaattcataaaaatacgataaatctgaggtctcaatacaataaaactaataaatacaaagtatttctcccagaaactagtaagtatgaagtcatgagcttctacaacggaatacaagtcagaaactgaacaatatatacattgtctgaattataacagcactacgaaaggaaaagacaagtcaaactgcaaccaaggatgtagctctacctcgcctctagcagatagtccaacaagcaacctactactgataattggtccccacacctggatctccatagttaagtgtagagtgtagtatgagtacaaccgacccaatgtactcaataagtatcgtagataaacacggcaacgtttagtatgaaaacatccatgtgtatatatgtacaatttctcaagtactctgcttggacaatatcttggcatatataggtgatacgcagctaaatcagataaatgatcaaggaaattgcaagtaaagatgaaatgcaaaatccaacaaaacactggccaggtttcataacttttccatatttgttccaaaccacttatcagtattctaaatatctgcatgtacaccatcaagagagaaacatgagagggtgaccctagggggtggatatgtatccacacgttgcatggacaactcacgcgctaataatagaacccgcacagacaactcatgtgctgccaaacaactcgcgtgctagtaacatcaatatctcgacccgcatggacaacgcatgcgctgccagacaactcgcgtgctagtaacatcaatatctcgacccgtatggacaactcatgtgccaataacaaaacccgtccggtatggtcacaagcataataacacaatccgcacggcggggtcataggcaccctcgtaagatcgccacaaaccgagatttttaggtcaaaagatgaaaaatgaatgaaaacccctcgaactttctatttttgcccatcgattttcgcttttatggaccaacagccacttctgcagaaaatccatggcaggtgaggcttcgactcaagccaatagtcaccgcttctgcggtccaaaatagcgcacctacgcttcggcttctgcgggcaacaaatgcttctacgcacacgcacatgcggaccaagtttgcttctacgcccccaggccatcttggccagttacgcttcagcgacctctcttcggcatctgcgacctcgcaaatgtgtaatagtcctcactcctgcgctcgcagacctcctccctaattctcgcacctgcggccactctctccgtaggtgcgatgacacaagacttcaacaacaacaacagcatccctctaagtccaaatttcaatctgttttcaatccgaatctcatccaaggcccctgagaccccatccaaacataccatcaagtactaaaatatgatacgaacttagttgaaacctcgaatcacatcaaacaacataaaaacatgaatcctaccctaattcaagcctaataaactaataaatttctaacttctacaatcaatgctgaaacctatcaaaccaactccgattgacctcaaatttgcacacaagtcataaatgacacagcggacctatactaatttcaaaaaaccaaaattcgagctcagtaaacacaaagtcaacactcggtcaaacttctcaactctccaacttcaactttttcaacttttaccaattcaagccaaaatcatctatggacctccaaatcaacatccgcacacactcctaagtccaaaatcagcatactgagctatcggaaccatcaaaactctattctggagttatttacacataagtaaacatccggtcaactcttccaacttaagcttccaaccaatggattaagtatcccaactcaattcgaaacatctccaaaaccaaaccaaccaccccggcacttcatgtaacaataaatgaacacagaataagcaataaatgggggaacgaggaaacaatactcaaaacgaccggccggatcgttacactaaagatcctattttgagagatgagttgtatagatgtatttgacatcattcaactatacttttgtaatgacccggccggtcgttttgagaatttgagccccgatcccgtaatatctcttctccccataatggtttctgcttttgggatttgttggagtgtttggttatgaaattcagggagttttgggacacttagtcctaagttgtgagtttaagccttagagattggaccgtagtcagaactgtgtgaagacggatccggaatgaatatctgtcaactctgtaagctccgttgaatgattttgagcttaggagtgtgtctggaatgtgtttcggaggtttatagtagatttaggcttgaattggccaaagtaagattttctacgatttcggccgatagtggaatttttgatatcgagctcggaatggatttccggaagtggctgtaggttcgtagtgtcatttttgacctatgtgtaaaatttgaggtcattcggactagatttgacgtgtttcggcgtcatttgtagaatttggaaaattctaaattcttaggcttgaatccgtgcttaattcatgattttggtgttgttagatgtggtttgaaggatcgactaagtttttatggtgttataagattggtttgtaggtttggttgaggtcccgggggcctcgggtgtgtttcgggtgcttaaagggtgaaagtttggacttagaggaatttttgagttgctggttctggtgttttcgcacctgcggtggggagtccgctggtgcggccgcgcagaagcgaggctggtatcgcaggtgcacttttaggccagggagtgaatgctcgcagatgtgacgaatgagccgtaggagcggagccgcatctgcgaaaggtcagtcgcagatgcggaggtgagaaggacccaaggttccgcagaaacggacgattgagcgcagaagcgcatccgcaggtgaggactcaagcgcgcaggtgcagacccatctcggataagtgaccttcgcacctgcgatgattttttcgcagatgcggccccatgagcgcaggtgcggaaatcgctgggttgaagaggcagcttcgagggttcactcctcatttttcaccaattcgatttagagcttcgagggttcactcctcgagggattttgaaggagaactctagggtaactaattctaactctattttgatcataatacataaatctattattgttttcctcgtctaattaaggaatttgagggtagaagtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggggaaaaggttccccaattgaaaatctgagatttgaatgggaatttgacgttggatttagataatttttgttcaagtgaactcgtgagtgaatgggtgttcaaaatttgtaatttttacccgataccaagacgtgggcccgaggagaccttttggccgtttttcctaattcaaactttagcctcgaattaattatctaaattagttaattgtagttatatttatattatgcaattaatttgaatagattccggccatttggagtcggatactcatggcaagaacatgatatcgagttgatttgagcggttcgaggtaagtggcttgcctaatcttgtgttggggactttcccttaggatgtttgatattaattgatgtgtgggtgccttttacgtgaggtgacgagtacgtacacaggctattattgcaaaaatcccgtttttactttctaaatcataaactgtttttccttattatattacactgatacgtttaattgctaaacttagattagagaagcatgcttacgtgttttaactgcctaattgacattttgtgtgccatgcttagttaagtccctattttccttatctgtgtccagtannnnnnnnnnnnnnnnnnnnnnnnnnnnnnnnnnnnnnnnnnnnnnnnnnnnnnnnnnnnnnnnnnnnnnnnnnnnnnnaaactgtataactcgatgccatacctgctatttcatcttgcgttgcatatttaaattggtactgcggatgtattgcaggagatcccccctcccctgtactgcatatttattttgggactacagacgtattccgggagatcccccagcactgtatatttacttttgaactacggacgtattcctggagatcccccagcactgcatatttactttgggagtacggacgtattccgggagatccctcagcactgcatatttactttgggactacggacgtattccggaagatccccctgtactgcatattcatttggaactacgggacggtatcccaagagactccccactgtgtttactttgttctaagccgagggctcccttaactgttcaattttcaagaattgctttaactgtgttaccataaattttacttatatcttttactgtttaatttattatatttactccaatagggccttgacctgacctcgtcactactcgaccgaggttaggcttggcacttaccgggtaccattgtggtgtactcatgcccttccctgcacatattttcgtgtgcagatccaggtgcgagctatcagcctcggggttagtgcgtgttgctgactctaggagactccaaggtactattgcttgcatccgaagatcttcggagtccccttctactcccttacctagagactttcattattatctttagacttttgtatagagctacatagattatagcaccttgtgacttagtgatattccgggtcttaggaaattatttgtatatgccgagtggtactactcttggctattcacaatatgctgtttatctttaaaatgttgtattttctttatatttttcgtaatattaggcttacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcgtaaagactaggtgtcatcacgacaccttacggagggttaatttgggtcgtgataagttggatcaaagcactaggttcataggagtcgcgggtcacaagacgatttagtagagtctcgtggatcggtacagagacgtccgtacttatcttcgggatgctatgtaactgttaagaacaatcatatttctttgatttccttgtcgtgtaagttattgacatcaaaattctaaaattctattctattctttctcacagatggtgagaacctgtaccgggaggaccgacgatcaggcactcgagccccctgtcagagccgccagaggccagggtcggggtagaggacgaccatgtggtgtagcccgagcacctgcgagagctgcgtcagaggagaacctagcagctccaatttgagggccaaaaccggagatccctattgctactccagccctccaaggagaccttagctcagttcatgagcatgtttggcactctagctcaggatggactatttccgatagctcccgctacatctcaggccgggggaggggcacagactcgcgcaggccgcattcctgagtagagggtccaggatgatcaggccccagagtatattcctatgcccccagttgctccggttcagcatgagattagggtagctgcttatgaggcagagcaacccagacttgagacgtacaagaagtaccacccacctactttcagtggactagcttcagatgatgctctgggttttcttgaggagtgtcatcgtattcttcgcactataggcactgtggagacgagtggggtttctttcaccgctttccagctgaggggagaagcatatcagtggtggcgtgcctatgagctaagtactctggaagaggcaacctcactcacttgggctcagttttcatagatattcttgcataagtatgttcctcagagcctcagggatgcttggcgcgcagagtttgagcagttgcgtcagggtgctatgactgtgtcggagtatgcagtccattttcgtgagttagctcgccatgcaccagctctggttgctacagtcagagagagggttcgtctcttcattgagggactccactccaatatttggaccagtatgtctagggagttggagacggacatcacttatcagcaagcagtgagcattgccaggagagtggagggcatgtttgcccgggacagagaggagagagaggccaaaaggtctcgaaagactgatcattattcaggagctcgtgcaccagtagcacgctatggtaagggttttgtgagtcacccttttcattcagctcttccagcagccagcggtgttccagctcctcctagacctcaggagccctattatgcactaccaatatccagtatgccttttactcgaggtgctattaccggccagtccagcaggccaggtccgagttagtctcagctgccacatcctccgagaggttattttgagtgtggacactcatcacatggttagagatttccccagatccaggtggggtacaccttcatagacttatcagcctccacgtgctccaccgggtcctccggccattcttccagccccagctgcctccccacttcctcagccagctcgaggtggaggtcggggaggtcgaggttgccctagagggggaggccaggccaggtactatgcccttccagcctgttcagaggccgttgcttcagattcagtcatcacaggtatcgtccctgtctgtcaaagggatgcatcagtattatttgacccaggctctacgtattcatatgtgtcttcttattttcctccacatttgggaatatctcgggattctttgagtttttctgtttatatatctactcccgtgggagattctctcattgtggacaacttatatcggtcatgtttgattgctcttagtggttttgagaccagagccgatttgttattactcagtatggtagattttgatgttatcttgggcatggactggttgtcgccccattatgctattcttgattgtcacgctaagaccgtgacggtggctatgccaggcttgctgagattagagtggagaggtaccttagagtatactccccgcagggtcatttcatttcttaaggttcagcgaatggttgagaaggggtgtgatgcgtatttggcctatgtgagagatgtcagtattgatacccctacagttgagtcagttccagtagtgagggacttccccagatgtgtttccagctgatcttccaagcatgccgcccgatagagatattgatttcggcattgatttgttgccgggcactcagcccatatctattcctccttaccatatggcttctcctgagttgaaggagttgaagaaaaagttgcaagagttgcttgataagggtttcatcaggcctagtgtatcaccttagggtgcttcggtcttatttgtgaagaagaaggatggttctatgcgtatgtgtattgattaccggtagttgaacatggttacagtgaagaacaggtatcctttgcctcgcatcgatgatttatttgatcagttacagggtgccagggtgttttccaagattgacttgcattctggctatcaccagttgaagattcgggagccggatatcccgaagactgctttaaggaccagatatggtcactatgagtttcttgtcatgttatttgggatgaccaatgccccagcagcctttatgcatttgatgcacagtgtgttacggccttatcttgattccttcatcattgtgtttgttgacgacatcctggtatattcccagtgtcgggaagatcatgagtagcacctgaggaccgtgcttcagactttgagggagaagaaattgtatgcagaattttctaagtatgaattctggcttgattcagtggcattcttgggccacatagtgtcttgtgataggataaaggtagatctgaagaaggtggaggcagtgcagagttggcctagaccgtcatcagctacggagatccgcagtttccttggtttggcggggtattaccgtcgctttgtggagggattttcatccattgcagcgcctatgaccaggctgacccagaaggatgctccgttcaggtggaccaaggagtgtgaggagagctttcagaagctcaagacatctttgactacaacccgagtattagtattacctacaggttcggggtcctgcactatctattgtgatgcctcgaggattggccttggagcggtattgatgcaggatggtagggtgattgcctatgcgtctagacagttaaaggtgcatgagaagaattgtccggtctatgatcttgagttagcagctattgttcacgccctgaagatctagcgtcattatgtgtacggtgttacttgtgagatctacactgatcaccggagtttgcagcacttgctcaggcagaaggaccttaatttgcgtcagcggaggtggttggagctactnnnnnnnnnnnnnnnnnnnnnnnnnnnnnnnnnnnnnnnnnnnnnnnnnnnnnnnnnnnnnnnnnnnnnnnnnnnnatattactatattgtatcacccggggaaggccattctggcagctgagaggcccttagccttggatgttcatgccttagccagccagttcgtgatattggatatttcagagcctagccgggtattagcttgtgtagttgctcggtcttttatttatgaccgtatcagggagtgccagtatgatgatcttcatcttctagttcttcgggacagggttcgacgaggtgatgccagagatgtgactattggtgatgacggtgtgatgtggattcagagccggatctatgtgcccaatgtagatgggcttcgggagtttattctcgaggaggcccacagctcgcggtactccattcatcccggtgccgcgaagatgtaccaggatttaagacagcactactggcggaggaggatgaaagaggatatagttgggtttgtggccaagtgtctcaattgtcaccaggtcaaatgtgagcaccagagaccgggtggattacttcagaggttagagatcccagagtgaaagtgggagcggagcaccatggactttgtagttggacttccacggactttgagaaagttcgatgctatttgggtatcgtggatcggctgaccaagtcagctcattttattccagtgtcgaccacttattcttctaagaggttggctgagatttatatcagagagactgtccgccttcatggtatcccaatatccatcattcagacagaggtacacagttcacatcacgattttggagagccgtacaacaagagttgggtactagggtggagttgagcacagcctttcaccatcagacagacgggcagtctgagcgcacgacataaattcttgaggatatgctctgtgcctgtgtgatggagttcaaagggtcatgcgaccaatacttgccacttgcagagttcgcttataacaacagttaccagtccagcatttagatggcaccgtatgaggctttgtatggtaggcggtgccggtccccagtaggatggtttgagccaggcgaggcccgattgttgggtacagatttggtccaggatgccctcgataaggtgaaggtgattcaggagagacttcgcacagcccagtctaggcataagagttatgcggaccgtaaggttcatgatttggcatttatggttggtgagcgggtcttgcttcgggtatcgcctatgaagggcgtcatgaggttcgggaagaagggcaaactaagcccgaggttcattggtccttttgagatattgcggcgagttgggaaggttgcttatgagcttgccttgcctcccagcctagcaggagttcacccggaattccacgtgtctatgctccggaagtatcacagtgatccgactcatgtattggatttcagctcagtccagttggacaaggatctatcttatattgaggagccaggagccatttttgacaggcaggtcagaaagctcatgtcaaagaatattgcttcagtaaaggttcagtggagaggtcagccggtcgaggaggcgacttgggagaccgagcaggatatgcacagccaataccctcatcttttcacagtttcagttatgtctttatactcgttcgaggacgaacgattgttttaagggggggaggatgtaacgacccggctagtcgttttgagaatttgagccccgatcccctaatatctgctttccccataattatttctgcttttggaatttgccggagtgtttggttatggaattcgaggagttttgggacacttagtccctagttgtgagtttatgaaaacaagaaatgaatgtttatggaagaaaaataagaagtaaagagggagataaatatactataaccgctcatctgtacaatctcaataaattaaagaaaatgttaaattttaaaatctctaattaataataataaatacacaaattacataatatataagaatagtatattttaaatattaaataaatatagtatgaaatagtattttgggacctcttagaatttggggcctaaggtagtggctttagcagccttacccatcagccgcccatgacctttacacactgtgtgtccgactttgagaaggctgacaagttgaagcaatcacttcctccaggtttgagcgtgcaagacctgtgaagaaggatttatgcttttcatagagttattagggaatgaagaatttgtaagaactcaaatctttccttttaatatcttgccctcaggcatgtctgaagttttatttaaaacttttagatattgattgttgcattagtgtttactcatattgacagtattgtgagtgatccgcaatggtgccgaatgaattttgttagatgccaaagttagtgtttgattttgtcaaaaaagaaaaaatgaaaagtttttatagccatcaccggagagagtatgttttaattgtcatgtatacttatggcgagtggttttaacgcgaaagacattaacgtctagtatttttataatggggcataatcatctgagtatttttatactctgtctagtactgttttgtgcaacaatcataaagaggtagtaataaagaacaatgataatatacatcagaatgacaaagagacgatcatttctgaaatattcggatccattttagatcaagaagatctttattgccaccttcataatggaaatattttagcgtatcttagcttgacatgtcgtatattcttttggtgataaaatgagctgcgaaatttgttaaaaggacaagcttgccagatctcttttaaattagcacttgcatttctgtatcagctcttcacggtttccagtatatataaatccttcttatatttaatttgacagctcattttcaccaaaaagacaaaagtaaaaatacaaataaaccaatctctgggcctgtatttcaaataaaatacgtttctgctcgggattcaatagattatgtgaacgtgtaaagatcttcctctaggtctaaaatggatctgcattcaatagtgttgtagtacttttgtcgcacttcatgtatatattcacattcacatcgaagtgtattttttaactctttttaatatatgagcaaccattcgtttcttaatgggatatacgagtgctcgttccatttttatataataaaacttaaaaggcataacaagcagctacttagaatggaaacttcacacaaactcttattcatttcttcatttatttatgtgatacactttccgtactactccattctaaaaagaatgatatatcttcctctcaaatatattatctattgtaatttttaaaaatagttgtctcaaattatttatcattttagaatttcaagataaaattaattatatcttctcaattttacccttaatagtaattgttcttgaaaatagagatagcacataaatagactaaatattaaatgaaaagagaatacatcttaagacataaataagagtaaaatagttaaaatctctttccaattaatgatttcttaagggacgtgtaaaagaaatacacgacagataatttaagccgaagagaatacatttctatattttaattaaaaactttttatttaaaagtttttaaaacgatacaaattgaaagtcccacaaaagttttactcagataaccttcttatacaacataattaatgagaaacaggaagatacgatctagtgctgcgtgcaatagggcaaagcatatataaatagatgtgggtgtcaaccttttcattcatcctccacaatatataagataaaaggagcaagaaactatatatattcattttcatccaaaaccttattagggcaatggaaatgaatctagctgacgaaaccttgtttttctctgagtctcatctccttgaatcgataaagcaacatcttcttgatgattcagatttttctgaaattttttcgccgatgagttcaagcaacgaaatattgcctaacagtcctagctcaagttttagcagcttcgactgcagcttcctcaattgggatgaaaactttgaggaaacattaataccaactgatcaaaatccttcacatgagaagtgctccgagtccgaggagcaaacccagggcccagcggtggtgcgtgagaaaaacgcgccgcgagattggacgcggtatataggagtgaaacggcggccgtgggggacgttttcggcggagacaagagacccaagtaggaaaggtgaaggtgcaaggctgtggttaggaacttacgagaccgcagaggatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgttggcttacgatcaagccgctttcaaaatccgcggctcgagagctcggctcaattttccccacttaattggctcaaacatgcctaagccggctagagtaacagcgaggcgtagtcgtacgcgctcacccgagccatcctcttcttcatccacttcatcatcagaaaatgtgccaagaaaaaggaatatagatgtgataaattccatagccaaagccaaattcctttgtcatagcttaaatttacagagattagcttaactatgtgaaaggaaggaagctttcattcgttcaacattagaatagtctctaaaaaaatgagggcaacaaaaattttagttaatttctccattctcttttgttgccattcttataatgaaattgcttggaagataaatcacgttttgttctatcagtgtatatgcacttcattcaaatagacctccagctttcatattttttctatgttgatcataagtgagactagtgaaaaaaacagacaagttaaaaagtctaaatttgtccctaaactttcactccatcacatcgacctccctcgtagtttaagatattacacttacctctcttattttgagtttctagtaaacattctttttaacctaattatttttaattatataaaattgtaatacgataaattttccgtctaaatttggaaacatcttttctgaaaaaaaatctacaataaaacaactgactgaataaaataaaagaacatagtgtttgaaaattagtccgtctttttcggtggtgtataagatcggaggttgtggtagttagggcggttaaaaatcgaactgaaaccgttaagcgaatcgaatcaataacttattggcttattggtatcagattatcggagtaatggatggtgaacaaattaagattttataattaatggcttaacgattttggggcggattactcaattttcttatcgggtaaatcattaacccgttaagaatttttatatttatacttttacccctatgtatataaagtattattgaaaccttaaatggttaaatccctaatttctattttttaattctcaattgtctgcagccactagaggcagagaagtcgccagtcacgtctctcttgaactgaaaactgagaagtcaaaaaatcgaaatcacaatgattaatatgtgtatgtctgtatgagtagtcttgatggtattacaaatttggttaatacgtgtgtaaatgtatgagtagttttgaaaactcttcaattaaaaaatactgttttgttagatcttatatggtattaaaaatttggtattgatttgaaactgattggtattgattgaatgattgttcaaaaaaattctatttggtttagccgataagtcacctgatatccgcccgataattgttaatctggtataaatccgcatgttgtcttattggatggctagcggattactacatttataatccgataaccgttaagtttaattattcgcccgatccgcccgataaacatccctagtgggagcaagggcggatgcaacatagagctattgggtttaacagaactcattacttttgatcagaacataaatttatgtgtaaatattattaaacttaccaaaaatagtagatatgaatgaatccataactttaaaatataatgggtcaaatactaaaaatattaaatgttgaacccacaaaattaaatcttagatttggatatgaataagaaccctaaaagacttcccatgataattagatatgtaactggacaaatccctaaagatgtctattgcgaatgaaagagtacaaggtagttggtcagctgttgaaggaaagatttagagatccttctccgattacagctactatgcaatagcaggttgacagatgtcaatcgtttcaatcaagcaaaccttcagcagtttatgcaatatgaaagggcaattttgtcatatcagagtttttaaattctataataaataggtaaaaaatattactattacaaaagaaattaaaataagggagaaaagcgtaatatctcacactaaaaggaaagtcaagatgataaaaaaataagtttattggtcatccaaaaacaataccatcgtatttttcttaaaatccgtatctcttggttaatagtttcataaaacatacttttaccaaattaactttgtatccttcccccggtaatttaaaccaatccttcacagctagatttaaaattgtaaattcctctatgagaagagtatatgtagatataggaatgcctaatgtaacttacaaggtttatcttactgacacgtggtaacaaagctcaagcttcttatgtatacaatgattaaaattaagcatcctagtaggattacattaaaagcaatgaatctcttattagttattcataaaagatggggtcgtttggtttaaatacggcttatgccgggataagttatgctggaattagttatcctaatattattttttatccattatctggtatattttattaaaaatgataactgcataatttctaagaagaatgaataagttatctcgacactaattaccccaccctctacaaggtataagttatcccgatactaattttaatctcgggataacttataccaggtttttgtaacgactcggccggtaatttcgagagttgtagccccgttcccccatttactgctccatttatgctttatagttgttatatgacttatcgggttagttggttagagtccggagtgaattcagtgtgaaatgagacacttagtctcttaaatggaaaacttaagttggaaaagtcgtccggatgttgatctatgtgtaaacgacctcagattcgaattctgatgattccagtagcttcgtatggtaattttgaacttagaagcgtatccgaaaaattatttggaagtctgtagtgggattagacttgaaatggcgaaagtcaaattttgaaaagtatgaccgaggggttgactttttttatatcggggtcggatttcaattccggaagctgcagtaggttcgtggggtcatttatgacttgtgtgcaaaatttgaggttaatcggacgtgatttgataggttttggcgtcgtttgtagaattttgaaatttcaaagtttcttaggcctgaatccgtgtgtaattcgtgttttcgatatttgttggaggtgatttggttaaggtactaggggcctcgggttgatttcgggtggttaacgtacttggaatttgatttgagaagttactgaagtgtaagagttgctggtgtgaccgcacctacggagaagggaccgcagatgcgatcccgcaggtgcggaaaggggtggagaccagtaggggctgcaggcgcgatggtttctccgcacctgcgataacacagatgcggaccattggtcgcgggagcggaggcagccagagttagtcattttcacaggtgcgcccagatgttttgcaccaacgggcgtgcaggtgtggaaatgcctgggcagaatctatatcagcgggatccgtgttttttgtccatgtctaacattttttagctcgaaatttggaggtttggaaagggtttttcaaggggattctttgggtaagttccttgtgtttatttttattcaataattatatttccccacggagtttgcacttagatggtgtgtttttgaggtataaatttgggatttgaggctagggatttggagagttggttttgaggatttgaatgaccaattggtgttggattttgatgaatttggtatggttagactcgtgagtgaatgagcttttggattttgtgacttttgtcagatttcgagatatgggcccgtgggccgggtttgggccgatttcatattttggctataatgtcatttttttcttgtggaattaattcctttagcctatattgattgttttatactatatgtagctagattcgggacgtttacggatttgagagacaagggcattttggagtagaatttagcccgaattgagatagtaacacattcaaacttagttctaagggttcgaaacaccgaattatgtgttatgtgcttggtattgaggtgacgcacatgccaagtgacgggcgtgcaccattagaactgtgacctggttgactccatggcaccgtatagtggttttatcttgttgatacctgtgtattcatcatgtgataaagtaattgagctgtcactcgtgctagatatcatgtttaggatttatgttggtactgtttggaccacagtggtcgtttcttgttgttgtcttactgatttcattgatatttcatacttagtcatattcattcattttatatctcatcgcaatctcttttgttattaattgatgcatcatatcattattttcgggcaagtatcatgacattgtgagcccatgagagagagactggagagattgatgactgagtgaggccgagtgcttgagtatgagtggtatttatgggatcagactacacgccgcaatggttatactaatttatgatagcgcttgggatgaaggatcccctccggagtctgcacacacccctagtgagcgcggttgatattatatggagatggatcttctccacatggctagattggccttcctcggtactaggtgacttatattgagtgatgtatatgttctgggatggaccttccctgagccgtattagccatatacagtaccaagtggttgattatttgagagtgtgaacctggagatggatcttctccacagggctgaattggccttcctcggtactgggtgacttatagtcattgatgtatatgttccaggatggatcttccctgggccgtatgggccaaatacagtatcgggtggttgagtattcgagagtgtgagcacatgaggctgtcagcatggtgcatcacatacaacattgcattggcatggtagaggttgaggagttatatttttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattgatccattttactgttttaagatatctaccgaacttgaaagcatgtctatatttcttcactgttattttctgttttgaactgtgccggttgagttcgtaactactttcagcccacaatttgggtttgttacttacttagttggttgtactcacactacactctgtacctcatgtgcagatctaggaacttctggttacggcggctactgattgaggagataggatctcggagactatcgaggtagccgtatagcattcgcaaggccttgactctacttcattatcttcatctatacttcagtttttactccttagacattgtagtagactgtattctgacatagatgctcatgtactcagtgacaacccaattttgggatggattgtattatattttggatatttctgtttttaaaaggttttttccttaactattaaattgttttcgcctatattttgaagcttttactgtgttgagatagttgagtagcggcttgcctagtaccatgataggcgccatcacgacggttggttttttaggtcgtgacaagttggtatcagagcctagattatataggtctcacgagtcatgagcaggtttagtagaggcttgcggatcggtactgagacgtctgtacttatcttcgagaggctgccgaacccttaggaaaattacaatttcttgtactctatcgtgcaaatttgttgataacgaaaactgaatttatgttattctattctctcacagatggtgagaacatgtactacttggcaggatggacagtcaccagtaccaccagctagggctgcgagtggtcgaggtcacaatagaggtcgcgataggggcaaaggtacaactagggcagcacctgcagacccaccagttgctctagctcaggcaccagctgtgcctattgcgattgcaggcattcaggagactttggcccagatattggcagcctgcactggtcttgctcaggtggtttcggctcaggccgcacctgccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcccagccggttgcagctactcaggccctagtagttcctgttatggcagacgatgatcagaggagatttgagagtcttcggcctccaccatttagaggtactgagtcagagaatgcttaggagtttttggataggtgccaaccgatgcttcggacaacaggtattctggagaccagtggggtctcattcactacttttcagtcttatggggctgcactcagatggtgggagacttacgagagacgtaggcctgttggcgcaacaccccttacttggcatcagttctccgtggtctttttggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcagtcccacagagaagagctgcgcagacagttcgagcagcttcgccagggtgatatgtctgtgacgcggtacgagatgagattttctgagttgcctcatcacgctgtctggttggttcctactgatagggagagggttaggagattcattgatggcctcacatatcaactgcgattacttatgactagggagagagtatctggtgctacttttgatgaggtagtggacattgctcgacagatagagatggtttgtagccaggaacgtagagagagagagagaggctaagtggcctcgtggtccatgtgattacagcgatgttccttcaaggggtcaatttcaccaaggtaggggtcgttcttatagacatgctcaaacgggtcatccagctcatcgtggtgcatcagctagccatggttcttacagtgctcactcaggccagtattcattcagtgcactaccagcgcagagttctcatcatgcctcgtccgcacaagattctgcaggtcattcctcgagttataaggagcaacagtttcatcagagaaggggttgtttcgagtgcgtagaatttggtcatttcaagagagagtgtcctaggctgttgagtggggcttcacagcagatttctcgaccgacagcaccagcaccagcagttacaccacccaccctaccatctcggggtgggggtcaggcagctaggggtcgctcaagagggggaggccgatcaggtggcgggtaagctcgattctatggttttcctgccaggacagatgttgttgcctccgacgcggtgatcacaggtattgtttcagtatgccacagggaggcttctatattatttgaccctggttccacttattcatgtgtatcatcgtatttttctcattatttggatatgtcgtgtgtgtccctagtttcacctatttgtgtatctacactggtgggcgatattattactgtggatcatgtgtatcagtcgtgtgtagtaactattagggaactggagactagagttgatctcttattactcagtatggttgattttgatgtaatcctgggtatggattggctatctccatatcatgctattctggactgtcacataacaatcgtgacgttgacaatgccggggttgccaaaggttgaatggaagggttctctagatcttgtgggataatactgggtatgttgttgttgttgtacaattttaaaagcatccctgtgatttttaaactagattatcaatttttacactttcatgtccttctaagtgatgggaccccctgttgagtttggaagatcctcttgttatgagataatggtcatcgaaatgtcaagcattcgaaaggtggatgcgtctacccggagactcagtcaaccttatttatagatcatggatatcaacgttatgctggaacggttgctactatcgaagatcttgctcctactagctaatcacctggtatactggctcaaaactcggaacgatagctttcccctaccattataaaggcctccctaacgctctaaggaaagggcatcagaaaatagaatgataagttatgcgtcttttgttttgataatttgacaaacttcatgagagaaccagataagcaacctgatacattgaaggcccaacatatggttggaaagggatgcttgtcatatttggcctttgtaagagatgttgatgcagatactcctattattgattcaataccgatcgtacgagactttccggatgtattttctgcagacctgctgggtatgccactcgacagggatattgatttcgggattgacttggtacagggcactcaaccaatttctattcctctgtatcgtatggaaccagttgagttaaaagaattgaaagagcaacttcaggaactccttgaaaaagggtttattaggcctagtgtgtcgccttggggtgcaccggttctgtttttgaaaaagaaagatggtactatctggatgtgcattaattataggcagttgaacaaagttacaatcaagaataaatatccattgccgcgtattgatgatttatttgaccagcttcagggagcgagggtgttctccaaaattgatttgaggtctgggtatcaccaattaaaaattcgggattcggatattctaaagacgacattcaggactcgttatggccactatgaatttcttgtgatgtcttttgggctaaccaatgccccagcagcatttatgcatttgttgaatagtgtatttcagccatatcttgatttatttgtcgtaatattcattgatgatattcttgtgtactcacgtagccaggaggagcatgcaaaacacttgggaattgtattacagaggctaagagaggagaaactttatgccaaattctctaagtgtgagttctggcttagttcggtagcattcttgggacatatagtgtccagtaaaggaattaaggtggatccgaagaaaatagaggcagttcagaattggcccaaaccatcctcagttactgagattcagtgttttctcggcttgatcggttattatcatcgtttcgtggagggtttctcgtctattgcatcgcctatgactaaatagacccaaaaaggtgttccgttcaggtggttagatgaatgtgaagagagctttcagaagctcaagatagctttgactacaactccagtattggtattgcctacaggttcagagtcttatactatgtattgtgacacgtcgcggattcgtctcggtgcagtacttatgcaagacggtagggtgattgcatatgcgtccagaaagttaaaggtacatgagaagaattatccagtctacgatcttgagttagcagctattgttcatgccttgaaaatttggcggcattacttgtacggtgtccagtgtgaggtatataccgatcatcggagtctacaacatttgtttaaccagaaggatcttaacttgcggcagcgaaggtggttggagttgcttaaggattatgatatcaccattctctatcatcctggaaaggccaatgtggtggccgatgccttgagtcgtaaggcaaagagtttgggcagcttaacatacttaccggtagtagagaggcctttagccttggaggttcaggccttggctaatcagtttgttaaattggatgtttccaagccgaatcgagttttggccagtgtagtttctcggtcttctttatatgatcgcatcagagagcgccattatgatggtccatatctgcttgttcttaaggacacagttcagcacggtaatgccaaagaagtaactattggagatgacggtgtattacggatacagggcaggctacatgtacctaatgtagatggttttcctgaactgattctccaggaagctcatagttcgcggtactctattcattcaggcgtcgcgaagaggtataaggatttgagacagcactattggtggaggcggatgaagaaagatatagttgggttttgtatctcggtgtttaaattgtcaacaggtaaagtacgagcatcagagaccgggtagattactacagagacttgaaattccggagtggaagtgggagcgtattaccatggacttcgtagttggactcccacagactttgagaaagtttgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttgaccaaatctgcacattttattccagtcggtactaattattctttagagcagttggctgagatttatattcgcgagattgttcacgtagtttacctcgaagttttggagggcagtgcagcgagaattgggcacacaggttcagttgagtacaacatttcaccctcagatggacggacagtccgagcgcactattcagatattggaggatatgctacgcgcttgtgtcattgattttgggggttcatgggatcaatttctgccactggcagagtttgcttacaataatagctaccagacaagcattcagatggctccgtatgaagctttatatgggagacggtgtcggtctccggtgggttggtttgagcctggtgaggttagactattaggtactgacttggttcaggatgctttagagaaggtcaaggtaattcaggaacagcttcacacggcatagtctagacagaagagttatgccgacaggaaggttcgtgatgttgttcacatggttggggagaaggttctgctcaatatttcacccatgaagggtgtgttgaggttcgggtaaaaagggcaagttgagcccgcggtatattgggccttttgagatacttaagaaaattagggaggtggcttatgaacttgctttgccacctagtctatcaagtgttcatccagtgttccatgtatccatgctccgaaagtatatcggggatccgtctcacattctggatttcagtgtagtacagctagacggtaatttgacttatgatgtggagccggtggctattttagaccggaaggttcgaaagctgaggtcaaagaatataacatcagtgaaggtgcagtggagaggccagcgagtcggagaagctacttgggagattaagcaggaaatgcagaacaaatatccacacttatttgagactccagttattattctaaacccgttcgaggacgaacgtttgtttaagagggggagaatgtaacgacccagccagtcgttttgagtattataaccccattcccccatttactgctcaatttatgtcttgcaattgatttatgacttatcaggttagttggttcgggtacggaaggaattcagaacgaaatgagacacttagtctcataattgaaaatttaaattagaaaaagtggaccggatatggacctatgtgtaaaggacctcggattcaaattttgatgattccagtagctctgtatggtgattttggacttaggagtgtgtccgaaaatatttttggaggtccgtagaggaattagacttgaaatgccgaaagttgaatttttgggaagtttgaccgaggggctgactttttgatatcgaggtcgaaatccgattctgaaaattttaataggtatgttatgtcatttatgacttgtgtgcaaaattggaggtcaatcggacgtgatttgataggtttcggcattatttgtagaaattagaaatttcaaagttcaataggcttgaattggggcgtaattcccgaacctcaacacacccttcatgggtgaaatcttgagcagaaccttctccccaaccatgtgaacaacatcacgaaccttcctgtcggcataactcttctgtctagactgtgccgtgcgaagccgttcctgaatcactttgaccttctctaaagcatcctgaaccaagtcagtacccaatagtctaacctcacccggctcaaaccaacccaccggagaccgacaccgtctcccatataaagcttcatacggagccatctgaatgcttgactggtagctattattgtaagcaaactctgcgagtggcagaaattgatcccaagaacccccaaaatcaatgacacaagcgcgtagcatatcctccaatatctgaatagtgcgctcggactgtccgtccgtctgagggtgaaatgttgtactcaactgaacctgtgtgcccaattctcgctgcactgccctccaaaactgtgaggtaaactgcgtaccccgatctgaaataatggacaccggcacaccgtgtaggcgaacaatctcgcgaatataaatcccagccaaccgctccgaagaataattagtaccaactggaataaaatgcgcagatttggtcaaccgatctactatcacccaaacaacatcaaactttctcaaagtccgtgggagtccaactacgaagtccatggtaatacgctcccacttccactccggaatttcaagtctctgtagcaatccgcccggtctctgatgctcgtactttacctgttgacaatttaaacaccgagatacaaacccaactatatctttcttcatccgcctccaccaatagtgctgcctcaaatcctgatacatcttcgcggcgcctggatgaatagagtaccgcgaactgtgagcttcctggagaatcagctcacgcaaaccatctacattaggcacacatagcctgccctgcatccgtaatacaccgtcatctccaatagtgacttccttggcatcaccgtgctgaaccgtgtccttaaggacaagcagatgtggatcatcatactggcgctctctgatgcgatcatataaagaagaccgagaaaccacacagccaaaactcgattcggctcggaaacatccaatctaacaaactgattagccaaggcctgaacatccaaggctaaaggcctctctgctaccggtaagtatgctaagctgcccaaactctccgccttacgactcaaggcatcggccaccacattggcctttccgggatgatagagaatggtgatatcataatccttaagcaactccaaccaccttcgctgccgcaaattaagatccttctgtttaaacaaatgttgtagactccgatgatcggtatatacctcacactggacaccgtacaagtaatgccgccaaattttcaaggcatgaacaatagctgctaactcaagatcgtggactggataattcttctcatgtacctttaactgtctggacgcataggcaatcaccctaccgtcttgcataagcactgcgccgagaccaatacgcgacgcgtcacaatacacagtataagactctgaacctgtaggcaacaccaatactggagttgtagtcaaagctgtcttgagcttctgaaagctctcttcacattcatccgaccacctgaacggagcacctttctgggtcaatttagtcataggcgatgcaatagacgagaaaccctccacgaaacgacgataataaccggccaagccgagaaaactccgaatctcagtaactgaagatggtctgggccaattctgaactgcctctattttcttcggatccaccttaattccttcactggacactatatgtcccaagaatgccaccgaactaagccagaactcacacttagagaatttggcataaagtttctcctctctcagcctctgtaatacaatacccaagtgttgtgcatgctcctcctggctacgtgagtacaccagaatatcatcaataaataccacgacaaataaatcaagatatggctgaaatacactattcatcaaatgcataaatgctgctggggcattggttagcccaaaagacatcacaagaaattcatagtggccataacgagtctgaatgccgtctttagaatatccgaatcccgaatttttaactggtgatacccagactcaaatcaattttggagaacaccctcgctccctgaagctggtcaaataaatcatcaatacgcggcaatggatatttattcttgattgtaactttgttcaactgcctataatcaatgcacatccgcatagtaccatctttctttttcacaaacagaaccggtgcaccccaaggtgacacactaggcctaataaaccccttttcaaggagttcctgaagttgctctttcaattcttttaactcagctggtgccatacgatacggaggaatagaaatgggctgagtgccctgcaccaagtcaataccgaaatcaatatccctgtcgggtggcatacccggcaggtctgcaggaaatacatccgaaagtctcgcacgaccggtactgaatcaataataggagtatctgcatcaacatctctcacaaaggccaaatatgacaagcatccctttccaaccatacgttgggccttcaaataagaaattaccctgctaggaacaagatctagagaaccctccattcaacctttggcaaccccggcatcgtcaacgtcacgatttttgcgtgacagtccagaatagcatgacatggagacaaccaatccatacccaggattacatcgaaatcaaccataccgagtaataagagatcaactctagtctccagttccccaatagttaccacacacgaccgatacacacgatccacagtaataatatcgcccaccggtgtagatacacaaacaggtgaaactaaggactcacagggcatatccagataatgagcaaaatacgatgatacatatgaataagtggaaccagggtcaaataatatagaagcctccctgtggcacactgaaacaatacctgtgatcactgcatctgaggcaacaacatctggcctggcaggaaaagcatagaatcgagcctgcccgcctgatcggcctccccctcttgggcgacccctagctgcctgaccccccccgagatggctgggcgggtggtgtaactgctggtgctggtgccgtcggtcgagaactctgctgtgaagccccactcaacagcctaggacactctctcttgaaatgaccaaattctccgcactcgaaacaacccctcctctgacggaactgctgctcctgataacccgaggaatgacctgcagaagcctgtgcggacgaggcatgatgagaactctgcgctggtagtgcactgaatgaagactggcctgagtgagcactgtaagaaccatggctagctgatgcaccacgatgagctggacgacccgtctgagcgtgtctgtaagaacgacccctaccacggtgaaactgaccccctgaaggaacaccgcgtaatcacccggaccacgaggcctcttagcctctctctctctccacgttcctggctacgaaccatctctatctgccgagcaatgtccactacctcatcaaaagtagcaccagatactctctccctagtcataagtaaccgcagctgatatgtgaggccatcaatgaacctcctaatcctctccctatcagtgggaaccaaccagactgcgtgacgagccaactcagaaaatctcatctcgtaccgcgtcacggacatatcaccctggcgaagctgctcaaactgtctgcgcagctcttctctgcgggactgaggtacgaacttctccaaaaagaccacggagaactgatgccaagtaaggggtgctgcgccaacaggcctacgtctctcgtaagtctcccaccatctgagtgcagcccagaaaactgaaaagtagtgaatgagaccccactggtctccagaatacccgctgtccgaagcatccgttgacacctatccagaaaatcctgagcatcctctgactcagtaccgctaaatggtggaggtcgaagcctctcaaatctctcaagtctcctctgctcatcatctgccataacaggaactaccggggcctgagcagctgcaaccggctgggctggtagtgcccccggtatctgaagtccctgtactacctggtctggagtacgggcaacaggggtatgagtacctcccccagcctgagaagtggcaggtgcggcctgagccgaaaccacctgagcaagaccagtgcaggctgccaatatctgggccaaagtctcctgaatgcctgcaatctcaatgggcacagctggtgcctgagctgatcctgtcggctcaactatatctggaatctgctcctgagctggaacaactggtggtactacaggtgctgttccaactgtggtacgagctacacctcgacctctacctcggccccggcctctaccacggccccggcctctcgcggccctaactggtggcactggtggctgaccgtccgatccggtagtacgtgtcctcaccatctgtgagagaatagaatagcagaaatttagtttccagaatcaacaaattcgcacgacagaatacaagaaagtgaaattttcctaagggttctgcagcctctcgaagataagtacagacgtctccgtaccgatccgcaagactctactaaacctgctcatgactcgtgagacctatgtaacctaggctctgataccaacttgtcacgacccaaaatcccaacctgtcgtgatggcgcctatctcgatactaggcaagccgataatctcaataaaccacaatttctctttaagtttgaaaatataatatttaaatacaatacaaacactcccaaaacctggtgtcactgagtacatgagcatctaatatgaatacaagtctggaaaatatagtctataatagtctgagaccaaatacagtaaacaaagagatagagaaggagagacaaggtctgcggaacacggcagctacctcaaaatctcctgaaaatcaaccgcgcgaaaggatcaacacccgctatgtccgggaacacctggatctgcacacgaagtgcagggtgtagtatgagtacaaccaactcagcaagtaacaataataaataaggaactgaagatagtaacgagctacacagttatggttcatttccagtaattccagcaaagaatagacatgctatcaaatctggcagtttaatgtcaaatcaatttttatacagttcctgttcatgtaatccgtatatcaacaatctttcagagatttcacaacaatgacagatagcaactaagtgcaacaacaaatggaaatcaagtacaacctcttaggacaacaatcactcactgggctcccagccctcatcactccctgggctcccagccctcatcactcactctcaatgggtacccgcgctcactgggggtgtacagactccggaggggctcctacagcccaagcgctataatctgcacggacaactcacgtgccataatataaatatctggttcacacggccaactcacgtgctatagtataatataaggatccacggccaactcacgtgctgcacggacaactcacgtgctatatatcaatatctcacaatcaggccctcggcctcactcagtcataaatctctccagtctctcgggctctcaataatcatgaaatcagcccaaacaacaatgatatgatgtatcaataataataacagagactgagataaaatgtgcaagtaaaaactgagactgagtacatatagcatttagcaggcaattcaacaagtacgcgacctctgtgggtcccaacagtactatcacatagcctaagcatgatttctaacatgatttacagtcaaattttatcaacacatagagagcatatagctaacaacaaattattcaactttacagtttcccgggacggaccaagtcacaatcccctcggtgcacgcccacacgcccgtcacctagcatgtgcgtcacctccaaaataatcacatgataccaaaatccggggtttaataccctcaggaccagatttaaaactgttacttacctcaaaacgtgaaattctttactctgctatgcctttgcctcgcaaatcggcctccgaatgcctcgaatctagtcacaaataattcgtttcagtcaataaaatttattggaattaattccataagaaaatactaatttttcataaaaatccgaaatttagctcaaaaatcgcccgtggggcccacgtctcggaacccgacaaaagttacaaaatcgaaagcccattcaaccacgagtctacccataccaattttaccaaaatccgacctcaactcgaccctcaaatctacaaatcttatttccaaatttctaagttccaatctccgatttacacctcaaaatcatgtaatctagtcggattattcgatgataattcaatattatggagtagaaatgatcacaagggacttacctcaagttttccttgaaaatatatcaaaaatcgcctctcctcaagctccaatttgtcaaaaatggcgaatgggacgaagtccctgtttttataattctgcccagacaacctcggttctgcctcgatcttggccttcgatcgaggtcctcgatcctcgatcctggcctcgatcctggcctcgatcctaggcctcgatcctgatcctcctcgatcgtggcttcgatcctgatcctcgatcatggccctcgaccctggccttcgatcatgtcttcgaccctgccttcgaccgtgaccctcgaccctgggctcgatcatggcttcgatcccttgggctcgatcatggccctcgatgacttgttgttatatttggttgaggtcccgggatcctcaggtgagtttcgtatggttaacggatcaaaaattgaactacaacagctgctgcaatttccttatgttggaaatttcttctgccagattcgagcccagaaatctctcagaatcgagcccaggacctgctagaatcgagcccagggtcgagggccacgatcgaagccatgaccaaggccagggtcgagggccacggtcgaaggcatgatcgaaggccagggtcgagggccatgatcaaggatcaggagtgaagccacgatcgaggcccaggatcgagggccaggatcaaggaccaggatcgaggcccaggatcgaggcccaagatcgaggcctaggatcgaggaccttgatcgaaggccaagatcgaggcagaaccgaggttgtctgggcagaattataaaaacaaggacttcgtcccattcgccatttttgacaaattggagcttgaggagaggcgatttttgatatattttcaaggaaaaattgaggtaagtcccctgtgactactccataatattgaattatcatcgaataatccgactagattacatgattttgaggtgtaaatcggagattggaacttagaaatttggcaataagatttgtagacttgagggtccaattgaggtcagaatttggtaatattggtatgggtagacacgtggttgaatgggctttcggattttataacttttgtcgaggtctgaaacgtgggccctacgggcgatttttgagctaaaattcgaaattttatgaaaaattagcattttcttatggaattaattccaataaattttattgactgaaacgaattatttgtgactagattcgaggcattcggaggccgatttgcgaagcaaaggcatatcagagtaaagaatttcacgttttgaggtaagtaacagttttaaatctggtcctgagggtattaaaccccagattttggtatcatgtgattattttggaggtgacgcacatgctaggtgacgggcgtgtgggcgtgcaccgagggaattgtgacttggtccatcccaggaaactgtaaagttgaataatttgttcttagttatatactctctatgtgttgataaaatttgactgtaaatcatgttagaaatcatgcttaggctatgtgatagtattgttggggacccacagaggtcgtgtacttgttgaattgcctgctaaatgctatatgtactcagtctcagtttttacttgcatattttatctcagtctctgttattattattgatannnnnnnnnnnnnnnnnnnnnnnnnnnnnnnnnnnnnnnnnnnnnnnnnnnnnnnnnnnnnngggctgattttatgattaatgagaacccgagagactagagagatttatgactgagagaggccgagggcctgatattgagatagtaatatcatagaacgtgagttgtccgtgcaacatgtgagttggctgtgcagatccttatattatactatagcacgtgatttggccgtgcagcacgtgagttggccatgcggatccagatatttatactatagcacatgagttggctgtgcggatccagatatttgtattatagcacgtgtgttgtccgtgcagattatagctcttatgctgtaggtgcccctccggagtctgtacacccccagtgagcgcgggtacccattaagagtgagtgatgaaggctgggagcccagggagtgatgagggttggaagcccagtgggtgattgttgtcctaaaaggttgtacttgattttcatttgttgttgcacttagttgctatctgtcattgttgtgaaatctctaaaagattgttgatatacgaatttcatgaacaggatatgtataaaaattgatttgacattaaactgccagatttgatagcatgtctattctttgctggaattactggaaatgaaccataactgtgtagctcgttactatcttcggttccttatttattattgttacttgctgagttggttgtactcatactacaccctgcacttcatgtgcagatctaggtatttccggacatagcaggtgttgattctttcacacaattgatttttcggagattctgaggtagctgccgtgtttcgcagaccttgcctctccttccctatcttcttatttactatatttggtctcagactattacggactatatttttcagacttgtattcataattagatgctcatgtactcagtgacaccaggttttaggagtggttgtatcggtaattgtaagatttatggatgttatttaaatattatattttcagacttggaagaagttatggttcattaagatttcggcttgcctagtattgagataggcgccatcacaactggttaaaattttgggtcatgacaattacagattctttgtgtaccttcagtttgtaggaatttgatttctattgcaagacttgatgtttctgaatttgatttaaagtttgaaaatggatgttttaatttatataagaatgctgttttttatggttctcgtattcttattgatggtttatataaattgaaactcgatattggtttttccgaattccttcttacttttcaacacaatattgggattaaacgtatttcactagatgatagttcttcttacttgcggcatagacgtttgggtcatatatccaaagaaaggttaaaaagattagtaaagaataatattctttcgaatctgaattttactgattatactatatgtttggattgcattaagggaaagcaaacgaagcatagtaagaaaggtgccacaagaagcatccaactacttgaaattatacacaccaatatttgcggaccctttgatgttccatcttttggtggagaaaaatattttatcacttttatctatgacttttcacgttatggatatatctatttgctgaaagaaaaatctcaagcgacagatgctctcgaagtgtttgttaatgaggttgaaagacaattagataaaaacgtaaaaattattaggtcggatagaggtggtgaatattatgaaaaatataatgaattaggacaatgtccaggtccatttgcaaagttcctcgaggaatatggtatatgtgcacaatgtactatgacaggaacatctcaacaaaatggtgttgcaaaaaggcgtaatcgaacacttatggatatggttaggaacatgatggtaggctaaaattacgtattttagtcacttatttcactctaattcactgcactttattcacatttgagctgtaattggtagtgttttgcacttattgtgtgttttatgccttgtaggagtgattccgagctatgtagatgttatggaatgaattcgagctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccaaggtattaagctgggatcgttttcggagatcgagggccaaggctggacgtcaaaaattgaagtttctctatactctgagaatttcgatccccactttccgcagcgcgtggggcgccgtacttgtgcaatccttcactgtctgtcagaagttagctcactgtatttccccactaatgccctgcatagcgcgtcgccccatgcggcgcgcctgtgcaatacttacagagtaatttttctatttcggctagaagaaggtggttttgcctgggcccggtcctacttagtataaatacatgaaaaacgttttttcctagactttttgcacatattcgaactagggagtataaggaggagttgaaagaatatgagcacaaggatttcatcattcctcactcaagacacgagtttggatcgaatctatgttttcctatacattaattttatttgtgatgaatttctctgtatctatggagtagttctcttaagggtttgatggatttggtgtattgatgattgtttgtggattataactctagttttatgtattaaagcatttttggatgatttaatcattgcatctatagtcacttgttcatgtaattgacagaggcataacttgtgatatctttgcattatattattggttgagttcattaattcttcatagtaattgaaagatgctagttgaatcattgattaaacctaattaggaggatagtggagaaaggttatcctaaagaccaatccactacgtattcttgcatattttcacgtgcttaaattggttcattctgtgaggttaagacttaatcgagagaggagtttttgctgaacatttgaactaataattaagtgaattcgagagactcactaaaatattagaagtgaattacctagagttagatcccaaacaattatcttgcacctatcctatcgacccatattttctcccattgataagttcatttcttacctttgtttcgattgtcattagtcaataactttagcttcttagttaattttagttagacgtcttataatctcaattgttgatcatcttggatagtaaccaaactagaaactacaagaacattgtttaaatccaatccttgtggatacgatattatactatactatatttgattagcaagcataatttaggtgtgtgtttcgagctcgtcaaattttggcatcattgctggggattggcaatcaatattgtttgaaatagtttttggtgctaattcagaaattagattttaattttttttccccttcttttcttttcttttcttttcttttctttttccttttctattttattttctttattagttaacttcttttcaagattagttttgtagtacctaataaattggagaagatactatagattttggactctaaatgctgtgaagatggtatacaaccagacgaagaaaatggttgaagagttagcaactgaacattatcagcggcctgctatgtattttaaatgcggtggaaattatctatgagttgactgtcaaacaggtatgtattcttcttattgttcatattttgagtagtctcactctgtttctagttcgtacaggtatgaggattcatatgggcacaattctgactttggttaggatgaatacccttattataactggaatgaaagcaaagtgagacaaccacctcaatagaagaaaggtagtttagaagctcttatgcataggtacatgaatagtgttgaagaaaggtttatgcaaaatgatgaatttattaagaacctaacaatgcgagtgagctaattagtaagtatacttttaaaaatctcactgtgttgtgatggtgaatatatggaggagataccttgtgagaacgagcctactcaagaggatgagcatcgacagagagagatttccaccttaaagaggattttgattcaactgatatgattgaaaataaaattgtggttgagtgttaagaaacataagaagagttcaaacccacatccaccttccacatttgcaacctttagtagaagagaatgagaaacaaaaggtcttggacatactagataaatatttacttgacctttcttcttttttttcttattctaaccctgatcatgtggattttacttttggggacttacatgaatatgtatggattgattctgtgaaagaatgcaaaaacaaattaaggatcatcatgaacgagcaattcacttcttaatataaggacaagaaagaaagaaaaaatcgggtctagcaggtatcctcagaagaaacggacttaatgagctccacaaaaaatcccaaggagcaaaaacgaggaatgaattcagaattacgggtggagttcataagttctcggaaaagaaaaaaattcagggaagtttcctttcactactaaaaatctgctaaaaaccgaccaactatttctgatcaatgttggtcggtcaaaaaaagcgaccaaaaaccatccaggttggacggaaactggggaaaaaaaaatttacattttttttaaattaaataccgaccaacgttagtcggtaaattgatcaacgaattgacctagctggtcagacaagaaaattttggattaccgaccaacgttggtcggtaatctggatccaattttttaaattttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaccaacgttggtcggttaatgtaggggaagcatttaccgaccaactttggtcggtaattgttatttggtcggtaattgttattttctgcaaaataaccgaccaaagttggtcggttattacgttaacattgatcaaactttcgaattacttttatatttactatctaaataatataaatgtaattcgttaacacttttgtaatacaaaaaatgaataaactaacatatactatatataacatgctatttgtaaattgattcattgacttataacttacttagatgcatcgatgaatattaaaaacaaaacatttgacctatatcgactaatagtaaaaataaaacgtctcgacttatatcgattaatctagctatgccatgcattattagtgatgaatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaagtatgtttgtgtgtgtgtgtatatatatatatataagaacacgaagcgctaggaccacagggtcgggttcttttagggatagacttgggaagatactaattagtatatatactttatcatcaaatatatctatttgtaaattgattcatcgacttataacttacttagatgtatcgatgaatattaatcgatgattcatcaaaacgtctcgacctatatatcgattaatctatgtcatgcattattagtgatgaacgaatgaaaaaagaagttattagcatcaattacaatataatgtatgtgtgtgtgtgagaaattactcacatacttaattataacttagaaaatttacttagatagatgctattataatttattaaaattaaatagttaatataattatttataaagattatgcttatagtttataattatttataataattgcatagttaaataaaataaattcttgtagtttataatattttttttatagtttataatattttaagaaacaaaaacacaaaaaaaaaagaatttaatttttttaaaaaaaaatccgaccaaagttggttggtttttggtcaaacggtcaacacttaatgtaccgaccaaaatgaccgaccaactttggtcggtaattctgaaatcagagaattaaaaaacggggaaaacccccatttctctgaaattttcccctctcttctctatttccctcactcgaaaccttcccctctccatctctatttctcttacataaatctcattccccaccccgcgttgccaccgcccagccctcgccgtcgccgtcgtcgtcgccactgccactgccactgctgcccctctccttctccatctcctaaaaattctaggtttgaattacaacccatttatttattatttctaggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttactaattagttttgttaattagtcaattagttatgaattagtttagtttagggtatgggttgaatttctttagtttagttagtttatgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgaaacagagtatattttgggagttgccttattggaaggataatcttctccgacacaaccttgatgtcatgcatattaagaagaattattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatcatagccacgtggattgcatccatccatgtcacagccactcgggtcacagccacttgggtcacaaccactcgggtcacagccatcggtatcacatccacttgggtcgcatctagctatgtcgcagtcacagggatcgcaaccatcttcatcatcgactccatctattgcaggccttcgcctgcgaggtattagctctgacccgcctacaccgtcttcacatgcctctgatacacatgcttcgtatggtgatgacgaggtagtgcattatgatcgatatggcaggatcatcatagtccctgagggtgatgggtaagtgttattcattatttttgcgtctattgatttgtaacatttttactaagatattaatatgtttttattgttaaattgcaggttcaggccgggtaataagactacaaggataatcaccaatgccatcagaaagctttatgatggcccttatgcgacttggactgattgcccattctcactgaagaagcaaattttcaatcaatttaaggtataaatgttcttttaaacagtttaataatttatatttatgatgtttccatctaatatttaacttttgaaatacaatgctagtgtgtatgggaagaccgctatagcgtggaagtggctacaaatttttgatcataaagctagcaagagattggcggatgctttctcggatgctagaaagaagaacaagaggcctggctggttaattgagaatttgtggaatgatttgcaaaggcaatggcttaccgtagagttcttagagaggagcgaaaaaggaaagaaagctcgcgcatccgagaagggaggctccctgcacactggaggtacgatcagcctagggacaataaaaagaagattggtacgtaattgcttaaattattttacttttctaagtatatctattctgtttcttaactaaattaatttattttcaggaaaagaagtatgggcgtacaatgagtcatgatgagctattcaaggagacacatattgtgaagaagaagaaagagggggatcaagataggtgggtcgaggaccgggcctcgactgcatatgtaagctttcaattttctttaagtattataatttacttttataaaaaatttgaaatactgatttaatttaaaataatatagggtctctaccaaagtaatgtgaaggaattcatccgtagtcatccagctggtgaatcgggtgagccaacccaaccttcggacgaggatgctgaaagaatatggttggagtctgttggcggtccaaaatgggggaaggtatacgggcttcctactaaaaacttccatcgctataagtgtggaatgcgaggaatagggacttcctcacaaggtgagcgacttaatagggagagcctctccgctatgcgggagacagtgacaaagctcacatcagagctagaagcagtcaaggaaagagaaaggcttagagatgctcaattccttggcatgcaagctcagatcagaactctcctatctagtggagctttttcgttgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaaataccccttgacttttatatactttgaactagacaaatagaaccagttttgaactagttgtaattagttttaacttggttttggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgttgttgttgttgttgtgttattgttgttgttgttgttgttgttgtgttgttgttattgtgctgttattgttattaggtgtattggtatgctggcaggtggtgtagctgccaaaacaggcattttatgccaaaattaaacccagaaaaaccgaccannnnnnnnnnnntattgaattcccagaatttaacattaccgaccaactttggtcggtattttgcctgcactgttgagattaccgaccatagttggtcggtaatgtttaannnnnnnnnnnnnnnnnnnnnnnnnnnnnnnnnnnnnnnnnnnnnnnnnnnnnaaattaccgaccaaagttggtcggtttttttcaattttaataattaataaaaaaaacataatttagttaaaccgaccaactttggtcggtaaaattaaattaataaaatatgtttcctaccaaagttggtcggtaagtaattaaacttgtcagatggtcgttttaagctaccgaccaaagttggtcggtaatttccgaccaactttggtcggtaagccattccgaccatcaaaacaccgtccacaccgtaatggtcgcattttggtcggtaattggccataaccgaccaacgttggtcggttcttagcgaatttctagtagtgtttacctcttgctttttaattgtgtatcatggggacattctacaacttaaagtgtgggatgggggatatgttgtatgtatattagttttagtttttattagttgtaatagttggaaaaaattgaaaaacaactataaaaattgaaaataattgtcgattttcccgacgatggatatcgttcgacaggtttcttgagggagtaaagtcgaaagaaaaagacaaaaggattttcttttgttaggtagtgtgttaattcccccttggttttttttgtgtcgcggttcttttccaagagttttgtctgattcgggcatagttagtttttgttttgtagagtagtagaaaaccttgtgctatgatttgaattgaaggcaatatctattgacttgattataccttgagaatagtatgcgtgctttagtgtgacacttaggcttagttttggactcgtgtataagttttatcttaaattctatgatattaaccttgcttaaatgctttgactagagtgtctggatagtacgatcctgagtgagttatgtgtcatgtgtgtatgagattttgtgctattctgtacattgaatttgttgtctagaacttgccccgtgtgtttgcaaagcgaaatagtagttttgttcagtcttggaagtgatttaggcatttctttgttgagccagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgttattacccacatgattgttatatatcttagttaacctctttgagtttgtaatcttgtctctttggaaactacgttgcaagtcttacccatttgtttgattagactatctatttgaaccttgtacctctcgtgagcacttgaatttgtgatgaactatgtaaaggttgatgtgtggggtggttgatttggattttgagtgaaactattgaaataaggagaaaggtgcactgttttaaaaaagtaagagccacttgaattgaataagaaaagaaaaaataggtgtgtgattgtgtaaaagctccttgatagtggtaacttgatgtaattatgtttaaagaagtagggagttaatgtatattgatgtgaaggtagagttttggtttggcataagtgtggggttttgaacaatgaaatatatgtattaaagtgcttagggaggtgtagtcactctaatatccaaatatatcctacccatcccacagcgtacattacaaccaattaaagtcttacttgatcattgactgataagctcaattagtagagtagtacactacgggcaagcatatggtacgtcttttgtggcatatgaatgttgtttctgagagtgagtgaattctttctattttaagttcctagttgttcttaaatttcattgcgtgtataactactctctattattgtgtgagggtacttaattcatgaaggaaaggtaattcttgacctctgtgttagagtaagtgagcgggttatgaaaaatgcatggtgcttttgagtcaaatcttgaggtgaagatgttacggtattgtgcttaatgtgttttaaatattcttggtgtgataagttatgagattgttttcaaaaggtcatgtttatataacgtgtagtttgattgctcgaggacgagtaatgatttaagtgttgggtgttgatggtaggatataattgcgtattttagtcactcattgcactctaattcactgtactttattcatgtttgagttttaatttgtagtgttttgcatttattatgtgttttatgccttgtaggagttattccgaactatgttgatgttatgaaatgaattcgaggtatttggagctttgaagtctgagtaaaaacctaatggattaatccgggatcgtgtttgggggccgaggaccaagtctagacgtcaaaaaccgaagtttggtctgtactctgagaattccccactgccgcggagtgtggggcgccgtgcttttgcaatcctctgatgtctgtcagaagttagctctctagatttccctactaatgcccctcatggagcgtcgccccatgcgacacgcctgtgtaagttttacagagtaattttcctatttcggctagaagaaggtggtttcgtctcgacccgacctacttggtataaatacatggaaaatgttatttcataaacttttgacacatattcgatctagggaggctaagaaagagttggaagaacacgcgcacaaggatttcatcattctttcctcagtcaagacgtgagtttggatcgaatcaatattttcatatactttaattttatttgtgaggaatttctccatatctatggagtagttctctttagggtttgatggatttggtgtattgatgattgtttgtgaattataactctagttttatgtgttgaaacatttctggatgatttaattgttgcatctatattcacttgttcatataatcgagagagacataacttgtgatatctttgcattatattgttggttgagtttattaattcttcttagtaataaaaagaggctatttaaatcattgattaaacctagttaggatgataatcgagaaaggttctcctaaataccaatccactacgcattcttgcatatcttcacgtgcttaaattggttgatcttgtgagtttaagacttaatcgggagaggagtttttgttgaacatttaaactaataattgagagaattcaagagaatcacttaaacattataagtgaattacctagagttagatcccaaacaattatctcgcacctatcctctcaacccatattttctcttattgaggtaagtaacacttctaaacttggttctaagggtatgaatccccgaatttggtatgatataaattgtttggaagtgacacacacaataggtgatgaatatgtagacgtgcaccacataaattatgtcttgaataaatcctgtgaagttataaaattaaagaatcatgttattatctaaacattctccacgtgttagagaaattgagttgaggctcctattaaagatcatgtttaggctacgtgccaatattttgggacccatggggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatatacatttcacactcagtaataattgtccattgtgaggatatttatgggatcgatctgcgcgacacagcatgccataatggctttatacattattattatatggatcggggttgcccgcctacagcaggccttataggctttactattatatggatcggggttgccctcctgcagcaggccttataggctttactattttatggatcggggttgaccgcctgcaggaggctttattattatacggatcgggactgcccgcttgcagtaggccatattggctttatatcacatttgagctgaaggagcccctctggagtctatatacacccccgtgagcgtagatgattatatatatattcgggatggacttcccaaggcatggacttgccttacttacgatgattatatatatattcgggatggagtttcccagggcatggacttgccttacctatttatattgtaatgaatttacctagacatggatcttgtccatatcatttacatttggggataaattaccccagggctggattggctttatacgatacggtgtgattgactttcagtcgatgtgtatatatatacgggttggaacacccctgggctggattggccataaactataccgagtgaccgaataatttgtgatccgtatttacatgagatctttcaattgggatctcatattcctcatatcatgcagtattgatctatttctcttgtaccgagtttaactattgaacttgaaagcatgcctatattttgtaccattatttatacttgactgtacctacgaagctcgtcactactttcagcccaaaggttagtcttgttacttattgatttagttgtactcatactacactctgcactttgtgtgcagattcaggtgctcccggatacggcgactgctagatttcaaagttaatcctgttggggactatcaaggtagctgcttgacgtccgcagacttgatttccttcctgtttaattattgcattgttctatattttcagacagtgattttatcagtcagactttgtattcatattagatatttatgtactcactgacaccgggttttgggagtgttatatttgtatttgtgaggtttctttcgctgaatttaatcactttgtttttaaacataaaagatatgggagtatattgagaatgtcagctttcctagtattgagataggcgttatcacgacaagtgagattttgggtcgtgacaagttggtatctgagctctaggttacataggtctcacgagccatgcgcaggtttagtagagtcttgcggattggtacggagacatctgtacttatcttcaagaggctgcagaacccttaggaaaatttcactttcttgtattctatcgtgcggaattgattcagcttcaaacataactctttgaattccttccatgcattcgtatgcgcacatgagcgctcggtatcagttgtgcatcgctgacttgtgattccatgaacgaggttcgagatgtgtattctgtattttggtaatggtccagtctggaggacttgaggccagatttagaccgcagcttaggctctgtagcttcagttgtaacttgtatatttgggctcatatgtccagtaatgtccctacgagtgaaatttgtggctcgatgagtagtagaatggctttgtgatgagtatgatgtaactacaggatgtgtgaaggcgatttgaatgtgacgagaagtgtttccttgaaatgtaaaggaaggccattggaggctttattttcgttttgatgtgacgtacaatctcgagtgtgaacgttttgaaagatctttcacgttgttaaattttgggaaaaaatcaaattcttgtgtctagttaatgagtctggactcagaaagattaagtaatttcatagtaattgtggatgcgaaagggtataacaagatgccaatttgagactaagcaggtgggttatatcctgcggagtaatctatgtaggtatgtaccttatgaagtgaatagagagtttcttttctaccagcggggcgtatgtgttgagacttgaatttgaatctggttgagaaagttgacgtgagtgttaagagaatgaatgcgagattagcgtatgattagggtattttatggttggtgtgtcttgagcttgagaataattttcgttgaactgactgcggtaataaggcagtaataaagcataggtattgtgagttatcaaatattttaatctatagctttgagccaaatggggaagcctgttattgacaattcaattcatggttatgcgtcaatttgttttttgtttggtctgaagtatacttgggaatcagagatgacttgcagagatggagttcgagaatgaatcgagtaaggaaatttctggatacgggttatattgtgctttatgagtatatgaaaatcgtgggatgagtgagttgttatttgtgaattatgcaatgcgcacggagtatgaattttataggtggtattaaagtagagttacttctttgagtgtaattgtgctgatggggcacgtgttttttggcccattttggccatgtaatgtggatttgaacaaagggggtgactctcgagaaagttctaatggattcgagattaatatgtaacaattgagaatttttggcggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatggctaaaatctgagatttaagttggatggtgtcgagacttgtggcatttttatatcattatagattttatatttcggtattgggaaggtgaatgaaatggtcttagacccaaataaggtatttttagagtgggtgtttcggttgtggtatttatagggataattatgatgtggtaagactctacagatgttttggtggaaatattcttgggttttggtgacctgcgtggtttggtcgagttagaggaatttagttttaatagcttagttatgtgtagatggatttcaaagtgttcttgatggtttctaccatggtttgaaccaaatattttctactggtgtgggaaacgtgttgtgtattgtgatttcctcctggaaagaagcaagaggaaggtttgtaactaaccgagtatgtaatttgctggtgagtgagagttgataatgggattcatgtgcctatcacatgatagcataatagatgtggtgtgttgtgcgggattaggatttacatgtacaaggtgacagttcagtcttgaaaagaaggtaacgaatcttggacatcatggtcagtttcagatatttcgatgaatgttataactgctcggtaattcctgcgaagggtgcgcatttcagaaggcgtgttgtgttttgacttacggatgttcatcggtattgcagtactcacctggttgatagactgctggtattcaaattatttctatgtggcacggaagaattatgagagtattcctcatgggattatcgtgaatacaagatatgttagtcattttagtgctggagttgggattagttacggtgattcatgtgttcgatggatttggagactgggagttctcagaggcatattgttttagggttacggcctgtttgaggtgagtattttattttaactcagtggaggcactagttgcctttgtgatgactacgcactactagtgcgtatatatatgtgtgaggtttgatcccatgtgctagcatcggggcaattattcagattcgggaaaatgtttaggctattatatccctagagttgatggttaagcgtaacgttatgacatttctcttattcgtacctttattgagaactatctgggttatacttgagttacaaagaggctaattgcctgaataaactgggtagttactatttctgcgttaaatgcaaatttgagttgtgatagcacactttgcacatgcctgctctaaggcgtgttatttattccagcccaggagcatgtgaatcctactttatttatcatatacatgtgtacttatttgattgctcatgtatgatatgcttggattagaggcctgtgaccatgccagaagaattatgttattggaacgtgagttgtccgtgcggatccatatactgatattattggcacgtgagttgttcgtgcgcgtccagatattgatactatagcacatgagttgtccgtgtgagtgatgttaatgtgagctctaaaagagctggtactgttattaaatttgtgtgtcttggttctactatatatataatgatcttatagcattacaattgtggtggtgcttgttgaacttacaataacgttctctactttgagacatcttccattttggggtacaaggttggcgcgattgtggattggattgtattgctgtgacatgtcaatgagatagttttgtttaataatataagatcattggacctagaatgggtactatcaggtttgattacagcatattgagaggataatattgaaagtcggcttacgagaagattgtggttctgggtagggcgaagagagctccatgactagttgatttgatgagtggttatgagtttttgattgtttcttttattatcaacagtataccaaggttgtgggatgaagtttggttcgatatggggtttaatactagtacttggttggttttggagcagttattatgattaggaattatgctacgagtatgcgagttgtgtagtaggttatgtgattgtatctgggattatggttatggttggatacagcttgttcaggtttatacaatgggtaaatgtgggattcaggtcttgaaaaaaattatggatgttaggaatatggctccaagattttttggctaaggttaaattaatgattttcagttatgttgtgttttcaagcctatacaagttacacataataggatggcgtgggatcaccccaagtatgtgcgtggtagatggaatagtgatgtgatggcttggaatcaactctaggcacgtttgaggatgaacgcatatttaagtgggggagaatgtaacgacccggccggtcgttttgagtaatacaaccctgtttatccgtttttgctttacagttgttttatgacttgctgggttaattggttcgggtccggtgaggttttggaatcaattgaaatacttagttccaaggcttaaagcttaagctggaaaagtcgatcggatgttgacttaggtgtaaatgacctcggatttaaatcctgataattccaatagctccgtacggtgattttggagttaggagcgtgtctgaaaaattatttggagggccgtaatggaattaggcttgaaatggcaaaagttgaatttttaaaagtttgaccgaggggttgactttttgatatcggggtcggaatccgattctggaaatttgaataggtccgtaatgtgaagtatgacttgtgtgcaacatttgaagtcattccggattggtttgatatgtttcagcacaagatatagaatttgaaagttcaaagttcatagcttttgatatgaggtgcgattcgtcgtttcgatgttgttaggtgtgatttgaggcctcaagtaggtctgtgttatgttatggaacttgttggtatattgggacaaggtcccgagtgactcgggtgagtttcggacgaggttcggcgcattttggaagttttggctaaagccggaaattttctggttctggtgtgatcacacctgcggaaatggactcgcacgtgcgatggtcgcaggtgcgacaaggcagccgcagaagcgaagggagcaaaagcagcccaacgtgcgcagaagagaccttcgcaggttcgagcttcgtccgcaaaagcaaatgtcgcagatgcgacttttccaccgcagatgcggaagtcgctgggcataagcgttaaatttggggtttcgccatttttcaccattttcgaattttggagattcggtttgggcgattttggagaggaattttttcacacaactttgggtaagtgttcttgactcccttgtgattatattccatgaattaatcctcattttcggcattagaatattgatttttcaagagaaataacaagaattttttacaatttcataaaatgaattttcgagattagaacaccgtttaagagtcaaatttgagtgaaatttgtatggttgaacttgtaattggatgggttgtcatattttgtaagttttatcggattccgagacgtgggacccgcaggcaatttttgagctaaatttcggattttgttggaaaattagtattttcttatggaattaattccaataaattttattgactgtatcgaataatttatggctagatttaaggcatttagagacaaactgacaaggcaagggcctagcggagtaaagaattacacggtttgaggtaagtaacacttctaaacttggttctgagggtatgaatccccaaatttggtatgatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgaatattctccacgtgttagagaaattgagttgaggctcctattaaagatcatgtttaggttacgtgccaatattttgggacccatggggtcgtgttgcttttgtattaatttttaaaaaaaatatacatttcatactcagtaataattttcctttattaggatatttatgggatcgagctgcgcgacgcagcaggccataatagctttatacattattattatatggatcagggttgcccgcctgcagcaggccttataggctttactattatatggatcgagattgcccgcctgcagcaggccttatatgctttactattttatgaatcggagttgtccgcctgcaggaggccttataggctttattattatacggatcggggctgtcggcttgcagtagtccatattaactttatatcacgcttgggcttaaggagcccctccggagtctgtacacacccccagtgagtgtagatgattatatatattcgggatggacttcctagggcatggacttgccttacttacgatgattatatatatattcgggatggattattccagggcatggacttgccttacttatttacattgtaatgaatttacctagacatggatcttgtccatatcatttaccccagggctggattggccttatacagtacggagtgactgactgtcagtcgatgtgtatatatatacgggttggaacacccctgggctggattggccgtaaactgtaccgagtgaccgaaaattttgtgacccgtatttacttgaggtctttctactgggatgtcatattccttatatcatgcaatattgagctatttcatttgtaccgagtttaactgttgaacttgaaagcatgcttacattttgtaccattatttatactggattgtacctacggagctcgtcactactttcagcccaaaggtcagtcttgttacttattgagttagttgtactcatactacactctacaccttgtgtgcagatctaggtgctcccggatacgacggctgctagatttcgaagttaattctgttggggactatcaaggtagctgcttgacgtccgcagacttgattcccttcctgtttaattattgtattgttctatattttcagacagtgattttatcagtcatactttgtattcatattagatgttcatgtacttagtgacaccggattttgggagtgttatatttgtatttgtgaggtttcttccactgaatttaatcactttgtttttaaacataaaagatatgggggtatattgagattgtcggcttgcctagtattgagataggcgtcatcacggcatgtgagactttcggtcgtgacacttgcttacctttgtttcgattgtcattagtcaatagctttagcttcttagttaaatttagttagacatcttataatctcaattgttgattatcttggatagcaaccaaactcgaaactacaagaatatgtttgaaatccaatccttgtggatacgatattatattatactatatttgattagcgagcataatttaggtgtgtgtttcgagctagtctaatttttgcaacgttgccggggatattatactatactatatggatatggttaggagcatgatgagtaattccccattacctaaatcattgtggatgtatgctcttataaccactgtatatttattaaatagggtttctagtaaggtagttctaaagactcattttgaattgttgatggaaaggaaacctagtttaaggcacttgcatttttggggttgcccagcggaagctagagtttataatccactaaaaaaattagattctcgaacagtaagtggttactttattggttacccagagaaatctaaagggtatgtgttttactgtccaaagcatagttcgagaatagttgaaacctggtaatgcaagattcattaagaatggtgaagttagtgagagtgttgaaaaacaaattgtgaaaataaaagaggtgagtgtcaatattccattacccacgaatgtgcctacttccacacaaataccaaatattattcaagttgttgaagagcactttgacaacaacaagcaacatttggatgaaaaacttcatgagaaaactaactcacaaatatgtgacacaaataaaccataagaaatgccattaagaaaatctcaaagagttggaaaatcggctatttcggatgattacgtggtttatttgcaagagtcagtttttgacattggtcttaataaggatccggtttcatttttacaagccatagaaagtaatgagtctgacaaatagattgattccatgaaggaagatttaaaatctatggaatgcaataaagtttgggatctcgttgaattgccagaaagttataaaagaatcgggtatagatggtatataaagtttaataataccataacatcttttagatttgtgaaaaataccgttgatcggtgtatataccaaaagatcagtgggagcaagtttatatttttagtcctatatgttgacgatattcgacttgctgctaatgatttaggcatattgcgtgagactaaagattttctctttaagaattttgaaattaaatatatgggtgaggcatcctatatgataggaatagatatattccgtgatagatcacaaggattactggaattgtctcagaaaggttatatcaaaagcgttctagagagatttaacatgaacaactattcagcaggaatcgttccaattcaaaagggggacacatttagtctcatgccacgccctaagaatgatgaagaacgaaaggaaataaaattagttccttgctcttctattattggtagtctgatgtatgctcagacttgcccaagacaagatatgtgttttgctatcggaatgctgggaagatatgagagtaacccatgaattgatcactggaaagctgcaaagaaagttttgagttacttgaaaggaacgaaggattacatgctcatgtataggggatccaagcatttggaagttactggatacttgaattcagattttgttggatgtattgacactagaaagtccacgtttggttatttttttcaattagatgaaggagcaatatcgtggaagagtgccaaacagtctagcattgctgcaaccataatggaagcagaatttttggcatgttttgaagccacaaatcatgcattatggctgcgaaactttatttcagggctaggggttattgacaccattaccaagccgctgaaaatttattgtgatcattctgtaacagtattcttctccaagaacgataagtactccaatagatgtgccaaacatataaaattacagtactttaccgtcaaggaggaagttcagaaacaaagagtgtcacttaagcatattagaattgatctcatgattgcagattcgttaacgaaaagtttacaaccaaagatatttaaagaacatgtatatagagtgggtcttgactgtaattatgattgatgtatttatggtgttttgacactctaagctcatttatgtgtttctgatatacattaataattttttatttctcataatggcgtacacattaatgttttgagatattacaggataagtcacaacgagatattattttggaccataatattttatagcttatggacttggtatgatgagttgctaatgttatagtatatggaagggagtatgtagacaaaatatgtataaccgccataactcatatttagtagtttatcgtattatggtatttatgatggacattatagaagagatttgtttatgcgcaactaatgtttatattattaaatattaatattatgtgatttttgggccaagtgggagaatgtaagtttttttttacgtgtgtgtggcccaatagatttaaggcctgtaagtaatatttaataaaagacaaatctggttcttctgatcgattacttgatggatgcaccggattaagtaagaacctttatagattggtcatctccccacccattagggtcaccacctattctattcttctttttcatcactaaagtcagtaataacgaaagttagggcaagaggcgagataccaatttagcaattaacgcttccgcttcatgctaatggcttccgcttcaggtattttttttgcatcaattatatataagattatcatattcaagatcctggtatgaattaaagtttatgtttacaatatgtactagtagtatcctcatctttttatcactactattattaacagtaggagtaggaataacagtatgtgttgataatacctccgtcattatctttataattagttaagaaaaaggtgttatttttattttgcaatttatttttgaaaatattacttagttaaggtagggcagtaggttgtatctttaatagaatattccagtcatataatacgtttaataacgacaaggtcatttgtataagaaaacatttaatggattagcataaatgattaatttgataaaattcagggatatatttggagtacttttacactaatgacaatacacaaagagtgtgtttggtacgatggaaatatttttcggaaaatattttttattttccactgttaggctgaacaaaatagtttggaaaatattttcctacaaatcacattttcttgaaatcggatgaaaatgacttcccgagaaaaagttaggaaaatattccaaaaacatcacctaccctcacatgtaaccccaacccccttcaacttcaatttttgtttttttttcatttttctgcgccgcccacccccaaccctgtataccctcccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaagttcaaaatcttacgagttccaaaattatgagttcggaggtttatgtgtttggaagtttacggatataaaaattatagagtttacgggttaaaagtttgcgggtttgaaagtttagcggttcaaaagtttatgaaaattgtgggttcagaaggttattggttttaaagtttatgacttcatgtttattgtatctaaattatttatgaatactcttgaaagttattttcgttaatgacctggccggtcgttacgagtattataaccccgactccccaattactgctcaaattgtgatttacagttgttatttggctttcaggggtaattggttcggtcccggtgaggttttggaatgatttgtaatatttagttccaagctttataacttaagttgaaaaggttgaccggatgttgatttatgtgtaatgaccccgaaaaaattttgctaaggaaattaaggtttcgtggtgctgaactaggctcagacgttttgagttgaacaagctggtgagcaaaggaaaattttggaataaataaatacatgtctacggcccactatgcgatcgtagaatcactccacagaccgcataatggccgcagagtgaagcagattaggccgagtttggagatcaggtttgcggcacattgtgcaatcgcataccagttctatgatgcattatgcgaccgcagaactggtatgcgggctatataatgaccgcagactgaagtagtgttgcccagttctggagggcctatttgcgacccattatgtgggccgcagaagcattatgcggtcgcatagctgaccgcaaaatgtgtttcagagcttcatttttctggttttataaacctgaccccattcttataaaacactattagggtcattttgaagggtttcatgtgatattttagagagaggtgagagcatcttagagagagaaaatgaagacctagtcatttgttgtaatgacccgactggtcggtttgggtattacagccccgttccccaatttactactcaatttatgctttacagttattatgtgacttgccggggaaataggttcgggtccggtgaggttttgaaatgaattaagacacttagtctctaagataaaaatttaagttgaaaagattaaccggatgttgacttatgtgttaacaacaccggaatagaactttaatgattccaatagctttgtatggtgattttggacttaagatcgtgtccaaaaaattaatcagaagtccgtggttaaattaggcttgaaatggcttaaataaaattttaattttgaaagtttgaccggggagttgactttttgatatcggggtcagaatccgattctagaaatttgaataggtccgttatgccatttatgacttgtatgcaaaatttgaggtcaatcggacttgagttgataggtttcgacatcgaatgtagaagttgaaaattcttagtttcattaagcttgaattgtgggtatgattcgtggttttagcattgtttgatatgatttaaggtttcgagtaaatttgtatgatgttttagtacttgttggtgtatttggttgaggtccccggggcctcgggtgattttcggatgattaacagatcaagaattggagttgggaggttgctgaagctgtagcccctctggagtgatcgcacatgctagggtcttggccataagtgcgatgccgcatgtgcggagttggaggatgtcggcagaggtcgcaggtgcgatgggatttctgcacctacaattgcgcagatgcgggcagggatctcagaagcagaggctcgctgggtaagtgaagtccgcagaagcatgtttctttccgcgaaagcggatgcgtaggtgcgagcccgggctccgcaagtgcggaaatgcctgggcaatgttaaaaatgagggtttccaagatttttctcattttggagctcgatttggacgactttggagagggagtttttcacacaacttggggtaactatcattgactcccttgtgattatatttcttgaattaatcttcatttttggtgtattattattgaatctgcaagagaaatcgaacgaaatttttataattccataaaatgaattttcgagttttgaatatcgattcaaagtcgaatttgagtaaaattagtatgattgaaatcgtaattggatgggttgtcgaattttgtgagtttcgtcggattccgagacgtgagccccactgtcgatatttcgagcggagttaggaattgttttattaattgataaattgcaagcattagagtgtattttgattaatttacacgttgtttgactaggttcgaatcgcttggcatgtaattgaggagatatgaaggtgtttcgaggttgatatacgcggaatggaatttttggagtattgtttagcttgctcggcattagattcgtcttattcgaggtaagtaacacttctaaacttggttctgagggtatgaatccccgaatttggtgttatataaattatttggatatgacgcacatgataggtgacgagcatgtggacgtacaccatagaaattgtgacttgaataaatcctgtgaagttctaaaattaaagaatccacgtgttaagaaattgagttgagactcgtattaaatatcatgattacgctacgtgccgatatttttggacccacagggtcgtgttactgttcaatttaattatattgaaatatatatatatatttttcatactcagtcatgttcattcattttgaggatatttatgggatcggggctgcccgcatgcagcatgccatatcgggtttatatatatatattatatggaacggggctgcccgcctgcagcagaccttgtaggctttatcattatatggatcggggctaccctcctacagcagaccatattgactttatatcacgcttgggctgaaggagcccctccggagtctacaccccccacagtgagcatatatatatatatatatatatatatatatatatatatatatatatatatatatatatatatatatatacaggatgaatttcgcagggcatggacttaccttacttatttgtattcatgatgaatttttctggctatggatcttgtccgaaacatttacatttggggatcgtgcctacatttctgtaccgttatttatatattggactgtactgcggagatcgttactactttcagcccagaggttagtcttgttacttattgagttgtttgtaatcatactacactctgcgcctcgtgtgcagatccgggtgcttccggatacggcgactattagatctcgaggtgttatcagttaaagactatcaaggtagcttcctggcgtccgctgaccctgactctctctcttcctttcagttattgtactgttctatatttttaaatagtgtttttatcagtcagactttgttatcatttagatgcgcatgtacctagtgacaccgtgttttgggagtgttttatatttttcaatggaatttaaatattatgttttcaaacgtgaagaaattgagttttatggagattgtcggcttgcctagtattgtgataggcgccatcacgacaggttaggattttgggtcgtgacaaattgctatcaaagcctaggttacataggtctcacgagtcatgagcaagtgtctagtagagtcttgtcgatcggtatgatgacgcccatacttatctttgaggggctacaaggcattttaggataaacttttcatcattatctccttattgtgcgggattgattcggcttgaaatataaatttttgaattccttccatgaattcgtgtgcgcatgtgagcgctcagtatcagctatgcaccaccgacttatgattctatgaacgaggtttgagatgagtattatgtgttttggtgatggtccagtctggagaacttgaggccagggttggaccgcagcttaagctcggtagcttcagttgtaacttgtacatttggactcatatgtccggtaatgtccctaggagtggaatttgtggctcgatgagcggtgaaatggctttgtgatgagtatgatgttgactgcggggcgtgttaagatgatttgaatgtgacgagaaatattaccttgaaatataaaaagggccattgggtatttgattttcattttgatgtggcgtacagtctcgagtatgaatgttttgaaggacctttcacgttgttaaattttggtacaaattaaattctcatatcttgttaatgagtttggacttagaaagattatgtgattgcatagtaattgtcactgcgaaagggtataacaagataccaatttgaggctaagcaagtgggttatcccctgtgtagtaatctatgtaggtgtgttccttataatgttgagtgaagagtttgttttcttccagcggggcgtatgtgttgagatttgaatttaaatctggttgggaaagtttgcttgagtgtcaagagaatgaatgcgaatttagcggatgattgaggtatgtttatggttggcgttgcatgagcttgagaagaattttcgttgaactgattgtggtattatggcaataatagagtatgagtattgtgagttatcgggtgttttaatctatggctttgagccatgtgggggagcctgctattgacaattcaattcatggttatatgttaaattttagttttggtctgaggcatacttgtggattacttatgacttgcagaggttgagatcgaggatgactcgattactgaaattcctaaatacggggtatattgcgctttatgagtatatgaaaatcatgggatgagtgagttgttatttgtaaatgatgtagtgcgcacagagtatgaatttgatcggtggtgttaaggtatggttacctctttgagtgttgttgtgctaatggggcacgtgtctttcagcccgtttgggcggtgaaatttagatttgagcaaagtggatgactcccgaaaaggttataatgggttcgagatttatatatagcaatcgataatttttttggatttgtgtatggatagaatctgagatttacaattaatggtgccaggcttgaggtaattttgtatgactatggattctacattttgtataagaaaggtaaaaagaacaattttaaattcacataaggtattttcagagtgagtgttacggttgtgttatttatggaggtgcttaagaagaatacaatgtcttatgggccttaaggcagtgtgattttatgttaggatgtcttgtattgagctttgggtaaggatcatggaattttgacagagaaaagtgtcaacttgagggtaattcagaataaactcagagaaaataggatgactgggtagtaggttggaccagtatggtatgattggtacttttagtacctatgaagtggtgaggctctacagatgttttagtgaaaatattcttgggttggtgacctgcgtggcttggtcgagttagaggaatttagttctgatagcttggttatatgcaaatggatttcacagtgttcttgatggtttctaccatggttcgaactagatattttttaccgttgtgaaggacatgttgtgtatcgtgatttcctcacggatgagagcaaatggaaggtttctaactaaccgagtatgtaatttgctggtgactcagagttgataaaattctcgtgcttctcacatgattgcatgatagatgcggtgttgggtgggattaaaatttacatgtacaaagtggcagttcattcttgaaggtaagttcccaaattttggacaacatggtcagatttagatatttagatgaatgttataactgctcggtaattcctgagaagggtgcgcatttcagaaggtgcattgtgttttgacttacatatgttcattgatattgcggtactcatctagttgatagactgttgatattaaaattattgctatgtgtcacgaaagaattatggaagtattcatagtgggatgatcgtgcatgaaggatatgatagtcattcgagtgttggagttgtgaccagttaaggtggtttatgtgttctatgaatttgggggactgggagttctcataagcaaattatttcaaggttgcggcttgtttgaggtgaatattttatttaaactcagtggaggcactaattgtgttaattatttatgatagttgcgcgctacgagtgtgtacatatgtgaggtttgagccatatgcgggtatcagtgcaagtattcatactcggaagaattcttaggcaaagatatgcctagaattgagtgttaagcgtaaagttataatgtttctcatattcgtacctttgttgggtactatctgggctacacttgagtttacaaagaggctaactccccgaataaattgggtagttactatttctgctttaacttgcctatttgagttataacagcacactttgcacatgcctactctattgtgtgttatttatactagtccaggagcatatgaattttattttatttatcatatacatgtgtacttatttgattgctcctgcattatatgcttggactggaggcctgtgaccatgccgggtaattgatattattagcatgtgagttatccatgcaggtccaaacatttatattattggcacgtgagttgtccgtgcgggtccaaatattgatactatagcacgtgaattatttgtgtgtttgatattaatgtgagctctaaaagagttggttaccgtttatagattcgtgtgtcttggttatactatatatatgatgagcgtatagcattgcaattatggtggtgcttgttgaacttgcaatacaattctcttctttgagatatttttcatttttgggtacacggattgcgcaattgtgacttgagttatattggtgtggcatgtctgtgggatagttgtgtttaataatatatggccattggacctagaatgggtactatcaggtttgattatggtatatttgtgaggatgacattgaaagtcggcttagaaagtgattattgttctggttggggcgagaaagctccatgacttgttgatatgataaggggtaatgagattctgcgtgtttctttaataatcaacattgtacgaaggttttggaactaggtttggcttgatatggggtttaatactagtaccgggttagtttggagtagttactgtgatcgagaatggaactacgaccatgcgagctgtgtagtatgttttgtgattatatctggggttatggttatggtttgacacagcttgttcagagtcatacagtgtgtagatgtgagactcgtgttttgaaaagaaattctaaatgttggaaattgaattccaaggtttatgggctaaggttaaattaatgactttcaattatgttgggttatcaggcctatataaaatagggtgacgtgggatcaccctcgggtatgtgcatggtatggtggagcagtgatttaaaggcttaggaacaactcttggtacgttcgaggacgaacgtatgtttaagttgggtattacaacccagttcccctatttacatctcaaattatgctttgcatttgttatgtgactttccagggaaattggttcaggtccggtgaggttttgaaataaattcagacacttagtatccaagattaaaacttaagttgaaaagattggccggatgttaacttatgtgtaaacaatatcggaatagaactatgatgattccaatagctatgtatagtgattttggacttaggagcgtattcggaaaattatttggaagtccgcaattaaattaggcttgaaattgctaaaatagatatttaagtttggaagtttgaccagggatttgactttttgatatcgaggtcagaatctgattctggaaatttaaataggtctgttatgtcatttatgacttgtatgcaaaatttgaggtcaatcggacttgatttgataggttttgacatcgaatgtagaagttgaaaaattttagtttcgttaagcttgaattggggaatgattcgtggttttagcatttttggatgtgatttgaggtttcgactaagttcatataacgttttaggacttgttggtgactttggttgaggtcccgggggcttcgggtgagttacggatgattaacggatcaagaattggagttgtgaggttgctgaagttgcagctcctctagtatgattgcacctgcgagggtcttggacacaagtgcgatgccgcaggtgcggcagctcgagcactggtgctgtcacgacccaaaattctaaccagtcgtgatagcacctatctcaatactaggcaagccaaaatctcaatgaaccacaacttctttcaagtctgaaaatataatattcaaataacatccacaaatcttacaattaccgatacaaccactcccaaaacattgtgtcactgagtacatgagcatctaattatgaatacaagtctgaaaaatacggtccgtaacagtctgagaccaaatatagtaaataaggagatagggaaggagagacaaggtctgcgaaacacggcagctacctcagaatctccagaaaatcaactatgtgaaagaatcaacacccgctatgcccgggaacactggatctgcacacgaagtgcagggtgtagtatgagtacaaccactcagcaagtaacaataataaataaggaactgaagatagtaacgagctacacagttatggttcatttccagtaattccagcaaagaatagacatgctatgaaatctggcagtttaatgtcaaatcaatttttatacaattcttgttcatgaaattcgtatatcaacaatctttcagagatttcacaacaatgacagatagcaactaagtgcaacaacaaatgaaaatcaagtacaacctcttaggannccactgggctcccaaccctcatcactccctgggctcccagccctcatcactcactctcaatgggtacccgcgctcactggggtgtacagactccggaggggctcctacagcccaagtgctataatctccacggataactcacgtgccataatataaatatctagatccgcacggccaactcacgtgctatagtataatataatgattcgcacggacaactcacgtgctatagtaaaatataaggatatgtacggccagatcacgtgttgcacggacaactcacgtgctatgatatcaatatctcacaatcaggccctcagcctctctcattcataaatctctctagtctctcgggctctcattaaccatgaaatcatcccaaacaacaatgatatgatgtatcaataataataacagagactgagataaaatatacaagtaaatacatagactgagtacatatagcatttagcaggcaattcaacaagtacgcgacctctgcgggtcccaacagtactatcacatagcctaagcatgatttctaacatgatttacagtcaaattttatcaacacatagagagcatatagctaacaacaaattattcaactttacagttttccgggacggaccaagtcacaatcccctcggtgcacgcccacacgcccgtcacctagcatgtgcgtcacctccaaaataatcacatgataccaaaatttgggggtttaataccttcaggaccagatttaaaactgttacttacctcaagccgtgaaattcttattctacaatgtcctttcctcgtgaattggtctccaaacgtctcaaatctagccataaataattcgtttcagtcaaattaatttattggaattaattccataagaaaatgctagttttccataaaaatccgaattttagctgaaaaatcacccgtggggcccacgtctaggaactcgacaaaagttataaaattcgaaagcccattcaaccacgagtctacccataccaattttaccaaattctgacctcaactcgatcctcaaatctacaaatcttatttccaaatttctaagttccaaaatcatgtaatctagtcggattattcgatgataattcaatattatggagtagaaatgatcacaatggacttacctcaagttgttccttcaaaatatatcaaaattcgcctctcctcaagctccaatttgtcaaaaatggcgaatgggacgaagtccatgtttatataattctgccgagacaacctcgattctgcctcgatcttgtccttctatcgaggtcctcgatcctgggcctcggtcctggccctcgatcctaagcctctatcctggccctcgatcctaagcctcgatcctggccctcgatcctgggcctcgatcgtggcttcgatcctgatcctcgatcatggtcctcgaccctagccttcgatcatgtcttcgaccctgccttcgaccgtgaccctcaacactgggctcgatcatggcttcaatcgtggccctcgaccctgggctcgatctgggctcacatctgggctcgattctgagagatttctgggctcgaatctggcacaagaaatttccaacagaaggaaattgcagcagctgttgtagttcaatattttatccgttaaccatcagaaactcacctgaggccctcgggacctcaaccaaatataccaacaagtcctaaaacatcatacgaacttagtcgaatcctcaaatcacctcaaacaacgctaaaaccatgaattacgccccatttcaaggctattgaactttgaaatttctaatttttacaaataacgccgaaacctataaaatcatgtctgattgacctcaaattttgcacacaagtcattaatggcataacatacctattaaaattttcagaatcggatttcgaccccgatatcaaaaagtcaacccctcggtcaaacatcccaaaaattcaactttcggcatttcaagtctaattcctctacggacctccaaaaattcttccggatacgctcctaagtccgaaatcaccatacggagctatttgaattatcaaaattcaaatccgaggtcgtttacacattagtctatatccgttcaatttttctaacttaaaatttttaattatgagactaagcatctcatttcattccgaatttcctccggacccgaatcaactaacccggtaagtcttaaaacaactgtaaagcataaattgagcagtaaatgggggaacggggatgtaatactcaaaatgaccaatcgggtcgttacattctcccccacttaaacatatgttcgtcctcgaacgtgccaagagttgtttccaagcaatcaaataactattccatcttaccacgcccgtacccgggggtgatcccacgtcatcttattctatataggcctgtcaacataacacaactgaaaatcattaatttaaccttagcccaaaacttggagcccaatttgtaacacctagaattctttccaaaatctaaatctcacatctacaccgtataagtctgaacaagttatatcaagccatagccataaccccagatataatcctattacatactacacaactcgcatactcgtagcaccatttctgatcacaataactacnnnnnnnnnnnnnnnnnnnnnnnnnnnnnnnnnnnnnnnnnnnnnnnnnnnnnnnnnnnnnnnnnnnnnnnnnnnnncaaaaccaaccaagtactagtataattgcattcaacaaaacctcattctaaaaccttcgtatactgccactgatgaaagaaacaatcaaaaactcataaccactcatcagatcaactagccatggagctctatcgccccaacaagaactataatcaagcctgatagtacccattctaggtacaatgaccttatattattaaacacaattatcccatagacacgccacattaatataacttcagccaccgctgcgcaatccgtgtacccaaatatgggagatgtctcaaggaagagaaccatattgcaagttcaacaagcaccaccacaaccacaatgttacaaccaactccttaaatttcatgaagaggataaccgtaggcgtatatgcacaattgtagaggaaggaaattaatgaatcagataaattaccatagaaataaaattcctatacacggcacagataactcacgtgccaataatatgaatcgcctggcatggtcacaggcctccagccccagcatatcatacatgggcaattaaacaagtacacttgtatatgataatgaaataagattctcatgctcctggactggtataaatagcacgccatagtgtaagcatgtgcaaagtctgttgtcacacttcaaatcggcaattttatgcagaattagtaactatcccgtatatttagggaatcatcttctttgtaacctcaagtatagcccagatagttctcaacaaaggtacaaatatgagaaatgttataactttacacttaacagtcaattctaggcatattatagcctaagcattcttccgagtatgaatacttgctctaatgcccgcacatgggctcaaacctcacatatatgcacattcataacgcatagctattacaaataattaacgcaactagtgcctccaccgagctttaaataaaatagtcacctcaaataggtcgcaaccccgaaacaatatacttctgagaactcccaatctccaaattcatcacatgaatcatcgtaactgatcccaactccaacactaaaatgactaacacatcttccattcaagataataccatgaggaatactttcataattctttcgtgtcacatagcaataatttgaatatcagcagtctatcaaccaggtgagtactgcaataccgatgaacatccgtaagtcaaaacacaatgcgccttgaaatgcgcacccttctcatgaattaccgagaagttataacattcatcaaaatatctaaaactgaccatgctatccaacattcgttaccttctcttcaagactgaactgtcaccttgtacatgtaaatcctaatcccgcacaacataccacatctattattccatcatgtgacaagcacaagaatcccattatcaactctgagtcaccagcaaattacatatctcattagttagaaacctctctcttgcttctttccaggaggaaatcacaatacacaacacatttcatacaccagtagaaaatatctggttcaaaccatagtggaaaccatcatgaacactttgaaatccatttgcacataaccaagctatcagaactgaattcctctaactcgaccaaaccacgtaggtcaccaaaacccaagaatattgccaccaaaacatctatagagtttcaccacatcataattatccctataaatacacaaccgaaacacccactctgaaaataccttatgcgaatttaaaattgttcctttttcctttattatactgaaatgtagaatccatagtcaaacagaattaccgcacatcctgataccatccaaatgtaagtaactgattctagtgatatacaaatttgaaaaactttcaattaccacaaatacattttgaatccattagaaccctctcgatagtcattcactctgctcaaatttaatttactccaccccaaatgggccgaaagacatgtgctcctttagcacaatcaacactcaaataagtaaccctggcttaacacggccaatcaaattcatacttcgtgtgcactacatccttcaaaataataacttaatcattccataattttcatattttcataaagtgaaatgtaacccgtatccaggaatttacttacccgagtcatcctcgatctccacctctgtaagtcataactaaaccgcaagtatgcctcagaccaaaactaaaatttaacatatatccatgaaattgaattgtcaatagcagactcctctgcttggctcaaagccatagaacaaaaaactcgataactcataacacccatactttattactgccataatactgcagtcagttcaacgaaaattcttctcaagcttatgcaacacccaccataaaatacctcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnncgacaatcaagtcaactttctcaaccagattcaaattcaaatctcaacatatacgccccgctggtagaaaagaaactctccactcaacattataaggagcacatctatgtagattactccgcaggatataacccacctacttaatctcaaattgccatcttgttatacccctttgcaaccacaattactatgaaatcacttaatctttctgagtccaaactcattaaccagacacgagaatttaatttgccccagaatttaacaacgtgaaagaactttcaaaacattcacactcgagattgtacgtcacatcaaaacgaaaataaagcacccaatggccttcctttaaatttcaaggaaacacttctcatcacattcaaatcgtcttatcacatcccgcagttacatcatactcatcacaaagccattcaaccgctcatcgagccacaaattccacttgtagggacattaccgtacatatgagtccaaatatacaggttacaactgaagctaccgagcctaagttgtggtctaaatatggcctcaagtcctctagtctctcgggctctcattaatcaagaaatcatcccaaacaataatgatatgatatatcaataataataacagagactgagataaaatgtgcaagtaaaaactgagactgggtacatatagcatttagcaggcaattcaacaagtacgcgacctctgtgggtcccaacagtactatcacatagcctaagcatgatttctaacatgatttacagccaaattttatcaacacatagagagcatatagctaacaacaaattattcaactttacaatttctcgggatcgatcaaatcacaatcacctcggtgcacgcccacacgcccttcacctagcatgtgcatcacctccaaaataatcacatgataccaaaatctggggtttaataccctcaggaccaatttaaagctgttacttacctcaagccgtgaaattcttattctgcaatgtcctttcctcgtgaattggtctccaaacgcctcgaatctatccataaataattattttccgtcaaattaatttattggaattaattccacaagaaaatgctagttttccataaaaatccgaattttagctcaaacatcgcctgtggggcccacatctcggaactcgacaaaagttataaaatttgaaagcccattcaaccacgagtctacccataccaattttaccaaattctgacctcaactcgatcctcaaatctacaaatcttatttccaaatttctaagttccaatctccgatttacacctcaaaatcatgtaatctagtcggattattcgatgataattcaatactatggagtagaaatgatcacaatggacttacctcaagtttttccttgaaatatatcaaattttgcctctcctcaagctccaatttgtcaaaaatggcgaatgggacgaagtccttatttttataattctacccagacaacctcgattctgcctcgatcttggccttcgatcgaggtcctcaatcctaggcctcgatcatgggcctcgatcctggccctcgatcctagccctcgatcatgggcttcgatcatggcttcgatactgatcctcgatcatggccctcgacactggccttcgatcatgtcttcgacggtgaccctcgacactgggctcgatcatggcttcgatcgtggccctcgaccatgggctcgatcatggcttcgatcgtggccctcgaccctgggctcgatctgagctcacatatgggctcgatttctgagctcgattctgagagatttctgggctcgaatctggcagaagaaatttccaacataaggaaattgcagcagctgttgtagttcaatttttgatccgttaaccattcgaaattcacctgaggccctcgggacctcaacaaaatataccaacaagtcctaaaacattatacaaacttagtagaatcctcaaatcacctcaaacaatgctaaaaccatgaattacgccccaattcaagcctattgaactttgaaatttctaatttctacaaataacgctgaaacctatcaaatgatgtccgattgacctcaaattttgcacacaagtcattaatgacataacatacctattaaaattttcagaattggatttcgaccccgatatcaaaaagtcaacccctcactcaaactttccaaaaattcaactttcggcatttcaagtctaattcctctacggacctccaaaaattcctccggacacgctcctaagtctgaaatctccatacggagctattggaattatcaaaatctaaatccgaggtcatttacacataattctatatccggtcaacttttctaacttaaatgttttaattatgagactaagcgtctcatttcactccgaatttcctccggacccgaatcaactaacacggtaagtgttaaaatgactgtaaagaataaattgagtagtaaattagggaacagggctgtaatactgaaaacgaccggccgggtcgttacaggtgcggagttagaggatgtcggcagcggtcacaagtgcgatgggatttccgcacctgcgattgcgtagatgtgggcagggatcgaagaagcagaggctcgctgggtaagtgatgtccacagaagcatatttgtttccgaaaaaaatgatgctcaagtgtaagcccaagctccgcaggtgcggaaatgcctgggcagtggcaaaaacgagggttttcgatattttactcattttggacattttggagctcggtttgggcgactttggagaagaagttttccacacaacttggggtaagtgttcttgactcccttgtgattatatttcatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatcttcatttttcgtgtatgattatcgaatttgcaagagaagtcgaaagaaatttcaataattttataaaaagaatttttgagttttgaatgccgattcggagtcatatttgagtgaaattagtatggttaaactcgtaattggatgggttgtcaaattttgtgagtttcatcggattcagaaatgtgggccccactgtcaatatttcgagcggatttaggaatagtttttctaaattgataaatttcaagcatttgagtgtattttgattaatttgcatgttgtttgatttgtttcgaatcatttggcatggaattgaggagatatgaaggcgttcagaggttgatacgatcagaatagaatttccggagtattgtttagcttgctcgacattggatttgtcttgttcgaggtaagtaatacttataaacttagttctaagggtatgaatcccctaatttggtgttatttaaattttttggaggtgacgcatacgataggtgacaagcgtgtggacgagaaccatagaaattgtaacttgaataaatcatgtgaagttgtaaaattaaataatcatgttattattcgtatattctccacgtgttaggaaattgagctgagactcgtattaaagatcatgattacgctacgtgccgatattttaggacccatagggtcatgttgctgttgaatttaattgttttaaaaatatatatttttttcatactcaatcatgttcattcattgtgaggatatttaggggattggggctgcccgcatgtagcaagccatgtcggctttatatatatatatatatatatatatatatatatatatatatatatatattatatatggaatggggttgcccgtctgcagcaggccttataggatttatcattatatggatcggggttacccgcctgtagcaagccatatcgactttatatcacgcttgggctgaaggagcccctccggagtctacaccccccatagtgagtgtaggcatgcaccgtatgaattgtgacttggtcaaattccatagaactgtgtagttgaataatctgttattttttgtatatttttcatgtagtagagaaattaaaccacaaattatgtttagattatgtgttggcactatagggacccacataggtcgtgtacatattgaactatctgcttaactgttgtttgtactcagtcacagtttacttgtttattttatttcagtctctattgttcattattgatgcatcatatcattgttgtttcggctgatttcatgattattgagagcccgagagactggagagatttataactaagtgaggccgagggcctgattgtgagatattatactatagcgcgtgagttgtccatgcagcatgtgagttatccgtgcggatccatatattatactatagcacgtgaattattcgtgcgggtctagatattatactatagcatgtgagttgtctgtgcatcacgtgagttatccgtgtggattattacgcttgggctgtaggagcccctccggaatctgtaccccccccccccccccccccctccgtgagtgcgggtacctactgagtgtgagtgctgaatgatgggtgaatggaatggctgagtgactgtggtcttgagaggatgcatttgatttctttctcattgcactatagctgtcatatacccatgttttggaaaatttctgaaagatattatctcttgtttcagtcaaacctgatacgaagttactgtttgggctctaaattgttcaacttgcaagcatgcctactttcttatgttggaaattactgtaattggacttagctgtgacgctcgtcactactttaagttctttatttagtattattacttgctgagttggttgtactcatactacaccatgcacctcgtgtgtagatccaggtacttcatgacacgacggttgctatttttcaaaactttatctattggaaactatcgaggtagctgcttgacattcgcaaaccttgactctctttccttttaggctttatactgtttatattttcaaatagcattttgtcagtcagacattgttatcatttaggtgctcatgtactcagtgacaccggattttgggaatgtatgctatgttaataatttgtgagcttttctatggaattcaaatattatgttttcaaatttaaaagaagttgtggtttattgaggtggtcggcttgcctagtattgagataggcaccatcatgacaggttaggattttggattgtgataagttggtatcagagcttaggttacataggtatcacaagttatgagcaggtttagtagagtcttggggatcggtatggagacatctgtacttatcttcgagaggatatcgaacccttaggaaactttcactttcttgtattctatcatgcgaacttattgattacggaaaactaaaattttgttattttattctctcacacgtggtgagaacacgtactaccgaatcgcacggtcagctactagttagggtcgtaagaggctggggccgtagtagaggcggtcccaaggtagaggtcgaggtgtcacttgtaccacagttggagcagcacctgtagcaccaccagttgctccatatcaagagcagattctagatgtagttgagacggcaggacccactcaggtaccagttgtgtccattgagattccaacatagagcactacaagcccagtcggttgaaactactcaagccccggtagtccccgttatgacagatgatgagcataggagacttgagagatttgggaggctttgacctccatcatttagcgtgctgagtaagaggatgctatggttttctagataagtgccagtagatgcttcgaacaatgggtattctagagaccagtggggtctcattcactacttttcagttttctggggctgccttcagatggtaggagtcttatgagaggcgcaggtcgatcggtgcagtaccacttacatggaaggagttctgtattctcttttttgagaagttcatgctgcagtcttatagggaggagctgtgcagacagtttgagcaagatggcatgtatgtgacctagtacgagatgaggttttctgagttggttcgtcacgcagtttggttggttcccattgataaagagaggattaggaggttcattgatggcctcgcgtattaactgcggttgcttatgactagggagaggatatctggtgccacttttgatgaggtggttgacattgctcgacagatagaggtagtccatagctaggagcatggtgacagggaggccaagaggccttgaggttcgggcggttttggtgggataccttctaggggacagtcctaccacagcaggggtcgcccttataggcccactcatacgacttgtccagctcatcgtggtgcatcagttagccacagttcttatagtgctcactcaggccagtcttcattcagtgcactaccagcgtagagttcttatcatgcctcgtctgctcaagctttgacaactaattcctcaggttatcatgggaaaaagtttcgccagaggagggtttgtttcgagtgtggagaatttggtcatttcaagagagattgtcctagggtgttgagtggggctccacaattgagttctcggccaacggtactagcaccagtagttacaccacccacccacctagctcggggtggggatcaaccagttagaggtcgccgaagagggtgaagccgatcaggtggtggtcaggcctgattctatgcttttcctgccaggccaaatgtcgttttctcagatgcagtgatcacatgtattgtgtcagtgtgcgacaaggaggcatctatattatttgaccctggttctacttattcgtaagtatcatcgtactttactcattatctggatatgccccgtgagtccttagtttcacctgtttgtgtatctacgtcggtgggagatactattatggtggaccgtgtggttgattttgatgcaatctcaggtatggattagtggtccccatgtcatgctattctggactggcacacaaaaactgcgacattgacaatgtcggggttgccaaaggtcgaatagagacgttctctagattatgttcccatcagggtaatttcttatttgaagacccaacgtatggtggggaaggggtgtttgtcatatttagattttgttagaaatgttgatacatatacccctattattgattcagtaccagtagtgcgagactttccggatgtatttcctgcagacctattgggtatgccacccgataaggatattgatttcggtattgacttggtgtcgggcacacaacccatatctattcctccgtatcatggcaccagttgaattgaaagagtcaaaagaggaacttcaagaacttcctgataaggggtttattaggcctagtgtatcgccttggggtgcactgattctgtttgtgaaaaagaaagacggtactatgtagatgtgcatcgattataggcaactaaacaaagttacaatcaagaataagtatcctttgccgcgtattgatgatttatttgaccagctatagggagcgaatgtattctccaaaattgatttgagaaccgggtatcactagttgaaaaatcaggattcggatattctaaagacgacattcatgactcgttatggtcactatcaatttctcgtaatgtcgtttggactgaccaacgccccagcaacatttatgcacttgatgaatagtgtattccagccatatcttaatttattcgtcgtaatttttattgatgatatcctggtgtactcacgtagccaggaggagaatgcacaacacttcggtattttattacaaaggcttagagaggagagactgtatgccaaattctctaagtgtgagttctggcttatttcggtggcattcttgggacacaaagtgtctagtgaagggattaaggtggatccgaagatgatagaggcagttcagagttggcccaggccatcttcaactactgagattcggagttttctcggcttgtccggttattatcgtcattttgtggaggatttctagtttattgcatcacctatgactaaattgacccataaaggtgctccgtttagatggtcgtatgaatgtgaagagagatttcagaagctcaatatagctttgactacatccctagtattggtattgcctacaggttcagggtcttatactgtgtattgtgatgcatcgcgtattggtctcagcgcagtgttgatgcaagatagtagggtgattgcctatgcatccaggcaattaaaggcacatgagaagaatgatctggtccatgaccttgagttagcagctattgttcatgccttgatgatttggcgacattatttgtacggtgtccattgtgaggtttataccgatcaccggagtctacaacatccgtttaaacagaaggatcttaatttgcggcagcggaggtggttggatttgcataaggattatgatatcaccattctctatcatcccggaaaggccaatgtggtggcatatgccttgagtcgtaaggcggaaagtttgggcagcttagcattcttaccggtaggagagaggcctttagccttaggtgtccaggccttggccaaccagtttgtttgattgaatgtttttgagccgagtcgagttttggcttgtgtggtttctcagtcttttctttatgaaggtatcagagaacgtcagtatgatgacccacatctgcttgcccttaaggacacggttcagcacggtgatcccaaggaagtcactattagggatgatggtgtattacagatgcaggacaggctatatatgcctaatgtagatgatttgcgtgagctgattctccaggaggctcacagttctcggtactccattcatccaggtgccgcgaagatgtatcaggatttgaggcagcactattggtgaaggcgaatgaagaaagatatagttagatttgtaggtcggtgtttaaattgtcaacaggtgaagtacgagcatcagagaccaggcagattgcttcagagacttgaaattccggagtggaagtgggagcgtattaacatggacttcgtagttgggctcccacggactttgagaaagtttgatgttgtttgggtgattgtagaccggttgaccaagtccacgtattttattccagttggtactacctattcttcagagcggttggctgagatttatatccgcaagattgttcgcctacacggtgtgccggtgaccatcatttggaattggggcacgcagtttacatcacagttttggagggcagtacagcgagaattaggtacacatgttcaactaagtacatcatttcaccctcagatggacgggcagtatgagagaactattttgatattggaagatatgctatgcgcttgtattatagattttggaggttcttgggattagtttctgccgcttgcagagtttgcttacaataatagctacaaatcaagcattcagatgactctgtatgaggatttatatgggagacggtgtcggtatccggtgggttggttttagctgggtgagactaggctattgggtattgatttggtttaggatgctttgaagaaggttaaattgattcaggagcggcttcgcatggcgcattctagacagaagagttatgttgaccggaaggtccgtgatgttgcttacatggttggggataaggttcttctcaagatttcgcccatgaagggtgtgttaaggtttgagaagaagggcaagttgagccctcggtatattaggccgcttgaggtgcttaagaagattggaaatgtggcttattaacttgcattgccgcccagtctatcgagtgttcatccagtgtttcatgtatctacgctccagaaatatgtcagggatccgtctcatgttttggattttagcatagtgtagttggatggtaatttgacttataacgtggagccggtggccattatagaccggtaggtttgaaagttgagatcaaagaacataacttcggtgaaagtgcagtggggtcagccaatcggagaagctactcgagagattgagcaagagatgcagagcaaatatccatacctatttgagactccaggtataattctaaatttgtttaagagggggagaatgtaacgactctgccgatcgtttcgagtattacaaccatgtctccccaattacttctaaaattgtgatttacgattgttatttgactttccaaggtaattggttcgggcccggtgaggttttagaataatttggaacacttagttccaaggtttagaacttaagttgaaaaggttgaccggatgttgacttatgtgtaacgaccccgaaaattatttgctaaggaaattatgattttgtggtgccgaactaggctgggacttttggtgttgaacaatgagcggtgagtgaagcaggttaggccaagttttgagatcaggtttgcagcgaattatgcgtccgcagaccagttttgcggtacattatgcgaccgcataacaggtatgtgggacgcataatgaccgcagactaaagcagtggcccagttccggagggcctttttgcaacccattatatgggccgcagaagcattatacgaccgcagagtgtgtttcggagctttatttttctagtataatatacccggccccattcttataaaacactattatgggtcattttgaagggtttcatctgatattttagagagatgagagagaatcttagagagagaaagtaaagacctagccatttgtccatcaattcttgttcaaggtttgaagatttcacaaggatcttgctaggacttccaagaggtaagaatttctaaccctagtcttcaaattcgagtttgggtaaatatgggtgattaagagtatgattcttgagtgtaagagtattatttatacatacacgtaccaataaggtttgtggaaagatttttgagttcaaatgggtaaagattgggttgaaaatggtaaaaatctttaaagactttaattgaaggtttgagggtcgagttaatgttggaattttgtgaaatttatatggttggactcgtggttggattggcgttcatagtttgtaatttttgtggttccgaggcatggtccccacgggagaattttgaatgcaattttggattttgttggaaaattaatattttcatatggaattaattcctataatttgaattgattgaatcaaattaattgtgactagattcgaggcgttcagaggccgattcgtgaggcaaaagcttattggaataaagaattgctcggatttaggtaagtaacagttttaaatttggcctgagggtatgaaaccccggattatgtgttatgtgatcggttgtgaggtgacgcacatgctaggtgacgggcgtgtgggcgtgcaccgtaggaattgtgactcactcaaattctatagaactgtgtagttgaataatatgttgttatctgtacattcttcatgtagtagagaaattgaaccacgaatcatgtttagattatgtgttggcaatgtagggacccacaaatatcgtgtacatgttgaactatcttcttaattgttgtttgtactgagtcacagtttacttgtttattttatttcagtctttattattcattattgatgcatcatatcattgttgtttgggctgatttcatgactattgagagcttgagagactggagagatttatgactgagtgaagccgagggactgattgtgagatattatactatagcacgtgagttgtccgtgtgaatccatatagtatactgtagcacatgagattttcatgcgggtctagatattatactatagcacatgagttgtctgtgcggattcagatatttatactatagcatgtgagttgtccatgcagcacgtgagttgtccgtgcagattatagcgcttgggatataggagcccctccggagtctgtacacacccctagtgagcgcaggtacctactgagtgcgagtgctgagtgctgagtgaatggaatggctgattgattgtcgtcgtgagaggatgcatttgatttcattctcattgcactacagttgtcatatatccctgttttggaaaatttctgaaatatattatctcttgtttcagtcaaacctgatatgaaattaatgtttgggccctaaattattgaacttgcaagcatgcctactttcttatgttggaaattactataattagagctgtaaaactcgtcactattttcagttctttatttagtattgtttcttgttgagttggttatactcatactacactctacacctcgtgtgcagattcaggtactttcggacacggcgattactagtttttcgaagttttatctgttggagactatcgaggtagctgcttaacgtccacagaccttgactcgctttccttttatgttttcactaatctatattttcaagtagtgttttatcagtcagacattgttatcatttagatgcttatgcactcagtggcaccgggttttgagaatgtatgctatgttagtaatttgtgagattttctatggaattcaaatattatattttcaaacttaaaagaagttgtggtttattgaggttgttggcttgcctagtattgagataggcgccatcacgacatgttaggattttgggtcatgacacttggcacaagaaattatttaaatatactcacttcatctcaattgtgaacttatttcctttgtactccgtgccaaaaagaatgatcacttttcatatttggaaataattaacttttttgcaatgatttataatgacgaaataaatatgcctcagtttacaccgcaagttcaaaaatcttctcttttttcttaaactccgtgcacagtcaaatgagttcccttaaattaaaacggaaggattaggatttaatgtccatcttacttttctgtttcccttgtcttttcttatttgaagaactttgagagagagagaagaaagagatgggccattgatatggagagaggaagtatgaagagctaataagtttggaattccgaatttgttaaaatgtggttaatttcaagaaatatttcataattattggttaagggtggcatgtgtgccggttaggatcgggaccggcccaggaccgcaagcccatatgggcggtgggcctaaacggtcctaaccggataggaccgggaccgtggggaggtgggctgggtagtaggccggtcctataggggaggcccgcgagaccgggaccggctgagaagtgggctggttcaagcggtcctaaacggtcctaaacgggcccaacggataattttttaaaaataaaattgaccgtttgtccatttaaaaactagttgtttggtctgccaaaatagccatttaaccacccaaactttgttttaaccctaaactttttataattatactttttccctattttcaactataaataccccttcattctttcatttttctcacaaaatcatcaatctctctctaatatcattctataattgcttacttaattgttacattttgtgcaaaattataaagttagtgaattgaagtcttcaagtcttcaacgataattaattttcaacaagttgttcgtcaattcggtaaacttgatccaactcttaatttttaatattatagttttgtttgttttatttactttgcttgattaattaagatggcttattccttaaaaaaaatatttagtaaaaataagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgtctgaccctcctgttactgcccctacgttttctagacaaccttctaaaggggcaaaaacatctcttgtttggccattttttactcaactaagagaaaaaaatagggctaagtgtaaaacttgtggcaaagagttagtttttaaatatgttggaagtcgggaggggggggggagggagtttgactagacacatattgctacaccctcaagataaagctagatattttcgtatgaaagctttggccgaggggacaagtgcatctactcaggctgaccttagtaccgggtcaaatcaattttaaccgggaattaacactgataccggtggtattttatattatgatccaaaaaaagatcaggaagaattggaaaaaatggttattgttatgtgcttagcccatagtttttcttctaaccctcactttgtgcattatattagaaaagtttataatcctacttataaaggttttcctcgcacaaccgtaaagagcgatatttataaatataaacatgaatatgaataatatttgcgctatttatttactcatataaattgtcgtgttgctattataactaatatcggtagaagtggtaatgattgtgattaccttactgttaccagtcattggattgatgaggattggataatgcaaaagcacattattgcttatagaataattaattcacgtcacacaggacagtttatgtcacgaacccaaattccctccgtaggatgtcgtgatggcacctagtctctaagactaggtaagcctatcaatgcggaataataataaatatctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacaggtaaaacaattagtaagaaaagatcaaacaaatttgaagtatatatctcacatcaatgataaagaatataacaagaaaaaaaaatttaataaatgcgcaacagtgatctacacaatttaaaaatataatctttcacaatttaacccgcgtacacactcgtcacctcgtgcacacgactttcaacacatttcaataatcacatcaataccaatcctagggaaaattttccccacacaaggttaggcaagtcacttacctcgacttgctccaatttaaccaagtattatgctttttcctcgattttccgactctgatcgactcgtatctagtcataattaattcgatacagtcaacaaaaattatagtaatcaatttcataagaaaatattacattttcattaaaatccgaaattagctcaaaatttgcccgtggggcccacatctcggaatccggcgaaacttataaaatccgacaacccattcaattacgagtccacccataccaattttaccaaaatccgataacaactcgacctccaaatcttaaattttcgtttttggaagattttgcaaaaatcttgatttcttccatttaaatccgaaataaatgatgaatatgaccatggatttatgaaatataatcacatttggatataggacacttacccaagttgaagtcttgaagaaatcctcaaaatcgcccaagaaccgtgctccaaaactccaaaacgaaatgaaggaaatgaccatttttggtccttaagtttctgccccaaaaacactattccggtcgctaaaagtccaatcccgtcgctaaaagtgtcacatctggtcgctaaaggtgcacaccaggactatttacaccacagttttatttcactaaaaaggctctaactccatcatacgaactcggaattcgacgattcttgttcctatgagtcacaaataaaactacgaacccattcgttcaatcgaaactcaattcggagctcatttgctcaatgtgataccaatttcgctcgttaaacaattaactcatatttcgcgcttaaaactcaatcgcgacttgatgaaattagaccaaactttccagatcactcctataattcattatcaaaatgtcgaaagtctcgaaatcgaatttcgatctctagaactaaaaatggacttttggatcattacatgcttatgttgaaaacatcaaactcttcctcgacagcctgtagtgtatcaatcataacttcttgtactcaactccaactgccaaacggtttaaagttctgcaaactagatacaaagtactacaactttcatgttttgctcatcgcccaactccttatagattgcgagatataagctcccaaagtcagccctgtgcagcagaaatttctggcgatgcacactgctgtagcaaaaatctgcagtacagcttcagtcaatcgatcataacattttgtataaatgtctgaatgataaatggtttatcattctggaaactagaatcaaagggctacaactttcatgttttgaaaatgttcagattccttatagatttcgagatataagcttccaaagtcagctctgcgattgcaccggttgctgtccaaaaacagcttctgcagcagaaaaattccagcagctcctttttgtccgaaattcattccgttaaccttccgaaatccacccgaggccctcggtaccttaaccaaatataccaacatgtcccaaaatacaatatgaacttagttgaggcttcaaaccatgccaaacaacgccgaaattacgaatcgcgcatcgaatcgaattatgagttttcaaatcttccaacttctatattttgcgccgaaacatatcaaatcaattccgattgacctcaaattttgcacacaagtcataaatgacataatggatttataaaaattttcagaatcggatttcgaccccgatatcaaaaagtcaacccctcggtcaaacttcccaaaaattcaactttcggcatttcaagcctaattccactacggacttccaaataaaattccgatcacgctcctaagtccaaaatcaccatacggagctgttggaatcatcaaaattctattccggggtcgtttgcacataatttgacatccggtcactatttgaacttaaacttttaatttttcatcaaaattccatatctcgggctagggacctcggaatttgattccgggcatacgcctaagtcccaaatcacgatacggacctaccaaactgtcaaaacactgatccgagtccgtttgctcaaaatgttgaccaaagtcaactcagttgagttttaaagctctaattcacattttaatccatttttcacctgaaaacttttccgaaaattttacggactgcacacgcaagtcgagtaatgataaatagtgcttagatcacataattaattattaaatttaaagatgacattttgggtcatcacattctccacctctaaaacaaacgttcgtcctcgaacggagttagaaaaagtacctgagctggtgaataagtgtggataacagctgcatatcatgctcggtctcccaagtcgcctcctcgaccggatgacccctccactgaaccttcacggaagcaatgttctttgacctcagctttcgaacctgcctatctaaaatagccactggttcctcaacataagatagatccttgtccaactgaaccgaactgaagtctaacacatgagacggatcgccgtgatatttccgaagcatagaaacatggaataccggatgaaccgcagagagactaggtggtagtgcaagtctgtaagccacctctccaactctctcaagaatctcaaaaggcccaatatacctagggctcaacttgcccttcttcccgaacctcatcacacccttcataggcgaaacccggagcaatacccgctcaccaaccatgaatgcaacatcacgaaccttccgatccgcataactcttctgtctagattgggctgtacgaagtcgatcctgaatcaacttaaccttttccaaggcatcctgaaccaagtctgtacccaatagtctagcctcgcccggttcgaaccaacccactggagaccggcaccgcctaccatacaaggcctcatacggagccatctgaatgcttgactggtaactgttgttgtaagcaaactccgcaagtggtaagaactgatcccaagcacccccaaaatctatcacacacgcacgaagcatatcctccagtatctgaatagtgcgttcggactgcccgtccgtctgagggtgaaatgttgtactcaactctaccgagtacccaactctcatgtactgccctccaaaaccgtgaggtaaactgtgtaccccggtcagagatgatagataccggtacaccgtgaagtctgacaatctcgcgaatatatacctgagccagctgctctgaagagtaagtagtaatcacaggaatgaaatgagctgacttggtcaatctatccacaatcacccaaactgcatcgaacttcctccgagtccgtgggagcccaacaacgaaatccatagtgatccgctcccatttccattctggaatttccaacttctgaagcaatccacccggtcgttgatgctcatatttcacctgtgacaatttaggcaccgagctacatattccactatgtctttcttcatccgcctccaccaatagtgttgtctcaagtcttgctacatcttcgcagcacccggatgtatggagtaccgcaaactgtgagcctcctggagaatcaattcacgaaaaccatctacattaggcacacatagcctgccctgcatccgtaatacatcttcatctccaatagtgacttccttggcatcaccgtgctgaactgtatccttaaggacaagcagatgggggtcatcatactgacgttccctgatacgatcataaagagaagactgagaaaccacacaagccaaaactcgactcggctcgaaacatccaatctgacaaactggttggccaaggcctgaacatccaaggccaaaggcctctctgctaccggtaaatatgctaagctgcccaaactctccgccttacgactcaaggcatcggccactacattggccttcccaggatgatagagaatggtgatatcataatccttaagcaactccaaccatctctgccgcaaattaagatccttctgtttaaacagatgttgtagacttcggtgatcggtgtagacctcacaatggacaccgtacaaataatgccgccaaattttcaaggcatgaacaatagctgctaactcaaggtcatggaccgataattcttctcatgtacctttaactgtctggacgcgtaggcaatcaccctaccgtcttgcatcaacatcgcgccgagaccaatacgcgacgcgtcacaatacacagtataagaccttgaatatgtaagtaataccaacgcttgtgtcggagtcaaagtgatcttgagcttctgaaagcttaactcacactcgtctgaccctgtaaatggggcaccctcttggatcaatttggtcttaatagttgttcataatcaattacagaatcgtcatttaacctcatgttaacaaaaatctcgttgcaaaccttcacaatactgataactagatgcgaggcatgaagacttcataattatttacccgaattaacgagtcacatttaacgccacctaggcgggcacctacctcgtaggttaaaaattaataattacaacacgaatttgacaactatgcacagagaatttcatataagaattttcaaataagcctaacaggcatgactccctattagtactatagtacaaatttaatttcacaagggagaacttaaacacaagaattttcctcacaaggatctcgtccttatataacttccaccgcagctcgtagcccggtttaaacatatcaatttatataaaaatgtgaggatctcgtcctcagttctgaatcacaagtaatatgcacatcgtgccaattgaaaatttccattttctccttttaaataatttcggttacaccaaatcacaacacataatgaaccccacaccggtagggcatataattcacaatttgcaattaattattcggaatttacatcaaaatttaccgaaatgagtaacagaaagccacatttagcctcgcagctcttattagtgaccaacacgaaatgataggcgtagttatctccataaaatctcccaacaggggtaaacacataagtagattatagaattatgaagctcactcataagtggagcacaataggaagactcgtttcgatattgagaaccgaatcaacttaaggaaattattcctttatattaaatcgaggtcgtacctgtaacgacaccatctgatgtagcgacctccgccataccgtaaaacaaatatatcaacggctgggtctccacctctaggacgccttttacccgtctgtcctccacccctaactggtcgtgtgggtggtgtagtaactgcaatggggcacgtagcctgagtgctttgatgaaataagtctctcccaagtttgggaatttttctcatgatgtgcctagtatcaccgtattcataacaacccttttgcgggttaggctgctcatattgagtctgtgccagataactggaataaccattgtaggaactcatgtcggtggtgcattaaaagaacttactggagcaccccgagtaatccgatgtgcagactgggctggacgactgcctgagccaagtgggcggtgttgcattggctggtctgccctcttcataggcttaccacgaacactggtggagaattatctctcccaaggcaaatttcttcttttgttatgctgactcaacactgttgagctgacccatttcttaacatactctttgattcttctttggggtaacccttacccctatttatacacaacgatcacaaaagtagagctccatacagacaaatcttggcacgaaccacatagtccagaatctcgtcaacaactgtacttactccgaagcaccccaaaatccgcaacagtgacgtccacgctgagtagaccttctacaaatttagagttgtttctataactcctttggtattgaagtataggattattaaggaggcggacataccgcaagtcccaaccttatcctctacaaaatctcaggtcttaaacatgtgtaaattttagggaacctttcagtaccacatatatacatttcaggccaaaactgatataatacatgaccccgcaatccacccattggtagtggactcccccactcggcgcgaagtcataggtcacaacgtccgatgatccacaataataaccttcacagcttgtataaatcaaccagacgccaacgtccgttgcacccccacatgattcactaggtgatctctcaatacgcccacatcttcagtcggaaccacacgttgaggcaatgtttgagcatctctggctccctcgtagtccatctgcggcatcacgaaccgtcgacgcacaactgataccgagtgcgcaatgtcatacacgagtggatacaaaggaatataagatatatgtttcaagctaaatcaatgccgcacgataaggagtcaaagaagtgaatatttcctaacagttccatagcctctcgaagataagtacagacgtctccgtaccgatccgcaagactctactaaacctgcttgtgactcataacacctatgaacctagtgctctgataccaacttgtcacgaccccaaattccctccgtaggatgtcgtgatggcacctagtctctaagactaggtaagcctatcaatgcggaataataataaatatctgaaataaataaactacaattcaaacaatttcaactcccaaaacccggtagaaataagtcacaagcttctaagaatttattctcaatgtctctatatgtcaaggtctaaataaaatataaggaagcaacataaaatgatagaaggggactccggagtctgcggacgctggcagatatacctcgaagtctccgtgcgcaggtaactcactgacgtctaggctggtaaaatgtacctggatctgcacaaaaagatgtgcagaagcgtagtatgagtacaccacagcggtacccagtaagtgccaagcctaacctcggtagagtagtgacgaggtcaggtgaggccctactggaatataataatggcatggtaaaatgtttatcaatgtagtaaaataaaatgacattgaaaatgaatcaaatagtatgtcacatttaatgacaccaaataattgcaaataatatctcgtggaaatcaaaacagaatttccttcaactttatgaaaatcacaacaataatcaaaggcaactacggccataaatcaatatcaacaagggcactcccgaggtaccgcctcgtagtcccaaatcataaataaattcacaatatctcatttccttatatcaccgcgggagccttcacaatttatttaaagaaaatattttttcccgaaatagcatcccgcgttttagccacccttatcacaccgcatgacttctagtagttccccctactagccacgcgtatcaagccacccttatctcaccgcatgcgtttcaacacccagaccttataccaccgcatgcgtatcaatatcacaatatatcacaatttgcacctcaagtgctcaaataatttaacttgccaaaataattcaacaacaatatttttccacaataaagagctcacggctcatgccaaaataaatcatcaataatagtttgccaaaataaatcatcaataatagacaataaagagctcacggctcatgtcaaaataattcatcaataatatttttccacaataaagagctcacggctccctcacaatgagtataaaaatattcaggagtaaataatttaggaaaataatatttcaaaatctttactacgttgcttcaatatcaagtttaaaaatgtcaaatacttcatattaataatatttaatttaaagaaaatcaaccttcaaataatgcacagaataaaagaaaccaagtttcaactaaacaggtaaaacaattagtaagaaaagatcaaacaaatttgaagtatatatctcagatcaatgatgaagaatataacaagataaaataatttaataaatgcgcaacagtgatctacacaatttaaaaatataatctttcgcaatttagcccgtgtacacactcgtcacctcgtgcacacgactttcaacacatttcaataatcacatcaataccaatcctaggggaaatttcccccacacaaggttagacaagtcacttacctcgacttgctccaatttaaccaagtattatgctttttcctcgaattttccgactccgatcgactcgtatctagtcataattaattcgatacagtcaacaaaaattatagtaattaatttcataagaaaatattatattttcattaaaatccgaaattagctcaaaatttgcccgtggggcccacatcttggaatccggcgaaacttagaaaatccgacaacccattcaattacgaatccactcataccaattttaccaaaatccgataacaactcgacctccaaatcttaaatttttgtttttggaagattttgcaaaaatcttgatttcttccatttaaatccgaaataaatgatgaatatgaccatggatttatgaaatataatcacatttggatataggacacttacccaagttgaagtcttgaagaaatcctcaaaatcgcccaagaaccgtgctccaaaactccaaaacgaaatgaaggaaatgaccatttttggtccttaagtttctgccccaaaaacactattccggtcgctaaaagtccaatcccgtcgctaaaagtgtcacatctggtcgctaaaggtgcacaccaggactatttacaccagcagttttatttcactaaaaaggctctaactccatcatacgaactcggaattcgacgattcttgttcctatgagtcacaaataaaactacgaacccattcgttcaatcgaaactcaattcggagctcatttgctcaatgtgataccaatttcgctcgttaaacaattaactcatatttcgcgcttaaaactcaatcgcgacttgatgaaattagaccaaactttccagatcactcctataattcattatcaaaatgtcgaaagtctcgaaatcgaatttcgatctctagaactaaaaatggacttttggatcattacatgcttatgttgaaaacatcaaactcttcctcgacagcctgtagtgtatcaatcataacttcttgtactcaactccaactgccaaacggtttaaagttctgcaaactagatacaaagtactacaactttcatgttttgctcatcgcccaactccttatagattgcgagatataagctcccaaagtcagccctgtgcagcagaaatttctggcgatgcacactgctgtagcaaaaatctgcagtacagcttcagtcaatcgatcataacattttgtataaatgtctgaatgataaatggtttatcattctggaaactagaatcaaagggctacaactttcatgttttgaaaatgttcagattccttatagatttcgagatataagcttccaaagtcagctctgcgattgcaccggttgctgtccaaaaacagcttctgcagcagaaaaattccagcagtcctttttgtccgaaattcattccgttaaccttccgaaatccacccgaggccctcggtaccttaaccaaatataccaacatgtcccaaaatacaatatgaacttagttgaggcttcaaaccatgccaaacaacgccgaaattacgaatcgcgcatcgaatcgaattatgagttttcaaatcttccaacttctatattttgcgccgaaacatatcaaatcaattccgattgacctcaaattttgcacacaagtcataaatgacataatggatttataaaattttcagaatcggatttcgaccccgatatcaaaaagtcaacccctcggtcaaacttcccaaaaattcaactttcggcatttcaagcctaattctactacggacttccaaataaaattccgatcacgctcctaagtccaaaatcaccatacggagctgttggaatcatcaaaattctattccggggtcgtttgcacataatttgacatccggtcactatttgaacttaaacttttaatttttcatcaaaatccatatctcgggctagggacctcggaatttgattccgggcatacgcctaagtcccaaatcacgatacggacctaccaaaactgtcaaaacactgatccgagtctgtttgctcaaaatgttgaccaaagtcaactcagttgagttttaaagctctaattcacattttaatccatttttcacctgaaaacttttccgaaaattttttacggactgcacacgcaagtcgagtaatgataaatagtgcttagatcttacataattaattattaaatttaaagatgacattttgggtcatcacattctccacctctaaaacaaacgttcgtcctcgaacggagttagaaaaagtacctgagctggtgaataagtgtggataacagctgcgcatatcatgctcggtctcccaagtcgcctcctcgaccggatgacccctccactgaaccttcacggaagcaatgttctttgacctcagctttcgaacctgcctatctaaaatagccactggttcctcaacataagatagatccttgtccaactgaaccgaactgaagtctaacacatgagacggatcgccgtgatatttccgaagcatagaaacatggaataccggatgaaccgcagagagactaggtggtagtgcaagtctgtaagccacctctccaactctctcaagaatctcaaaaggcccaatatacctagggctcaacttgcccttcttcccgaacctcatcacacccttcataggcgaaacccggagcaatacccgctcaccaaccatgaatgcaacatcacgaaccttccgatccgcataactcttctgtctagattgggctgtacgaagtcgatcctgaatcaacttaaccttttccaaggcatcctgaaccaagtctgtacccaatagtctagcctcgcccggttcgaaccaacccactggagaccggcaccgcctaccatacaaggcctcatacggagccatctgaatgcttgactggtaactgttgttgtaagcaaactccgcaagtggtaagaactgatcccaagcacccccaaaatctatcacacacgcacgaagcatatcctccagtatctgaatagtgcgttcggactgcccgtccgtctgagggtgaaatgttgtactcaactccaccgagtacccaactctctgtactgccctccaaaaccgtgaggtaaactgtgtaccccggtcagagatgatagataccggtacaccgtgaagtctgacaatctcgcgaatatatacctgagccagctgctctgaagagtaagtagtaatcacaggaatgaaatgagctgacttggtcaatctatccacaatcacccaaactgcatcgaacttcctctgagtccgtgggagcccaacaacgaaatccatagtgatccgctcccatttccattctggaatttctaacttctgaagcaatccacccggtcgttgatgctcatatttcacctgttgacaatttaggcaccgagctacatattccactatgtctttcttcatccgcctccaccaatagtgttgtctcaagtcctgatacatctttgcagcacccggatgaatggagtaccgcgaactgtgagcctcctggagaatcaactcacgcaaaccatctacattaggcacacatagcctgccctgcatccgtaatacatcttcatctccaatagtgacttccttggcatcaccgtgctgaactgtgtccttaaggacaagcagatgggggtcatcatactgacgttccctgatacgatcataaagagaagactgagaaaccacacaagccaaaactcgactcggctcggaaacatccaatctacaaactggttggccaaggcctgaacatccaaggctaaaggcctctctgctaccggtaaatatgctaagctgcccaaactctccgccttacgactcaaggcatcggccactacattggccttcccaggatgatagagaatggtgatatcataatccttaagcaactccaaccatctccgctgccgcaaattaagatccttctgtttaaacagatgttgtagacttcggtgatcggtgtagacctcacaatggacaccgtacaaataatgccgccaaatcttcaaggcatgaacaatagctgctaactcaaggtcatgtaccggataattcttctcatgtacctttaactgtctggacgcgtaggcaatcaccctaccgtcttgcatcaacatgcgccgagaccaatacgcgacgcatcacaatacacagtataagaccttgaacatgtaggtaataccaacgcttgtgtcggtagtcaaagtgatcttgagcttctgaaagcttaactcacactcgtctgaccctgtaaatggcaccctcttgggtcaatttggtcttaatagttgttcataatcaattacagaatcgtcatttaacctcatgttaacaaaaatctcgttgcaaaccttcacaatactgataactagatgcgaggcatgaagacctcataattatttacccgaattaacgagtcacatttaacgccacctaggcgggcacctacctcgtaggttaaaaattaataattacaacacgaatttgacaactatgcacagagaatttcatataagaattttcaaataagcctaacaggcatgactccctattagtactatagtacaaatttaatttcacaagggagaacttaaacacaagaattttcctcacaaggatctcgtccttatataacttccaccgcagctcgtagcccggtttaaacatatcaatttatataaaaatgtgaggatctcgtcctcagttctgaatcacaagtaatatgcacatcgtgccaattgaaaatttccattttctccttttaaataatttcggttacaccaaatcacaacacataatgaaccccacaccggtagggcatataattcacaatttgcaattaattattcggaatttacatcaaaatttaccgaaatgagtaacagaaagccacatttagcctcgcagctcttattagtgaccaacacgaaatgataggcgtagttatctccataaaatctcccaacaggggtaaacacataagtagattatagaattatgaagctcactcataagtggagcacaataggaggactcgtttcgatactgagaaccgaatcaagttaaggaaattattcctttatattaaatcgaggtcgtacctgtaacgacaccatctgatgtagcgacctccgccataccgtaaaacaaatatatcaacggctgggtctccacctctaggacgccttttacccgtctgtcctccacccctaactggtcgtgtgggtggtgtagtaactgcaatggggcacgtagcctgagtgctttgatgaaataagtctctcccaagtttgggacaattttctcatgatgtgcctagtatcaccgtattcataacaacccctttgcgggttaggctgctcatattgagtctgtgccagataactggaataaccattgtaggaactcatgtcggtggtgcattaaaagaacttactggagcaccccgagtaatccgatgtgcagactgggctggacgactgcctgagccaagtgggcggtgttgcattggctggtctgccctcttcataggcttaccacgaacactggtggagaattatctctcccaaggcaaatttcttcttttgttatgctgactcaacactgttgagctgacccatttcttaacatactctttgattcttctttggggtaacccttacccctatttatacacaacgatcacaaaagtagagctccatacagacaaatcttggcacgaaccacatagtccagaatctcgtcaacaactgtacttactccgaagcaccccaaaatccgcaacagtgacgtccacgctgagtagaccttctacaaatttagagttgtttctataactcctttggtattgaagtataggattattaaggaggcggacataccgcaagtcccaaccttatcctctacaaaatctcaggtcttaaacatgtgtaaattttagggaacctttcagtaccacatatatacatttcaggccaaaactgatataatacatgaccccgcaatccacccattggtagtggactccccctactcgcgcgaagtcataggtcacaacgtccgatgatccacaataataaccttcacagcttgtataaatcaaccagacgccaatgtccgttgcacccccacatgattcactaggtgatctctcaatacgcccacatcttcagtcggaaccacacgttgaggcaatgtttgagcatctctggctccctcgtagtccatctgcggcatcacgaaccgtcgacgcacaactgatattgagtgcgcaatgtcatacacgagtggatacaaaggaatatgagatatatgtttcaagctaaatcaatgccgcacgataaggaatcaaagaagtgaatattttcctaacagttccatagcctcccgaagataagtacagacgtctccgtaccgatccgcaagactctactaaacctgcttgtgactcataacacctatgaacctagtgctctgataccaacttgtcacgaccccaaattccctccgtaggatgtcgtgatggcacctagtctctaagactaggtaagcctatcaatgcggaataataataaatatctgaaataaataaactacaattcaaacaatttcaactcccaaaacccggtagaaataagtcacaagcttctaagaatttattctcaatgtctctatatgtcaaggtctaaataaaatataaggaagcaacataaaatgatagaaggggactccggagtctgcggacgctggcagatatacctcgaagtctccgtgcgcaggtaactcactgacgtctaggctggtaaaatgtacctggatctgcacaaaaagatgtgcagaagcgtagtatgagtacaccacagcggtacccagtaagtgccaagcctaacctcggtagagtagtgacgaggtcaggtgaggccctactggaatataataatggcatggtaaaatgtttatcaatgtagtaaaataaaatgacattgaaaatgaatcaaatagtatgtcacatttaatgacaccaaataattgcaaataatatctcgtggaatcaaaacagaatttccttcaactttatgaaaatcacaacaataatcaaaggcaactacggccataaatcaatatcaacaagggcactcccgaggtaccgcctcgtagtcccaaatcataaataaattcacaatatctcatttccttatatcaccgcgggagccttcacaatttatttaaagaaaataatttttccgaaatagcatcccgcgttttacccacccttatcacaccgcatgacttctagtagttccccttctagccacgcgtatcaagccacccttatctcaccgcatgcgtttcaacacccagaccttataccaccgcatgcgtatcaatatcacaatatatcacaatttgcacctcaagtgctcaaataatttaacttgccaaaataattcaacaacaatatttttccacaataaagagctcaatgaacaaatgagatcaatgtcaaaataattcaacaataatattttttcacaataaagagctcacggctccatcacaatgagtataaaaatattcaggagtaaataatttaggaaaataatatttcaaaatctttaatacgttgcttcaatatcaagtttaaaaatgtcaaatacttcatattaataatatttaatttaaagaaaatcaaccttcaaataatgcacagaataaaagaaaccaagtttcaactaaacaggtaaaacaattagcaggaaaagtcaaacaaatttaaagtatatatctcaatcaatgatgaagaatataacaagataaaataatttaattaatgcgcaacagtgatctacacaatttaaaaatataatctttcacatttagcccgtgtacacactcgtcacctcgtgtacacgactttcacacatttcaataatcacatcaataccaatcctaggggaaattttccccacacaaggttagacaagtcacttacctcgacttgctccaatttaaccaagtagtatgctttttcctcgatttttcgactccgatcgactcgtatctagtcataattaattcgatacagtcaaaaattatagaatcaatttcataagaaaatattatatttttcaataaaatccgaaattagctcaaaatttgcccgtggggcccacatctcggaatccggcgaaacttataaaatccgacaacccattcaattacgagtccacccataccaattttaccaaaatccgataacaactcgacctccaaatcttaaattttcgtttttggaagattttgcaaaaatcttgatttttcttccataaattcacggattcatgatgtaaatgagtatggaatcatgaaatataatcaatataggataaggaacacttaccccaatgttttcccgtgaaaatcgcccaaaaatcgcccaagaaccgtgctccaaaaatacaaaacgaaatgaatgaaatgaccatttttggtccttaactttctgtcaatccgtcactaaaagtccatttcccgtcactaaaagtccatttttcgtcactaaaagtccaccagaaactgctctaccagccttccttcaattgatcataacttcatgtacaaatgtccaaatgataaatggtttaacttttcagaaactataatccaacgactacaactttcatgttttgaaaatattctgattccttatgaattgcgatatataagcttccaaagtaggcttcacgcatcagaaatttctggcgaaactgctctaccagccttcattcaatccatcataactttctgtaaacatgtccaaataatgaatggtttaactttctggaaactatgatcaaacgactacacctttcatgttttgacattgttctgattccttatgaattacgagatataagcttccaaagttggctccacgcatgcaatttctgcaacagaaatttctgcaacagaaatttctgcaacagaaatttccagcactctttgtccgaaatccattccgtttaccttccgaaatccacccgagaccctcgggaccttaaccaattattccaacatgtcccaaaataccatacgaacttagtcgaggcttcaaactacatcaaacaacatcaaaacgacgaatcgcacctcaaatcaaaattaatgaactttgaactttcaaattctatatcttgtgttgaaacacatcaaatcaattcggaatgacttcaaattttgcacacaagtcataaataacataactgagctatgaaaagtttcagaatcggatttcgactccgatatcaaaaagtcaacccctcggtcaaacttcccaataattcaactttcggcatttcaagcctaattccactacggacttccaaataaaattctgatcacgctcctaagtccaaaatcaccatacggagctgttggaatcatcaaaattctattccggggtcatttgcacataattcgacatccggtcactatttgaacttaaactttaaatttttcatcaaaattccatatctcgggctagggacctcggaatttgattacgggcatacgtctaagtcccaataatgatacggacctaccgaaactgtcaaaacacttatccgagtccgtttgctcaaaatgttaaccaaagtcaactcaattgagttttaaagctctaattcacattttaatccatttttcacctgaaaacttttccgaaaattttttacggactgcacactcaagtcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatttctagcacgattacagatatttgtagatatttttgcgttagtgataaaataatgtcagtttcaatggataatgctactgtaacacaaatgttgtagcattgcttaccactacactaagtcctgcatttagtaatatttttcatgttagatgtatttgtcatatttaccatttaattatgggtgatggtatgaaattttaaatgttgaaattgaaaaggttaaaatggctcttaattggcttttttattcaaaccgtagaagtagacttagagaatattttaaaagatgcgatgaatttggcctaagagaaagaaagatttctaaaccttgtccgattagatggaattacatgtatgaaagtttagttgttgcatatgaatatagaaaccccataaactcaacgtttaatgctcatgtaagtgatgatgatgagcaccttacaaatgcggattgggctaatgttaaaatacttgtagattttttagaaaaattttatattgctacaaatgaattttctgggcaatattatcctactatttctaactgtttagtttatattgcagaacttgcaaatttgtttgatcatttttcagagggtggagaaatttatcaacttgctattgattccatgagaaaaaaatttaaaaaatattttttccctattccccctatttatggtgttgctgcattgttaaatcctactatgaaattaggaggtcctcaattttggtatgaaactgtttataatggtttagcacttgaagatgaggagttgtctacacttgcggacgcaatagcctcaattaaaataaatgttcaaactatttataatgcttatcaagttgcattagatcatgctagaccaaatgttccaactccttcttcttctagttctcaatcatctaaaagaactgcgggagtaagagcacttagtgcttgggcagggttcaggggttctcaaggttctagtactagtgatttttcacaactaaatgagcttgaagtttatttgtcacagggaattgaggaagtgaatcccgacggctcctttaatattttggaatggtggaaggacaaagaaaaacactttccgattctttcaaggatggcccgagacattttaaagtttaatgcttcaacaatggcatcagagagcgctttcagtcaagcaagacttcaactcggtgattatagagcgtctatgagggagaacttggaaaaatgagtacttttcaaagattggatccgttcggaaagaagaaattttggacttgctgaatcacaaccagaggtagacgaagcttacgaagaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccgtaattttttaatgctataataaaattataatgcattgctttgaatatctctttaaaatatttttgtctttttatatatcttaagttgtatatatagtataatatagtatatactataatatactatactatatatatataatatatatatataaatcgaatatagcttatatatattaagatgtatatatagtatagtatagttatatatatatatataagcgtatatatatatatcgaatatagcttatataatactatactatatatacatcttaagatatatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctaacttgtataaaaaaaaattaaaaaatagaaagtatctgttgggctcgcttgagcccgcttaggcccgggaccggcccacttaatccgggaccgttagttcgtggtcccgctcccggaccggttccaatgcgaagcccgggaccgcttaggaccggcccacttagaactgggcccgcgaaatccacttaggaccgggctcggcccacatgtcacccctattattggtattggactgacttagcaaaagtattattaagacatttaatttgaatatagaatgttagcatattgaaaaaaaacaaacatatcctaaaacgtggggataatatttatattaaattttaaactctagctaacagttttgattttattacacgaaagagactaataggctaaaatataaaatatagtagtggttagttgtaaacttgtaatattttgatctacggtccaagtcacacgaatcattaaactttttcgagttttcattattttaaaaaataataattcttcccaacaaccatgctcttaagagttaagacaatacaaatgaaatactctctccttccgtttcaatttatatgaacatatttgactgtacacggaatttaagaaaaaatgaagacttttaaaatttgtgatcctaaacaaatcaaaaaagagcctatagtatttgtgtggttataaaagcttctcattaagggtataattataaatttaagctaaattatttccaaatttagaaagaggtcattcttttttgaacggaccaaaaaaaaatagattcacgaaatgaggggagtaatactttatagttctataattaattagtaattaacttcctttaattattctaatccggatcatttcaaaagatcttcactaaaataattttacttgtttaatgtataagaaaatagtgaaaaaggaagtaatagcaattcacagcacatacaagctgaccctggtgttctactcattgaagtgtttcaaaatttaaacgttgattttaggaaacggccaaatacataaatagttcttttaagttgttctcagtgatcatacatgcaccccaacttatccctttaccattttaatacttcaattattgcttgtatgtgctaattgctatggtttttctagaagtattatttaattataaaattatttttgcccgcattatatatatatatccctttcttgacatttgtatttgaaagagagctatgcttaggttagttccttcagtcaacttttttggtaagttaaaagtgaactttaggtaagtaaatttcataatacattcacatatatatatatatatatatatatatatatatatatatatatatatatatatatatatatatatatattatcctgaaaatattaacacacctttttctctacaagtttgtaaggggtgacaaagccaaaatgtttcaataagcaggcaaactaattttattcaacatcttttggaataattcggattcgggcttttgtatatttattaggcgcaaaaagaaaaattgaaatgcattttgttgatttacttaaagaagtattatggcatttgtgttcgttgtcttatacgctctttacgaatggttactcatctttggaataattagctattaaagttatgtaattttttttgtgctaaaaaatcactcaattttatatagttcatttaaacgtaaaatttagtgacatgacaaaaattaatttaaaaagaagtcattaaatagtactacctccattccagtttacgtgaacctattttttttttggtctgatccaaaaaaattatctctttttaaatttggaaataaattttgcttaaacttacaattttatccttaatgagaagtttttataactatacaaatactctgggtccctttttaaattgtttaggatcacaaattttaaaaatctttattttttaaaaaactattcgactagtcaaacaagttatcctaaattattggaatcggaggaagtagtttaaaagctgaaatattttaaaacacaacccatccatttattcagtatacctgaccggtcccacaattgcagtttcacgaggaaagggaccaccacgtgttggaacagtaaatataatgaggtgctttaataaataataataaatgtattggtctgattatggtataatttatatgtgctgattcatgtcttttttttttgtttttttgttttggtagtgatagattaccggcgctaaaataaagacagttaattattattacatccggtccacggcaagtaattttttggtctttttgtattctaaaataagtgattttttcagattttaagaatgaattacttattttttttttctacattacccctgagtaaataatattggagtatgtattaggggtgtttatgtgaagagatagtaaatgttaatatggtcaaattcattgctacaacaacaacaacccagtataatcccactagtggggtctggggagggtagtgtgtacgcagaccttaccccaagtgggttgctctagtggtgagcatcctccacttccaaccaagaggttgtgagttcgagtcaccctaagagcaaattcattgctaattaatattatgaatttgctcttggggtcaaattcattgctaattaatgttaaaagatgaatttcttaatctgtgtgaaaaattcaaaaaattacttattgtagaccggagggagtattatgattttggtggctcattatgatttagtgttacaacaaatggatgtgaaaagtgcttttcttaatagagatatcaaggaggaagtttatatgagtcaacgagagcgtttcgaaagcgtttcgaaactgaagaagtcaatatatgaacttaaacgagcctcacgacaataatattattggtatataaagtttaataataccatagcatcttttggatttgcaaaaaataccgttgatcagtgcatatacccaaagattagtgggagcaagtttatatttttagtcgtatatgttgacgatattctacttgtagctaatgatttaggcatattgcgtgagactaaagagttttcactactagaaattcagcaaaaaccaacagcggtcgactgaccgattttggtcggtcaaaaaaccggcccaaaacacgaccgaagtcggtcggtttttcaaaatatttatttttaatttttttttacgaaatcgaccaactttggttgatttgctttggcgcaaaaatacggaaaactatttttgaaccccgcaaaatttaattttcaagaaaccaaccaactcaattagttttctttggcgcaaaaatacaggaaactatttttgagtctcgcaaaatttatttctcaagaaactgactagccatttaaaaaccgaccgaattcagtctgtaattttattttttaataaaaccgaccatattaaagagtataaataaaataaaagggagacaaaaaaaatgcaccaatggtctagtggtagaatagtatcctgtcatagtacagaccccagtttgattcccagatggtgtatattaaaataccgaccgactttggtcggaaaaaaccgaccaattgcgatcagttttttcagcaattttttttaaatttaattgaccgatcgaaatcggtcggaaaaatactcaccaaagtcagtcggctagctctaccgacgttacgattatcgaccgccacgaatcaatcggtctcgatcaatttttgccaattaccgatcaacatcgatcggtttttccccttttttagtagtgttctctctaagaattttgaaatgaaagatatggatgaggcaacctatgtgataggaatagaaatattctgtgatagatcacaaggattattgaaattatctcacaaaggctatatcgaaagagagagatttaacatgaacaaatgctcatcaggaatcgttccaattcaaaaaggggacaaattttgtctcatggaatgccctaagaatgatgtagagcgaaaagaaatggaatcatttacttattcttctattattggcagtctgatatatgctcagacttacacaagactggatattagttttgctgtcggaaatgctgggaagatatcagagtaacccatgaattaatcactcgggagctgcacagaaatttttgaggtacttgaatggaacgaaggattacatgttcatgtataggagatccaagcatttgtaagtttttggatacttggattcagatttcgctggatgtattgacactagaaagtccatgttttgttatttgttctaattagttgaaggagcaatatcgtggaagagtgtcaaacagcctgtcattgctacctccacgatggaagcagaatttgtggcatgttttgaagccacaattcatgcattatggttgtgaaactttatttcaggaattggggttgtcgacaccattaccaagtcgctgaaaatttattgtgataattctgcagcagtattcttctccaagaacgataagtacttcaaatgtgccaaacaaatggaattaaagtcttttaccttcaaggaggaagttcaaaaacaaagagtgtcactttagcatattagaattgatctcatgattgcagatctgttaacgaaaggtttatggccaaagatattttaaaaacatgtacatagaatgggtcttgattatatttatgatgttttgacactctaagcctacttatatatttctgatatacattaatgatttcatatttctcataatggtgtacacaatattgttttgagatattacaggataagtgtcaacgcgatattattatggaccataatattttatagcttatggacttggtacaatgagttgctaatgttgtagtatatgaagggactatgtagacaaattatgtatgaccgccataactcacatttcgtagtttatcgtattatggtatttatgatggacattatagaagaaatttttttatgcgcaactaatgtttatattattaaatattaatattatgtgattattgggacaggtgaaagaatgtaagttgttttttctacatgtgtgtgtgtcccaataggtttaaggctaattaatacttaaatgaaagacaaatctcgcccgtacgatcggttacttgattgacgtacaagattaagtgaggatatatataaattggttaccctccacctattagggttattacctattttattcttcttttccatcactaaagttggtggtaacgaaagctagggtaagggacgagataccaatttaccaattaacgcttccgcttcatgataatggcttccgcttcaggtatgttttctttatcgattatatgtaagattatcatgttcaaaatcttggaatgaattaaagttaatgcgtacaatatgtactagtagtatctccatcgtttaatcactactattattaatagtaggagtaggaataaaagtatgtgttgataataccatcatcattatctttataattagttaagaaaaatgtgttatttttattttgcaatttattttttaaaatcttacttagttaagatagagcaatagggtgcatctttaatataatttttatgtatatggtaaaatatgatatgacatgtggctggctagaaggaggatacatggaattcaagatggcatggctgaggaccgaacacagctactccgtttgtcaccggaaaggataacgttcgtaaaagtgtattaaatgctctacgcccggtagcatttactaaagaatattctgcagcattaagagcgatggtcagttacagagaattcagtatttatgttcaccgttacatcttcatcaatgaccctcataattggtattaaatgagggtatgatcctatgaccattttccctagacgtaactataaatagtgagctctgttatcattgtaaggggacgaattttctagcaagaacatatactatattctatacaaagctttacacaactttactttctttctttttgatcttatcattgctatgttcgaaaaccgtgttcacaaaatcactatctttgctattttatctacattataaggctaagtattgtgtattttttcgattatcatattatttcaggatcaaataagttcacatgtctagaaaccgcgaataaattaaactgtgccattttatggttaaacagtttggcgcccaccgtggagcctagacatccgtgcaattaaattgatcctttcctcttttactaatgtattttgattattttatcttagaaaaaatcacaaaaatggcagataacactgttaatgatgcacacaaccctgaaattccaagggtgaagttggctctgatgggcctagaggaagcagatcaggtcttaacaacgagaacgatttattgaaaggcccgcatggattatataccgcgcgcaccaccaatattgaaaggccggaactcgaagaagtatgtttaactatcgtacaagccaagtgtgacactagaactaatcccgaagcgttccaaaatgcttgaagttccaaaatttggaacttctgatccacaggaacatattaccacctataaaggcgatgaaaggaaataatctagcatctcacggaattaaatctgtgttgctataacaattcggcaaaactctcacgaggggatccctaacgtggtatatatcacttcccgagcattccatagattcttttaagatgctcgcagattctttcattaaaactcacgctggggctagaaaggtacaagcgcggaaggccaacatatttagaatcgcacaaggagaatctgaattattatgagagtttgttacctgatttcagaaagaaagaatgttactcccggccatcccggatgaatgggaagatgaagcattcaccaaagaattgaatccgagaagttcatatgcttcccagaagttgaaggaaagattgcttgatttttaagcaacaacctgggtggatgatgttcacaactggtatgagtcaaagataaggatcgaagatgactaggtcggttctacatcatcggccaaaggatgagagaataacaaagaaaaatcaaaggatgactatgacgcggatatgcgaacttcaaggggtcggtttttgccctacgagagtaccgaaagccgtggtagaaatttccaagcaacaaacaagtccatcgttgatagagggactgaccgtggtggaaacaatatatcacttcaagataaagaaacgtcggggtatcgagatatttcttacccctggttattagaatataacttcaacgtcagcgtagtggaactggtatcatccatgaggaacacggttcccaagacctatgagctctaattccaaccagagggattccaatttatagtgtgaataccacgggatgaacagtcactggacatgggactgccgacatcttcgggaggaggtggcaacgctattgaagaatagtcatctatgagaattcttgagtgatcgagctaagttcaattacagtcgcaacaaagacaatacgaaatcttcaaaagaaggagaagaagccccacgccagtcgatcaacatgatctttggggggaacgagattaacggggtcaccttttttgtggcaaaaaagactaaagtatcgataactcagagcaaaggactccgggaggacgatatcactttcacggagaaagatgcagacggattgttgttaccacacaatgatgcactggtaatctttttagtggatctaggaagttcggctaatatcataaaattgagagtattggaacaagctaaactcaccggaagcattatttcggcaataaaactcctcgttgaattcaaccttgcgagcgtgacgacccggggagagatcttgctactcacaaacgctgaagaagtaattaaaacaactctcttcgaagtagtggatggtcatatgggatacaacatcatcttaggaaggctgtagctacacgagatgaaagttgtaccttcgacatatcaccaattgttgatgtttccaatgcccgaaggaagcaagcagataagaggtgaccaaccgacaggaagggagatgaatgcaagctcagtttcctgtagcaaagggaaggagcacacgacattgtaattacaggaatcggtgcctactcccgagttagaagaggttattctagaggcagaatcgtcagaacagtatcaggtgctgagatatttccaagttccggaagagacagacgtaatgaaatccacggaagaggaactagagcaagtgacattgttcgaataattcttagaaagaaaattttcacttggggacgggactgcaccccgagctcatgtctggttttattgaattccttaaaattaacgctgattattttgcatggtcgcacgaggatatgacagatatcccgacgaaaatagtcgtgcacaaacagagtttggatcccaacgcaccaccagtacgacaaaagaagcgctctattgcccatgccaggaataaattcgtcaaagaagatataacccgcttgcttaaaatcggttcggtctgagaggtaagatatccagactggctagctaatattaaagtagttcatatggtgtcatgaccccaaattccctccgtaggttgtcgtgatggcacatagtctctaagactaggtaagcctattaatgcggaataataataaaaatatgaaataaataaatcgacaattcactgaattacaactcccaaaacccggtagaaataagtcacaagcttctaagaatttatcctcaatgtctctatataacagagtctaagaaaactaaggaagcaacataacaagaatagaaggggactccggagtctgcgaacgctggcaggtatacctcgaagtctccgtgcacaggtactcactgatgtctgggccggtaagaagtagctggatctgtacaaaaaaatgtgcagaagtatagtatgagtacaccacagcggtacccagtaagtgccaagcataaactcagtagagtagtgacgaggtcaggtcaggccctactagaaaataataatcaatggcatggtaaaatattttacaatataataaaataaaatgacaatggaaatgaatcaagtagtaggtcaccatttaattacacaaataatgacaaataatacctcgtgaaacaaaacataatttcttttcaactttaagaaatatcataacaaaatcaaaggcaactacggccataaatcaatatcaataagggcactcccgatgtacctcctcgtagtcccaattcataataaattcacaatatctcattttccttatctcaccgcggaagccttcaaaatttatttttaagaaattattttttccaaaatagcatcccgcgttttagccatccttatcacaccgcatgacttctagtagttcccctactagccacgcgtatcaagccactcttatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgcatgcgtttcaatacccagaccttataccaccgaatgcgtatcaatatcacaatatatcataatttgcacctcaagtaatcaaataatttaacttgccaaaataatttaaccacaatgttttgccacaataaagagctcatggctcatgccaaaataaatcatcaataatattcaggaataaataattcagcaaaataatatttcaaaatctttaatacgttacttcaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatattaataatatttaatttaaataaaaccaacctgcaaataatgcatagaataaaagaaactaagttccaactaaacaagtaaaacaattagcagaaaaaaggtcaagcaaatttaaagtgtataaatcaaatcaaagatgaagaatataacaagatgtaataatttaattaatatgcaacagtgatctacacaatttaaaacataatccttcacatttagcccgtgtacacactcgtcacctcgtgtacacgactttcatcacattataattaataccaatcctaggtgatatttcccccacacaaggttagacaagtcacttacctcgacttgctccaatttaaccaagtagtacgttttttcctcgattttccgatttcggtcgactcgtatctagtcataattaattcgatacagtcaacaaaaattatagaatcaattctataagaaaatactatatttttcaataaaaatccgaaagccaatgtcccgtggggcccacgtctcaaaatccgacaaaagttatgaaatatgaacgcccattcaaccacgagtctaaccataccaaaatgactaaattccaataacaattcgtccctcaaatcctcaaatctatccaagagggttttaaaaattttccaacttaaatcaccaattaactgataaaaacagtgatggatttggataatctaaccaaaattgagttaaaaacacttaccccgatgttttctctgaaaatctcccaaacctcgcctcaacccgaactccaaatcgttaaaaatggaaaatggttcgtcccattttcagaacttaaactctctgcccaggcttttactcttcgcgatcgcgaatatccacacacgatcgcgaagtacaaaattccgctgcccagatataactctacgcgatcgcggaaaatcccaagcgatcgcgaagcacagtctccgcaagcctacgcgatcgcaagccttctcacgcgatcgctaagcattaagcgagtggcccagcttctgcctcgttactctacgtgaacgcgaccttcttcacgcggtcgcaagccacaaaatatcaaagctatgcgatcgcatcctgcttcacgcgattgcgaagcacaaaactcagtagccctcaattaaccttacacaatcgcaaacaatgccacgcgatcgcgatgcacaacttgccaaacctacgcgatcgcaattgaactcacgcgatcgcgaagaacaaaatcaacactgcctcaactaagcctatgcgatcgcgtcccaatcttcgcgatcgcgaagaaggtttaaaataccagaaatcagcagctaccaacagtgccaaaatgaaggaaaatactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgagcccctcgggacctcaaccaaatataccaacaagtcctaaaacaacatacgaacttaatgagtcttcaaatcacatccaacaacactaaaaacacgaatccaacgtagactcaagcctaatgaactttgaaattttcaatttctacaaacgacaccggaacctatcaaatcaagttcgattgacctcaaattttgcacgcaagtcataaatgacataacagagctgtacatatttcggaactggattccgactccggtatcaaaaagtcaactccccggtcaaacttccaaacttaaattcctattttagctatttcaagcctaatttaattatagacttccaaataaaatttctaatacgctcctaagtccaaagtcaccatacggagctgttagaatcatcaaaattttatttcggggtcgttttctccatatgttgaccgaagtcaaacataacattttaaggccaacttaaggaaccaaatattctgatttcaacccgaacccttccaattcccgaaccaaccatccccgcaagtcataaatttataaaagcacatacaaggagttttatttaggggaacagtgttctaaaagtcaaaatgaccgattgagtcattacatatggagaacaataaattttgtatgtgtgtagactataaagatcttaataagacgtgtctgaatgattcgtttccactaccaaatatttttcaaatgattgaaccaaattaaaatgaacctggaagatcttaatatgattttccttgatgcttatgcgaggtacaaccaaattaagataaaccaggaagatcaagataagacttcgtttataacaaatttcggtatatattgttatattgtggtgactactttccctttgcagaacatccttcataaactcgagctctagggaagattggcctaatgggccgtcgaaatgagtgaacccgacattgaatataaatcgaggactgcaattaggtcacaagtcttggatgacttcgtgcccgattttagccttggactgctgtctctggcaactaaggatgcagtaatggtgttggagtcaacatcaggggtttggatattatttataaacggagcctcaaacgaagggtccgggctcagaatagctttaatcacgcctttgggggaaacattaaggcaagccattagcacgatccatttaactaacaatgaagcagagtatgaagttgattgcagggctcgaattggcccgaggacttgattatgaggttatcaaaatcaaatgtgactcacagttagtggtaaaccagatttacgggatctttgataccaaagaagaacgtatgcaacaatacgtggtaaaggtccaggcttttttggcacgattccgtgagtggtcgatcactcatatcccgagagaggacaatgcagaagcagattcattagcaaacttaggttcatcaatggaaataaatagatcatagtccagaacgctggtagaactgatgagctcagtccttgatataggtggtaactccgaggtgaattcggctagtctagtctgggactggagaaacgaaataatcaactacctcgatcatgaaaagttgcccgataatcccaaagcatcacgatggttacacaccaaggatttacgttatagcttcatgaaaggccaatggtatagaaaatctttccaaggcccgctcgtccagtgtttaggagcatcaaaagctaactatgtcatgagagaaatccatgaagggatatgcagaaatcactcaggcatagagtctttggtgctgaaattggtacgtgcatgatattattagcctcgcatgaaacaggataccaaagatttcataagaaaatatgataaatgccaacgctatgcatcactagtacatcaaccggcagaacccttacattcggttttgtctccatggtcgttcatgaaatgggagatagacatcgtcggaccgctgccaccggctcccgaaaaggtaatgtttcttttaattttgactgattatttttctaaatgggtggaagcaagttcttatcagaagatcagaaaacacaaagtgttcgatttctagttggaaaatataatttgcaggttcagaataccaaaagagatagcatgcgataatagaccgcattttatcggtgcaaaagttacaaagttcctcgaaaacttgaaaataaagagaatcacatcttcgccttatcatccgagcgcaaatattcaagcggagtcgacaaacaaagtgatcatttaaaagctcaagaaaatgttggtagcaccaaaagacaaatggaccgaagagttgcccggagttctatgggcctaccgaaaaatgaccaaatcaagtacaagagaatctccttttcccctcatatacggtgttgaagccctgatcccggttgaagttggcaaacccactttgagatattctcagacaaaagaagaataaaaaatcgaagcaatgctaataaacttggaactgctcgagggacacaaggacttggcgcgtgtgagaatggcagctcaaaagcagaggatagagcgatattataatcaaagagccaactttcatttttttcaaagtaagagacttggttctaaagaaagtaacacaaaatacatgggagctcaatgtaggaaagctaggttcaatgtgggaaggtctctaccggattttagctgtcactaggaaaggttcgtacgcattggagaaccagaatggggacaaatttcctagcaactagaacgtggcacacctcaaatgatattattgttgatgaacgacgttcaaacagaaagcatgtgttgcactctttttccctcgttcagcttttgtcccaattgggtttttctcgcaaggtttttaacgaggcagcgacagaaagcattctacgaagacatcatcaataagacctttgatagcaaggcaaacaaacaagcttctactcggggacgattaggtaatctttgattaaatagcaaattcccactagtgattacccgtaaaatggtatagttgaatttatacgcagtttccagacaggtgaacttatttgatcttgaaataatacgatcattgaaaaaatacataatacttagccttagaatatagatgaaatagcaaagatggtaattccgtaaacatagtttccgaacacagcaatgataagatcaaaaggcaagaatgtgaaattgtgtaaagctttatatagaatatagtatatgttcttgccaaaatatttgttcccttacaatgataacagagctcactatttatagctacgtctagagaaaatggtactggtatcatacccttctttaatgccaattatgaaggtcattgatgaagatgtaacggtgaacataaatgctgaattctctataacagaacatcgctcttaatgttgtagaatattccttagtaaatgctaccgggcgcagagcatttgatacacttttacgaacattatcctttccggtgacaaacgaagtagctgtgttcggtcctcagtcatgccatattggatttcacgtgtcccccttttagccagccatgtgtcatatcatattttaccctatacaaatagtccccctgctttccggtgacataactttgtgttaccgagatgttggtagaaataccttttggcgggaattactataattccctcttaaggtctctcatagttgattagacgcacatctctcctcatttaatgacctaaacacgtgtcatcccatgattcagcagaatgctttccggttatcgaggtaatcatgaccatgaatttagccgccaagagtttacttatacacaacttccttttcctttgcgtttcacaattgcttgagcttttgatctgcattcttgttttccatacctttcctaattttatttaaacacaaactctttacctttttcttttccaatggcatcttcctctaaatgtgctggttgtacaaagaataataacaaaaccgaggattcagttcctccaacagtgggttccatcatcccagaaaggttgagtactttgaaggattttgcagagaaatttcctactgctaaccctcgtacatgggttgttagtaggtacccttcttccattctcctttccagtatccctgttgtgaaggaggaatgccactgcaatgagttggaaattattgctcctgatctatcggagcgggtaacccttcccaaggaaggttttacatatttttaaagcatccatttagtttgtgtgtgttttatttgaggggagagatcgattccgtgattgtggagttatgccttcactaccaggtgtgtttggcacaggtaagtccttcagtgttgaggacggtcgcctttctctgacatttgtgccaagaaactggagaagagctaaccttagctcatatgatgaatctttattcccctaaaatcttcagcgggggaataataaacctttgtgagcatggtcatcatgttgttttttctagtatagatgatgacaatgactgtgggtggatagaacagttcgttgtagttgccaccaatgacatcattccgacaacggcttcatcctttcggttgcctagaaccgcactcgtaagttctttttataatactcctcttactagatattcttctatggtcatatcatctcttcacccttcacatgtttcagcaactcgatggctcccaccggtgggttcagaagatcttggatatcacaacgcacgaaactcgttcgtggaaagaattggcccttaaatacgggtggaaggccaaaattatggtaactttaatttaccttgcttctatttttgtatatgaagaacttggttgaacctttctgactttgttcatagacttaggtgtacctgcgagctctgttattgtccctgaggaggacgttctatcttatcctgctaatgcatcaaggctgtttcaggaagcacttactcgaacaagtatctccgggcctgttttgggagaaaatacttcttcacggagtccccgactagaggataaacaaacaaagagaagactcacctccacagccgaggaaaagaataaaagggcaaagattgatgccctcgaataatatccagtgccgatgatgactggtcctccttctgggccattcatagacaccgtgatgattgattataataaagaagttgttgatgagggagcttctttacacataaggctacgatcctcataatctcaacaggatgcccgacctgttgagatagttacactaactgaagacgatgtctcggcactttggggagaatctgatttggtagaatatgctaactctcgtatgggccccaattgctgcaaccggtgctgcagggctgagtacctggtctttttcgcctttggttggcgagtatcaaataaccagcactgcatttgatgcagttgcttctcactccttaactccatcagcttcatcttcaccaacaccagcaactgcaacattatttccatcttcatctactcttctatcaactcttgctgcaccatatgcatcggacgcacctgaccattaagaaggtgttcctcttccacagtccccaattcatgggaatttggggaaaaactatgccaccccttctgaagatccacaaaggaggaggaacattactcttttggtctctaccgggtgcaacctactatcacggtcagtggatctttctaactacctgaagcctttgacttcagaaaaatactgggaaaagattcagacactcgcgggcgagtgtttgttgaacaatgttatgcataactattgtttgttgaataatgctatgcataatgcctttggcttcctctgttatttcttctacttttgaacagatgtattctaagttttacctcttcttattttataggccaacttttatttctctgacggccttcaaaggttaattcgtgagaaggaagtacttacttttgaacgagatcaacttttggcggaataagaccagactgttcttcacctctcaaaactagaaaccagggctactgaggttgttgttttggaggctcgtttgcatcaaagagagcaagaagtagtaacctttagccaagaaattgggccgctaagggttaattttgatgagtccaaggccaaatgggctgaagtccagaatgtcattcttgctgcagccgactgtgaggctacctctgctgaaagaatggttaaattggaggcatccttgaactccaaaagtgaagatcatgctgctatggaggtgaaacatgcccagctagaaaagaagtacaggaaaaccattgagcataataggctctttagttccactgtctgttagcctgatatcaccctcaaatctgctagatctgcccggaaaaaattttccagtgaggttactcaaaaagaaaaactcaagcgccgagctgcttcccttattacttaagaaacttattccatgtatagcatgaggagaaaaaacattggaagaggccaaatttggtatcattgatgtcgatgccgaaagtactaaggcccgagagcttgagttaggtgcaaaaaatagactcccgacgcagtctgatgctccatgttcttctgattctggttctaagttttcgaaaactaaggagggatcggaaggcgatgatgccaaaaatgaaactgggtaaagcgctgagccatcagtggaaccaactgtttttcctgacaatgcatatacttttcttcatcctgcttctgtaggcactgcagttaagctttttctttcttttctcattttgttcttgtaacgttttgtccctttcttgcaaataaagagatacatttttgttcaaatatcgtttgagttttactttcatttgaatatccatgcaagcctttaacttttgcatttgctcaagcattctgcgcatgttgttcaattcacactttactatacatagtctcggatgccttttcttcgaagaatttaggttccgctttttatcccttttatgtgagggtttttatgaatttttgtgcaagtttccctttaacatgagggttcctatgaatatttgcgcaagatttctttttgcatctttttcatatgcggcttcgggtatatttttctccgatggcattttggatttcgggcattgattcttccgaaaccaaccctttaacgtgagggttttataagagagggacctcttatgtttacggtgatcttgaagaggacgtctcatgttaattatagcactaacatttgaagcacttgtttaactttcaaatgacaaaattagctcatcgttcaaacaagaaacaagataaaaaaaggatttaattttattccctctattttcataaatcacataagcattttgctatgcagaaaataaattgtcattacttgtggctatcttgtataacttatttctacagggctggctgcgtagtccccggtcccgatgatgcattttgtttctggatttttgttccaggttgacgtggcagtcattgttgttgtatcctcatatcactccccatagtgttcgaatgcgaataatacgaattgaaacactggaagtcttgtatctccgagtgtctcgccaatcaattgctaagtaattcttcactcggcaacatatcttgtttccccttaggaatccatgttatcgagctaaagaatacctaatagtcttatggcgctttatgcccgtgaatatttgggtaacctctgttcggtagcaaacttaacttcccgatgggaatgttctatcgaactaaagattacctaatcgtccccgagtggaagcttgttcatttgtcttgctataaaaggtcttattgctgatgtcttcgtagtatgttttttcctgtttgagcatcgttcatcaacaataatatcttttgaggtgtgctatattctagttgctggtcgattcatcccattctggttctccaactcgtacgaacctttccaagtgacaattgaaatccggtagggaccttcccatgttggacctagctttcccgtgttgagttcccgtgtattctgtgttagtttcctaagaaccaagtctcctactttgaaaaaatggaagttggatctttgattgtgatatcactcaatcctctacttttgatctgccattctcatatgcgccaagtctctgtgtcccttgagcagttctaagttgattagcattgtttcgttattcgattctttatttatttgagaatatctcaaaatgggttcgcccacttcaaccgggattagggcttcagcaccgtacatgaggagaaaataagtttctcatgtacttgatttagtcattcttcggtaggcccatagaactccaggcaactctttgggccatttgccttttgctgtttccaaccttttcttgaggttttgaatgatcactttgtttgtcgactccgcttgaccgtttacgctcagatgataaggcgaagatgtgattctctttatttttaagttttcaaggaactttgtaacttttgcaccgataaattatggtacattgtcgcatgctatctgttttggatttccaaacctgtaaattatattttcccagaggaaatcgaccactttgcgttctctgatcttctgataagaacctgcttccatccattttgaaaaataatcagtcaaaattaaaagaaaccttacctttctgggagctggtggcagcggtgcgccgatgtccatccctcattgcatgaacgaccatggggacaaaaccgaatctaagggtcctaccggtttatgtactagtgatgcatagcgttgacatttatcacattttcatacgaaatctttggcgtcctgctccatgcgaggccaataatatcttgcccataccaatttcatcaccaaagactctgcgcctgagtgattgccgcatatcctttcatggatttctctcatgacgtaatcatcttctgatgctcctacacaccaggtcggcgggccttggaaagaatttttatacaattggcctttcctgaagctataacgtgcaaccttggtgcgtatcacccgtgatgctttgggatcgtcgggcaactttccgtgctcgaggtaattgattatttcatttctacagtcccagaccagactagccaaatttacctcatagtaaccacccgaatcaaggactaagctcatcagttgtaccaccattccggactccggtccctttatttccgttagtgaatctaagtttgctaatgtatccgcttctgcattatcctctctcgggatatgagtgattgaccactcacggaatcgtggcaaaagagcctggacctttaccacgtatcgttgcatatattcctctttggtatcaaagatcccataaacctggtttactaccaactgtgggtcatatttgattttgttaccctcggaatcaagtccccaagcaaatcagagccctgcaatcaaggctccatactcttcttcattgttagttaaagagatcgtgctaatggcttgccttaaggttccccccgaaggcgtgattaaaactattccgagctcggacccttttactttcgaggctccatccgtaaagaaggtccaatctcctgatgtcgattccgacaccattactgcctccttggttgccagaggcagcaatcctggactaaaatcggccacgaagtcagccaaaacttgtgacttaattgtactcctcagtttatattcaatgacgaattcactcatttcgacggcacatttggtcaatctgtcagagagctcattttataaaggatgttccgcaaagggaaagtagtcaccacagctattcggtggcattgaaaatagggcctcagtttccgaggtacgactactagagctaaggatagttttttccaatgtaggtagtgagtttctgctcccgttaaaattttgctaacttattaaataggaaactgcgtaccttcatccttccagactaaaaccgcacttaccgcaacttctgaaatcgtgagatagactagaaatgtttcaccttcttttggtttcgagagcaatgaagggcttgataagtacttcttcaggtccgtcaaagcatgctagcactccggcgtccattcgaaattattcctctatttgcgcaatgtaaataagcgataacacttttccgatgactgggaaatgaacctactcaaagctgctaaccttcttgtgagtctttcaccacataagtcagttgcccataataacatcctccgaccataatagctgaaatttcacgaatttggtgcccacaatacgcctcatggcgcatataagtcttgttccaactctcgaaatactgccacaacggaggagatacatagaaactaatatccacctaccgaatcaacacatcatggagtttctcctcctgacaagaaccattacctcattctgaattgaataatgatatttgctcttaaatatacgttatataaatctgattgcactaatttcaagtccaataatctcgtctcaccccgtacaaattgctcaggcaatgagtcacctcaaacactgaccaagatcttatgcaacaccatcaaagcgccaacaagctaccattcgaatataactcataaggaagaacgaaccctgacagggaattaccagcctgcgtaacaaataaaatagtcgaatagatgctatgaacctacctcagggatgaaaaagcaaggcgcacaaaataagtgcaaggaactatgctcaacatctcattgttgcgacgtgcaacccgatctatcatgacactgttgcggcgtgcaacccgattcatataacattctcgtagcggtgtgccacccagtccagacaatgtacctgtagcggcgcgccactcgatctgcacataacattaagaagaaaacacacatatcaagccgtaacacttatacttagaaaatgcccgaatatggaccacaagcacgccaagtgcataatataaattatggggagacggataatgccatacgctatgaaacctaagcacagctaaggtgcaatggtgacctgcatctcgagagccacctgctcacataacaccacaagctacacgggacctcaacatgtgtgcgaataatgaagccacctcacaacccacatggcacaatagagatttacatggaatagctgacaacagaaataacatccaatgcccgacgactcccccctgagaaatgctattgcgaacgaacacatccgacctgacgtagagcacacactcacactagacccaccaacggacctcacaccgattctgatcataccatactaggtcaataactttccaaagatccacaatggccctattcatgatatataagaacaactgtcacatccgaaacaaactcgcacggtccacagtccgaggaacaggacgcctctcaggcataaactctcgcatttgtgatattaccataaccttcatacttgattttaatctttaacaatcaagtgactaacatgccacacttatacaaatctcctcgtggggtacgctctcacgaccttccgctcatatagcaaagtccgcacatccataccaccaaccatactaatttagtaaggcaaatcacaatttacaaatcaatacacaatgcctcttccacataacgtcattctcacgcgacactaagataacacaagcttactctaaaacgtggggataatatttatagtaaattttacaactctagctaattgataataactcttgtgattttattacacgaaagagactaataggctaaaatataaaatatagtactgatggagtagttagttgtaaacttgtaatattttgatctacggtccaagtcacatgaatcattaacctttttcgagttttcattattttaaaaattaataattcctcccaacaaccatgcgctgagactagggtgccactgaatatttaaaaatcgactaaattgaccgaaatgtaccgtactgaatcgatttttaatttttttataataaaatcgtaggttcttatataaatttacaatcgtaccgataattaagataggtgttttattttataaaaataaagtgaaaaaataccgaaccgtaccgaataaaattatatgtggaaaatatatttatatattaaatttaaaaataataaagcattaaatttttccttgggcagtgaaattatgaaaatggttacaagccaataagtaattaaatcaaaatcttaattctcaatcctattatgctactactactaaaacgaaattatttctggcatatttactagaatgacacaaaatattctagcgattatgagtagcaaaatataatgtattgaatatgtttcctttcgtctgatttagatttatcaatatttaatcttctataggctttatttttgagtctgagcttggttaatatttttctactcgtgtgatttatcttctttttttttgttgtctttttctagtttcttttatgctgatgtagagtagttaatagatctacactctaaccatctttcatatttcttaatatatcaccatttaaacagtaaaattgtctagagagttttgctaagtcgtataaaagtatgtttattattgcattctacttttactaatgacttttacatgacatttaaaataataccgaaaattaaccgaaccgtacagataccgaagagaaaccgacaagattgagacggtttcgaaaagtttaattttggttatacatgatagaataaccgaaaaattagtatggtatgcattttataaaataaccgtccgaaccgaaccattgacactcttacttaagacaatacagatgaaataatactttatagttctataattaattagcaataaacttcctttaattattctaatccggatcatttcaaaagatcttcaataaaataattttacttgtttaatgtataagaaaatagtccgccggagaaaagaagtaatagcaattcacagcatatacaagctgataagggtgttctactcgttgaagtgtctcaaaatttaaacctttattttaggaaacggccaaatataaccctgtagtattaaaaggccaaatacataaacagttcttttaagttgtccatgtgctatggttttttaaagtattatttgattatcaaattattttcgcccacattatttatatatatatatatatatatatatatatatatatatatatatatatatattatcctgaaaatattaacatacctttttctctacaagtttggaagtggtgacaaagccaaaatgtttccataagcaggcaaactaattttattcaacatcttttggaataattcggattcgggcttttgtatatttattgggcgcaaaaaaaaaatgaaatgcattttgttgatttacttaaagaagtattatgccatttgtgtttgctgtcttatacgtctttacgaatggttactcgtctttgggataattagtcattaaagttatgtaatttttttgtctctaaaaaaccactcaattttatatagttcatttaaatgaacattttttctggattatatgctttccagtaaaatttagtgacatgataaaaattaatttaaaaagaagtcattaaaatagtaatttaaaagctaaaatattttaaaacacaacccatccatttattcagtatacatgaccggtcccacaattgcagtttcacgaggaaagggaccaccacgtgttgggaacagtaaagataatgaggtgctttaataaataataaataataaataataaataatgtgtttgtctaattatgatataatttatatgtgctgattcatgtcattttttgtagtgatagattacaccggtttaagcgggtctagtgtttgtcaaagttataaaatatataaaataagttaaaattgtttaaaacaatacaaaatcaataagctaagcaatcataactttatttgtttgtcttaaaagttatttatgacgaaaatccacttttttcaggtcaatccaaatggaccatagaagaaagtttacagtgtgactcaccttttcgtaatttcttagctcactcacagccacagttgaagaaatgaaaaattacaactgacttttagctccattataattttaagtgtgtcccatctttttgaccacaagtattataataaaagttgattgatttttagatcagttaagttaataattagaatcgtacgcaattatttgtcctattattgattgttttatatagtgccaaaaactttggaataaaataatctaagttttaaatggatgcatgcaagcatgctacctactctatattttaaacttcttcaagggccccaaagtgtatgtctcttactattccctagttttgtgagagtataaacccggcattcgtgccaatgtcagaagtttttttttcaatatttaaataatgttaagacaaaatttaagtctattaatatttgttataatgcatgattttcaattgaaaatattaagaatggctgtatattatttgaagtttcttgtttatatagatgttggaactgggagctcggtcagagcaagaatatgattttcatgttagaatttttacttatatatgctacattataaacttatttacccttcctaaatagtttatcatttaattacattagtttatacaatttaccatgtaccagaatccaattttaggtataaggaggagccaaatattcctaaatctcttctctatgcggatctccttaatcttcagattctcctcatatccttttcctgtctctcacctaggatcctcatctatggtttattaaaaagttttaaaagatattttctatagaattaagatgtcttagtcgtaactcgcaatttacattttactgctagtttggtttattgttacatgtcattttataatgtatcatattgtattgtactatattgtattgtattatttggtgaatacaacgtttggataaattgtaccgtttgccgtcgtttcatgatgttacgcaccaacaaaatttaacaatacaatataataaaatttaagtaacaatcaaaataaatattttatttaaagtaacaatacgatacaatacaatagagaacaaccatccaaacaagctattagtgttgttcaaactagagtttcttggaaatttatttgaaatttctattgcctatgtaagttactatccatcattcacaacaagcacaatgtattatatacagatttgtacatgtttaccctaaaatacggataacaattaaatttgtaagtggttttaaggatacgtaggttaattcaatacaaatgataaactgcattagattaaacagataagggacgtaataaattgtcaaaccaatcaagaggagtgatcccggacttagtatcagcttaatgaaacgcctgccttcgatcccgggctcacgttattgatgaattgatgaacaaaagtaagaactttgaataacacagaaaataagaatatatttccttgatatgcgtgttacagtatatctaatgaataatctgacccccctttatatagtaggggagccttaccctaagtgcaattccacaaaaggtaaaaatctttcgtttaactaatcaccggttttctgccgatacgtgtcgagattcacactgtgacatccggttggtcacggatatcacgaccctttgttggtcatggtcgattatctggtaatttcctccgagattttttggattcgaaccgatcctggggggtcgtggcctcgatactcccgaggacagacgttttgcccggactccggctctaggggctctttgcctcgattccggtcccttacagtcacgtcttcctcagtttgcttcatcgaaaatcgaagcatctcatgggatcggttttactcgtacacagatagtcccctcatttttcggagagtaggtttacgaaaacgacgaaaaatgatatgtgcacttcgattccttcttcaatacgacgtgacaaaaacgataaagaatccaaaatgtcccgtcagtcgcatcaatatgactttaaatgcgggttgtccctggatgtgaaacgacgtgaagcctctataaatattcccctccttcgttcactttttaccttttgatcaagattctactttcgagtcttcaggatattactgcccttcttcatactctaacatttttacctccgttcttcgagattcctccgtatattgcaagcttctacttattttctatccaaacccgcgcacttgactttctcagtaaaatttttaccttttatctcccaccttttcttcatattttgaaaactttttccagatatcattggctaaaacttccaaaattgttccccaaaaagttgcttcttcttcttcacaaccgatcaccgaagtcgaagagaccacttccgatgtggtcatcctcgagagaagcactccgggcgtggctaccaatgagccagatcccgagcctcccttgaaaatgttcgtctcgggagggtgcttgatcgcggatgattttaaggttgaaaagccctcgtcggtgtagggctggtgtaaggcggtatctaggtacatatgcttcatcacagaagaggtccttcatgcaattctaaagaattgtgtctgggcggataaagacatagtaatccccaggcccgaggacgctattactactcatgtggaggggtatctgagtttttacacttatctcttcacactaggcctagtggatccggttattctggacttctgtaaaaggtttaaagtatgcctcggtcagatccacccctcgctgtggaggatcgtaatcctccttcgatactttgtgaacaaaatcgacttctatcggttcaccatcaatcatctactccatctgtacagtccccgaatctttcgatggggactgataaagctcgtacgccgtgctagcaaatcctcattctcaagcatcgatgaggaccgggatcggggctggtagagacgctttgtccgggtgaggaccacagacttgatccctgccaagtttagaccattccccgagaagtggaatgtatcacgtaagcataactttcctttaaatgtcaattttatattcatcttctttttcctcaccagtatttgcggtggtgcagctgttgctcgagtcccaaacgccattcctcagctcaaggagtggatcgagggcatttgttcacagatgccttattctaagcgcacatggcacgaactctcgaagggtcgttgggaggcccatactcacggtaagctctctttcccaaataagtaacattatgccctttttagcaccatattctcattccctctcttttctttttgcaggcttgcctaagctcagagaagaaaaagccaagaagaaggttggcccgtaagacaaaggatagttctagctcccgagcacccaactcgaactcactttttcggctcagggacgagcccgaagaaggtgatatgtttgtggttggtgatccgacctcccccgaagagcgggcgacatccgagggggaaaccacgagggctaatccccctcagtttcaggaaaccgatgtagagatgagggctgagacctctcgagatgccggatccggtctgcccggtgtcatagatattccagggtcgccttcatttaccaaatccatgtttgacgaaccccaagcggtgaaggagcgatccaacgaaagggcccatagagcagatgatcccattcgttctattttttaaggtgtggattcaaccgctctagaagacttctccgggttgggtgacttggaggtgccgaggaaagacctatcttcagaggtcgacgagctgaacccgagctcaaaattaatcaaccagttaccggctccgagcattgatcccagccgtaagaggccaataatcatcaccgtccggagaatgcccgggttctttctacacccgtttgagttgtgagctacctccggtgcctggtaatcgaagaagaccaagcgaaaatgaacgaggtggaagtatcgtgattgctcaacgaagcgcaggaagtgctgaaccgggtaaggcatcattacgttcttccatcttctgacttagttttatttatatttctcacgtcttctctgttttatatttttgctgacctcggtactccatcatgaaagttttctctggtaccgggctgaggttaatcagctcgaggctgaggccagggagctcttcgagaagagggacacgtatacgcttctcagcgagcaacacgaagaagttgtcaagagtctccaggctgagtttgatgtagctcagaaggagtatgccgacctggtggaacatatgaagattttcgaagttagtgatgatgacttagccatggaaactaacgatcaagcctcgcaggtccagcagaagtttgaccagatcgaccagctccgggctgaagtgaaagaggtccaggccatggctgatgtctggaaggaacaaaatgtaatagtcttaagggacaaaatatgtatctgcaaggtagaaacattatttcattcttgtgcgtaatatacaagattgtaagtgtgtacaaacttcgtgttatggcttaggtggtctacgcgggcacgttcatttgaccgtttggctcttataataaatcttattcactgagcctagactattcaagaacaaagtttcattcctttctaaaatcattacccgagggtgatgacccctagtattcgaggtcaatcgctgagaggtctcggatactgttgatgtgaccattgactctggtttataatcggtcttggattctaagttagcatgatccactaatgcctcgttaaaaaccttgctagaaaactcatttgggacaaaactgattcaagaaaaaagagtgcaacatgtgctttcaggcctaacaactacatcatcctttggatatttcctccaagtgttagtccaattcgcaatataggttaaaaaaaaaagaatgaatggagtcgtaccttagcaatagtatcattttaagtaggttatgttccagttgttcagtagctgctcatcattccctgcttcgagtttgtacaaacctttaccggtaatctcgataattcaatatgggccttccgaattcggtcccatcttcccttcatttgggttccagatgtttggtgtcacctttcttaacaccaagtccctgatattaaagtgtcagaggttggctctccggttgtaatacctttcgatccgttgtttctgggcggtcagcagaacgagggcgtcctcgcgtctctcatccaatagttctagtctcgtgctcatggcctcaccgtttgactcttcggtcgtatatcataacctgatactcggttctcctacctcgactgttattaaagcttcggcaccgtagacgaacgaaaacagggtggccccgatactagacattgaggtcgtatggtatgcctatagggcttcgggaaaaaatttccttctattttcctttggcgtcagtcaatctcttcttaaggttttagagtatggtcttgtttgagactccatctagccgttcccactagaatgatagggtgttggcaggatccttttgatcttatggtcctcaaaaagttttcttaccttactgccgatgaactgcttcccgttgtcacatacgatctcagccgacattccaaaccaacatattatatggtcccaaataaaatcaatgacttctttttctatgactttctcaaatgcctgagcttcaacaaattagaaaaatagtcattcataaataatataaattgagccttaccgggttcccatggcaggggaccgatgatatccatcccccatttcatgaatggccaaggtgacaagaccgaatgcagtagctccccgggctgatggatcatcgatgcgtgcctgtgacaaccatcgcatttccgtacgaactccttcacatctttatccatgtcgatccagtaatagccggctctggttatcttaccaaccaacgattcggcccccgaatggttcacgcatgtgcctctgtgaacttccctcaaaaagtattcggtgtctcccagtcccagacatatggagagtgggccatcgaacgttcttctgaacagggtgttatcctcggacaggctgaatttgtcgtcattcatgcgcagagctctcgattctttaggatccgatggcagcttctcggtcttcaggtaatctgtacacttgtttctcccatcccaggttaagcttgtcgagtttatctcggggtggccttcttccactacggctttcatgagttgtacgaccgttcccgagctgaattcattgtcatcaaatgacgaccccaagttagctagcgcatcgacttcactgttttgatctcggggtacatgttgctaggtccactccttgaatcaatatagtattgcctgtagtttatccaggtatcttcgcattcgttcctatttcacatcgaacgacacattgacttgatttaccaccaggagggaatcgcatttaacttcgatcaccttggaccccctggcttttacccaaattgagacctgtaattatggcctcatactcggcctcattgctagtcaatttcacagttctaatagattgcctaactacgttactcgtgggtgtcttcaacatgatgccgaggccggacccctttgcgttcgaatcaccatccataaagagggtccagatccccgaggaggtcctcgaggataacaataatcccctttcgacttcgagtattaaggcaggcgtgaaatcggctacgaagtctgccaaaatttgagatttgattgcgattcgggttcgataatcaatatcgtacccactaatttccatgaccaatttggccaatcatagcgagagctcgggtttgtgcattatgttcctcaatgggtaagtagtcaagacacatatgggatggtattgaaaatatggccttaacttcatggagacgcttagcaaggcgagcaccaatttctctaagttggggataccttgtttcggccttgcctagtgtcctgctaacataatatatagggaattgcgtaccttcttctttccggactaagactccacttaccgttatcttggataccactaagtataggtacaactgctcgtctgccatcggagtatgataaaggcagacttgaaaggtaccgtttgagttattccaaagcttgctggcattctgggatccacgagaagttattcttcttcttcaataatgagaagaaccgatggatcttatcagaggaccttgaaatgaatctatccaaggtggctatgtacccggttagtctttgaacgaccttgacattgtccaccacggtgatgtcttctatggccttgatcttgtcgggattgatctcaattccctggttggacaccatgaatccaaggaacttcccggacctgactccgaatgccgcatttctccaggttcaacttcatattatatttcttcaatatgttgaaagtttcctacaaatgtttcaaatggtcctctactcgcagggacttaactaacatgtcgtcaatgtaaacctccattgattttcctattttttcttcgaacatccgatttactaggcgttagtaagtggcaccggtgttttttagtccgaatggcattacgttataacaatagttttcatatttagtgatgaagaaagtcttttcctggtcgcccggatccatccggatctggttgtacccggaataggcatcgagaaagttgagtatctcatggccggccgtcgcatcaatcatacgatcgatgttaggaaaggaaaagttcccttagggcatgccttgttcaagtcttagtagtctacacatattctttccggtagtgtttaccgacagggttatctcctctttagtggtctcacatgccatgttaaacccgtttaaaattcaggttgcaggcacaatttggtcttgtagtcccagctgttccatgaccctcaatttgatgatattggccgagctacctggatcaattaacacacgcttaactcgagatttatttatgagtacaaatattactagtgcatcattgtgtggttgcatgatgccttcaacatcctcatcattgaatgatacggttctcttcggtacataatctcgagtccatttttctcttgtaatggacactttagtgcgctttaacatcggccctgggggacgtcaaccacaccaatgatcatgatgatgacgtgctgaggctcctcctgattgatctgcttgttggagtctctattcttgaagtgatttttggctcgatcactcaaaaattctcgaaggtgtccgctattgaataaccgagtacttcttctctcagttgtcggcaatcttcggttatgtgaccatgagggccatgatatttacacattaggttggggcccctttggacaggatcagattgtaacagtcgaggccacttagtattttttatgcgtccgatggctgataggatgccgatagcatcgacgttgaagttgtactccgataaccttggtgtttcctaagatccgatgggtctgtcaaaaccgtttttgttcatgagtcctcggttagtatgacctcgatcgcttcttctttcacttctcacagtgttgcatccggacccattaccccttcgatctttattgtatgcttgataacggtctctgttcgatctcgtttcatgatcgacggaccttttggatctgtcactagtcctgacgggataaacgaacccggaaagggccccgagctgatcattttttaccctgattttagattggtaccggttatgggcttcgacccaacttaccgtcgggtattctatcaaattttgcttcaactgatgtgaagcctatgagctttagggattgagtccttgggtgaagtcctgagcggcccaattatctgcgacaggagggaaatccatccgttccatttgaaaccttgatatgaattccctcaccatctcgttatctctttgctttaccttgaaaaggtttgatttcctggtctcgaccttgatggccttggcgtgcgcttttacaaaggcatctgcaagcatagcaaacgagtcaatagaattatggggtgagttgtgataccatatcataactcctttcaacaagatctctccgaacttttttagtagaacagattcgatttcattatcttccaaatcatttcccttgatggtgcacagataagaggtcacatgttcgtttggatcagttgtcccattatacttcggaatttcgggcatacgaaacttctttgggatcgacttcagatatgcgctcggagggaaaggcttttggacaattcttttggaatccaggcccttcagtatcgatggtgctccagatatttggttgaccctggagttatatgtctccacttttttgtcgttggctttgattttctcccgattccacccattttgtcagttcctcaagaatcattattatctcagggttggtccagggttctatttcacccggcctttctgtggccgatttatatctgcgggcgctttcccgggacgatttaggctagactctaatgggggatcgactttggttctgcaactgtgatgtcactgcctgttgagcctgtaacatttcgaagatcacacgcaagttgattccatcaccttcgccatcgtgtgtactccgggatatcgaccgggctcccccgcgaatgctattttcggggtcagtaggcaaatttgcttcgatagagacatgtgagttagcatcgatcaaatcagcgactaggactccgttggggtcagcaaggggcaccttgttgctgggtaccacgttgttgtttcgccatggttgccggactcatcatccatgttcaaatggggagattgggagttcgacatttttaatttgacctgaaattaaaagctcaaagaactagtataaagtagagtatgttatcgaaatttgtatcaaattgccactattattcttagctccacggtgggcgccaaactgtttaccctaaaaaaaggaataataattaaatttgtaagtaattttaaggctacatggaataattcaatacaaatgataaactgcattagattaaacagataaaggatataataaattttcaaaccaatcaagatgagtgatcccgcacttagtaacagtttaataaaatgcttgtcttcgatcccgggctcacgttgttgatgaattgatgaacaaaagtaagaactttgaattatagcgaaaataagaatatattaccgtgatatacgtgttacagtatatctaataaataatccgacccccctttatatagtaggtgagtcttaccctaagtgcaattctacaaaaggtaaaaatctttcgtttatctaatcaccgaatttctgccgatacgtgccgagattcacgtcgtgacatccgactcgtcacagatatcacgaccttttgttggtcatgcttgattatcttgtaatgccctctgagattttttgaattcaaaccgatcttaggggtcgtggcctcgatactcccgagggtagacgttttgcctgaaccccgactcaagggactccttgcctcgattccggtccttacagtcacgtctcttcctatgtttacttcattgaaatcgaagcgtcccatgggctcggtttcacccgtacacagtacccatctctatgtcccacaaaaatcccaagagttcttcttcaccttcgtctccacattattgattgaatatataattaactctataattgatactaaacaaaaatttaaaataaaaaactaaattggactgcgaagacataaatttaaactccactgacagtcattcaaaagtttcgaagctttgaattcgaaaattgaattttaggaaattgttatttgtttggattggatgttgttgaaaatgattgggaatatcttttggagtttatatctcaattttgggagaatctgatgaagattcaaggtggttttggtaagaaatttcagattgaaccccgaagaagacattaacaaattatatatatattttgtatgtcgggtatagagacgacatacaaaatatacataactaacataattatatacacgttatatataaattatatgttaattataaaatttgactgcatttttgtacaaaatattatatttaagttgtagataacttatagattttgactgaatttgtatatattttgtaaaaaactttaattactttctagtaaataattttatgatttcttatatatatatatacgaaaaagtctgtttgatgtttagtgataatcgtttctcatttgcatcaaagtgttaaaaagaaaagagttttgagttgtggagaaaagtgataagtaaagtgggaggaagcctgtgaattgaatcatgggcttgtctagcccaattcccccaaaagggttgagccagcctagaagcagaactaggggcttagcccgtcatttagaatgagaaattagcttaaatagcacggcacttgcgttgctagtggatggaataaattgacaattatttccttcaatttttgttctttttatttattctggagagttttaaacatatggagggaaaaagattctggaagtatagttcaaataaagataataggagcatacaaaatttgaagagggtaaacgttaaacttgggtgctagctggtccaaatttacggctttttgaacggtccaaatgatagctggctggtaaatcccaaattaaaaatatactactactagttattagaaatgggtaataatcatttacatcctccaagtttactctaaaaataaaactcatcctctaattttaaacgattctcattttcatctttttatcctacgcaatgtctattttaccctttgacattttcaactccccatatacttaataccctttttatattatctagatatttcttaatgcaggtatctattcataatttaaataatattttatcttatcacataatttaatttaagttcactgaagttataaataaaataattatattatgaatttattaaaaaatatattgctactttttttttatattattattattattattattttaatattatgtatattaaaatgcatagaatgtatgtcggtgtgtgtgtgatgttccactatttttattattttctatgagtatatagtttttgatttttgattgttattaataaattttttctacagtataattaaagttcatgtaaagtgtaaatagataatttttgtaaatttattataaaatttacctctatttttcgatcattaatttttgttaccggcatcgtataatttataaaatttttactctcatttattcttgattttgtaaacatattgagttttgattgttattaataaaattactgataggaataagttatttattgtaatttttatattttctcatttatttcactattgaacgtcattaacttatatgcttgattactacttctcacttttttgggtttcgaaaaagtttctttgatttgtctataggtaggtcgttaacataaattaaaataaaaaaaatatcattatattaaagaataaaaataagagataaaaattgtagagggtaaaataggtattttaagaagtcacctttgatatgaggagcagaatgatatttgttcaaagttggaggatgagtttgatttttaaagaaaacttgggggacgtaattaaatgatttttaccctattagaaataaagaaaagtagaagctgaactcttggatacaagtcttagcttggtttggtcaaatatatttggattccatgaattcaaattagacattgagaagaccacactttattgatttcatcagctgttctctacgtattcggcttcatttctcagcatgacctcaatccctagctgatccaatgaaccatgcatttttcaaaagagagtttaactctaatattgattactaattgaaaacgtataagataggttatctgctccaataaataaaaattaataatatacagaaactatatactgttggtttataattacgttaaatccgatacttttatttatgtaccaatatacaccttattcatttcaaatagaaaatagaacatcgtcactttcttcttcttcttctacttcttcgtgcatggattttctccattatctctccaatccaacctttctttccgcaaatctcacctaatcgtaaacaaaagaagaaatattataattaaataaaatcgaaaaactcagcaccagatacgcgactaagacgtgatcactgatcagttaaggtattggtattcagttcatttcattatataaattatgtcaattcatcattggaggctaagaagagggaacccaatcaccaaagttttgaggtaattaggtctaagctactaattaattaacgtgtcaaagagcctataagaaaaacacgcgtgttggaagggttgggttgatccagtccaattccaaatatagtagtaatactctagcttcaatgatcgttacgttctagtcgcacatttagtagttgtgatcttaataaatcctggatagtaccaactttaccttttgaaacgtgacacagagaaccaaagcctcaacctgtttgaaaggacgatgctatatctaaaatgtaaaatataatttagctcacgtagaagaaaaaaagaagaagaatatctcaaattcttcaataaataaaagagaaaagcataaagccaaaactgatgtcaaaccactactagaaatccgggaaaaaccgaccaaagtcggtcggtaatggccaataaccgtccaaaacgcgatcattaatgtgtgatcggtattttgaaggtcggaagagcatatcgaccaaagacggtcggaaattaccgatcaacattggtcggtatgctctacacgaccatctgataatttaattgacttaccgaccaacattggtcggaatgttattttaataatttaattttaccgaccaaacttgatcagtattttaaatttattaattttgcttatcgaccaacgttggtcagtattggaaaataattttttttattaattaaaatttaacaataccgaccaacattaatcggtaaactggacagtgcagacaacttatcgaccaaagttggtcggtaatgttgaatttctgggaattcaatgtgcattaagtaaccaacattggtcggtaatttggaattaattttttttattagttaccaaccaaggttggtcggttttatgggattaattttggcataaaatgcttgttttggtagctaacaccacctgccaaataaaaacagcatactaatacccccaattcacatataataactatcaattcaccacatacaacccctaattcaccacaaatccaaccaaacatccaacaacaacaacaacaacaaccaaacatccaacaacaacaacaacaaccaaacatccaattaacactttaaaactaacaaattaaagttcaattaaacatcacaatccaaaaccaagcaaaaactaagtaattacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgaggtattttctacaacatcatcaccatctcatgaactttcatctataagacggtatagagaacggtcttatagagtatgggaagaacgatcacgggtcatacgggaggaacgaccacgtggaggccgagcctctagcgatgactcacgagaccggggcaacggaaaagctccagtagaaaggatagttctaatctgagcttgcataccaaggaattgagcatctctaagactttctctttccttggccgcttctagctcagtgtaagctttgtgtgatgacccaatatgtcatctttaaatttaacattcaattatgtgctttcagacctcgaatagcataatttagcattcctcgacttgcgtgcacagtccgtaaattttttcgaaaagtttttatgtgaaaaatagattaaaatattaaatagtgctttgatttggtgtccgattcatatttttaggtattattttggtgttttgatcacgcgagtgagttcatataaagtttatggacttgtgtgcatatatggtttggagccccgagggctcaggtaagtttcggatagcctacagaccttttgaactttggaaaaatctggtttttgagcttcagctgtcacatggtgcattgtgctttgcaatcgcgaagtcattcccgcgatcgtgaagagttaattgtgagctatgacttttactcttcgcgttcgcgaagagagacacgcgatcgtggaaggttggctccaagtgcatcgcgaacgcgtagtgttgatcgattccgcaaagaaggaatggggaagaagctggggaacacaatttgtgcttcgcgaacgctggagggcatttgtgattgtgtaaggttaagaaatcgttctgcgcgttcgcgtgagtgttgccgctttcgcgtagagttaaattctgggacagtctaatttgtgcttcgcgattgcgaggaattgtctgcgatcatgaagagtaaaatagaactgggcagaaatatttctacacgttcgcgaatggatttccgcgatcatgatgaagaaatccatggacaacagaacttaagttctggaaatgggatttcgtcccatttttcattatccacgatttagagctcggtttgggagattttcagaggagttttcacaaattcgaactggataagtgttccttatcctatattggttatatttcattaatccaagtatatattcatcatttatttcggatttagatggaagaaattggattttttataaaatcttccaaaaatataaaatgaatatttgaaaggcaatcctaagtcggaattcgataattttagtatggttgaactcatatcaaaacgggtgtccgaattctgtaatttttttgtcgggttccaaaaagtgggccccacattgacttttgttgacttttcgaaaatgacttaaattaagttcctttcgaatcgtgaataatttttaatgcttaaattgaattgttggtaaataattggctaggtttgattggtttggaggataattcaataggaaaagccatggtcgagtgatcacttgaaatttgccaaaataaggtaagtgtcgtggttaaccttgacttgagagaaataactgttgaattgacttcagttatgatttaactgttttacctctattcctgttattattattattattattattattattattattattattattattattattattattattattattattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgcacttctcgtgcagataccggagttagtcccagtggcgtattatagattttgctcatattcagctatcagatgagacttgaggtatagatgcacgacgttcgcagctctgaagtccccttccactttattttagttctgtgcttacttttagatagttttatttttattcagacccttgtttgtattattttagaagcccgtgcacttgtgactccagttctaagatggtatttagacatcgttattattttggttgttcatttaaattttagatattattatggtttttggtctctttactatttaattaagatgaattgttaaaaatgattaaaattattgtaacgttggcttgcctagtaagtgaaatgttaggcgccttcacggtcccgaaggtgggaatttcgggtcgtgacaagttggtatcagagcactaggttacttaggtcttatgagtcacgagcaagcttagtagagtctgaaggatcgatacagagatgtttgtacttatctctcagaggctttgaagtttaggaataatatcacttctttcttattctgtcatgcaattttattctatcatcgatgattgaatcattctattcttagtctctcgcagatggtgagaacacgtaatacatctactgacggacagtgaccagagcccctggtggcaactatgaccaggggtagaggccgaggccgaggtcgaggtcgtgctagaggctgaggtagaggcagaggtagggctcagtctagagctcgggcatcatcacctgttgtagaacctcaggtgaatttgggagcagaggttccaactcagactgtacctgttggaccagttcaggccctaaaaggattcatagctactatagtgctttaggatgctctagtctatttggtgaaccttatggagggcgtggcccagaatggaacatttccagtggcatcgcccgtctcacaggatgggggaggagcaaagactcccactactcccgctccgaagcagatggctccgaagtatcaggctccagcagccccgccagttggggtagttcagccagttattgcggcacatgccggtgataggcacgccatgtcttctgaggccttatttagattggacaagtttactaagctctttccagttcacttcagtggtacaccttctgagggtccacatgattatcttgaccgctttcatgaggtattgcggaacatgggaatagtcgaaagcaacggggtcgattttgctgtgttttagatggctggttctgccaagaggcggtggagagattatgtacttactagaccagcgaattcgcctgcacttacctgggagcagtcctcacaactatttctggagaagtttgttcctattacactgagagaggaatacaacaggcagtttgagtatctccagcatggtagtatgactgttacccagtatgagactcaatttgtggacttagcccgttatgccatcgtcttgcatcctaaggagaaggaaagagtgaggagattcattgatggactcacttatactatcaggcttcagatggccaaggagacatggattgatatttccttccagaccactgtgaatattgctaggcggatcgagttagttcgtgctcaggagagagggctagtgtcagataagaggccccgtcattccggtaatttcagaggcgcctcatctggaggcagggatacttatagtaggggtcatcctcccaggccattttattcaacacttcaggcatctcacggtgcttcagggagtcatggtcctatcagtgcaccaccgctctagattcactacagcggttatccggctcgttcgggtcaggttcatcttcagcagccacaacagcaggatgggtgttatgagtgtgggagcattggtcacatcaggagatattgccccaggttgtcgagcaacagatctcagcaggattctcgtgccatcataccggcaccagttactctgtcacccgcccagccagctaagggtaggggtcagacaactaaaggtgcaggtcaggtcattagaggtggagaccagccagttagaggtcatcccaggggcatagtttagggtggtggggtccaaccccaattttatgcttttccaactaggcctaaggctgagtcattcgatgccgtgatcacatgtattattttagttttccatagagatgcttcagttctatttgatcaaggatctacttattactatatgtcctcttattttgcttcatatctagttgtgcctcgtgattctctgagagcttccgtgtgtgtgtccacactgatgggagattatgttgtggtagatcatgtctattattcatgtgtggttactattgggagtattgagactagcatcgatcttctacttcttgatatggtagattttgatgtcatcttgggtatggattggctgtcaccttatcatactatattggattatcatgccaaaatgatgaccttagccataccggggttgcctcaattagagtggaaagagattcctggccattctactagcagggttatctcttatgtgaaggctcgacgtatggccgagaagggttgtctagcttatttggctcatattcgcgattctaatgcggatgttccttctatggattcaatcccagtagtctgtgagtttctagatgtattttctgcagatttaccagggatgccaccccgacagagatattgacttctgtattgatttgtctccgggaacccaacccatttctattccaccataccgtatggccccgccggagttaaaggaattaaaagaacaattacaagaattgcttgataagggctttgttagacttagtgtctcgccctggggtgcaccagtgttatttgtaaataagaaagatggttcaatgcggatgtgtatagattatcaacagttaaacaaggctactatcaagaacaagtatctgttgccggactcggtatgtgcattacgaattcctagtgatgtcatttgggctgactcggaatgtgcattacaaattccttgtgatgtcatttgggctgacaaatgccctagcaacatttatggatttgaggaatcgagtattcaagccctatttggattcttttgtggttgtattcattgatgatatcttgattactccagcagtcgagaggagcatgagcaacatcttcggattgtgctttagactttgaaatataatcagttatatgccaaatttttgaaatgtgagttttggttagattctgttgcctttttggggcatgtagtatcggctaaaggcataaaagtggattctaagaagattgagacagttcagaattggcctagacctacttcaactacagagatccggagttttctgggtttggtaggttattgtctggtttgtggaggggttttcatccatagcatccacgctgaccaaattgacccagaaaggtgccccattcagatggttagacgagtgtgagttgagctttcagaagcttaagattgctttaactacggtaccagtattggtattatccacaggttcaggatcttatacggtttattgtgatgcatctcgcgttgggcttggtgcaatattgatgcaagatggtagggtgattgcatatgagtcgcggcagttgaaagttcacgagaagaattatcctgttcatgacttagaattggcagccattgttcatgcgttgaagatttggaggcattacctttacagtgtctcgtgtgaggtatttactaatcatcgtagcctacaatatctgttcaaacaaaaagatctcaatttgaggcagagaagatggttagagatgttgaaagactatgatatcaccattttgtatcaccccagaaaggccaatgtggtggccgatgctttgagtagaaaggctgtgagtatggtcaaccttgcgtatattccggttggtgagaggtcgttagctgcagatgttcatactttggccaatcagttcgtgaggttagatatttcagagcccattcgggttctagcttgcacactcgctcagtcttctttatatgaacgtatcagggaatgacaatatgacgatcctcatttgcttgtccttaaggacacggtgcatcacggtggtgccaagcaggttgctgtggggagaagatggagttctgcgaatgtagggtcgtatttgtgtgcctaatgtggatgggcttcgtgaattaattcttgaagaggcccacagttcctggtattctattcatccgggtaccgtcaaaatgtatcaagatttgcgacaacattattggtggaggagaatgaagaaggatatagttgcataggtagctcggtgtctaaattgtcagcaagtcaagtacgagcatcagagacctggtggtttgcttcagaaattagaaattcatgagtggaagtgggagtgtatcactatggattttgttgttgggatcccatggactcagagaaagtacgacgtggtatgggtctttgtggacaggttgaccaagtcagcacacttcattccagtagcggttacctattcttcaaagcgattagcggagatttacatctgcgagattgtccgccttcacggtgtgctcgtgtctatcatttttgatcgaggtatgtagttcacctcacagttcatccggtgttccatgtgtctatgctatggaaatatcatgatgatccatcccatgtgttagatttcagctcagtccaattggacaaggattttacttatgaggaggagccggtagctattctagcccgacaggtccgacaattgaggtctaagagctatccatcagttcgagtacaatggagaggtcagtcaattgaggaagctatttgggagtccgagtcggacatgtggagtagatatccacacctttcaccagctcaggtaattttctaattccgttcgagaacgaacgtttttttagaggcggagaatgtgatgacccaatatgtcatctttaaatttaacattcaattctgtgctccgagacctcaaatagcaccatttatcatttcttgacttgcgtgcgcagtctataattttttcggaaagttgttatgtgaaaaaatggattaaaatataaaatactactttaaaactaacttaagttgacttcggtcaatatttttagcaaacggacccggatcactgttttgatagtttcggtaggtccgtattgtaatttgggacttgggcgtatgaacggaatttaatttggaggtccctagcttgagttatcgtcatttatcgaaaactagaagtttgaaagcttaaagatttcaaagtttgaccgtgaatttgactttatcaatatcgggctcggattgagattcttagagttggaatagatctgttatgtcatttatgacttgtctgtaaaatttggtgccaaacggaagtgatttgacgcgattcggacatccggttgataaaataggaattcttaagcttcattaaattttttatttgatttggtgtccgattcgtagttctaagtgttattttggtattttgattgcgcgagtgagttcgtatgaagtttttggacttgtgtgcatatgtggtttggagactcgagggctcgggtaagtttcggatagcccatagaccttttgaactttggaaaaatatggtttttgagtttcagctgtcacctggtgcattgtgcttcacgatcgcgaagtcattcccgcgatcgcaagagttaattgtgatctatgacttttactcttcgcgttcgcgaagagaggcacgcgatcgcggaaggttggctcccagtgcatcgcgaacgcgtagtgttgatcgcgtccgcaaagaaggaatgaggcagaagatggggaacacaatttgtgcttcacgaacgcaggagggaatttgcgatcgcgtaaggctgagaaatcgttctgcgcattcgcgtgagtgttgccacgttcacgtagagttaaattcctggacaatctaagttgtgcttcgcgatcgcgaggaattgtccgcgatcgcaaagagtaaaatggaactaggcagaaatgtttctacgtgatcgcgaatggatctccgcgatcgcgatgaagaaatccctggacagcagaacttaagttctgaaaatgggatttcgtcccatttttcattattcacgatttagagcttgttttgggagattttcaaaaaagttttcacaaattcgaactcggtaagtgttccttatcctatattggttatatttcataaatccatgtttatattcatcgtttatttcggatttagatggaagaaattggatttttttataaaagcttccaaaaatataaaatgaagatttgaaaggcaatctgatgtcgggattcgataattttagtatggttgaactagtataggaacgggtgtccggattccgtgattttttcgtcggattccgaaaagtgggccccacgtttacttttgttgactttttcgaaaatgacttaaattaagtccctttcgaatcgtgaataatttttaaagattaaattgaattattggtaaataatttgctaggtttgattggtttggagggtaattcgaaaggaaaagccgtggtcgagtaatcacttgaaatttgccaaaacaaggttagtgtcgtggttaaccttgacttgagggaatagaacccttgaattatttgttacatgaatttcatgtgtaacgacgtataggtgaggtgacgggagcctatacgtcgtcaaattgattgtttgcatatttatctaaacatcatagattattttaaattattaattaattatggtattaattatttctctcatattccttgcccaatattatgccttgaattcatgttataatttgctacgtgcttacttgatttatgtatcttaattgccacttgacatttagcatattaaatattaagttgcctattttttctttgattttcacaattaattgctacttgtcattacttgtttcctcaataaatcataattactgtatgctttgttgcctaataatttcttattaaatgtgttaactattggaatatttttacatccaagtgttgttaaattatattgctggagcgggtttcacgccgcactagatttattttaagtttatattgttggagcgggttgcatgccgcaacggaatttaattaaaatattatattgttggatcgggttgcacgccgcaacggattttatattaagtttatattgttagagcgggttgcacgccgcaacagaaattaattaaaggattatattgttggaacgggttgcacgacgcaacagaatggtaaaagaaattattggctatgaatgttgaattgacttcagttattgatatgatttaactgttttacctatgttcctgttgttgttgttgttgttgttgttgttgttgttattattattattattattattattattattattattattattattattattattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtataggttgatgtaagcgacctgccttagcctcgtcaaaatattcgtcgaggttagtgttacgatccaatttcacctataggtcgtgatgacgcccaacactatagccaggcaagccaactaataaattaaatatatatcgatagaatttaaatccaagaaaaatgataagataccaatttctaccaacgtgtgtgtgccaagacctggtgtcacaagtgtatgagcatctagtagattatacaaaatttcaaatactgtctgaaatgaaaatagaccgaattaaaaatacaagaagaggcactggtagctgcaggatggctcagaaaggcagctcaccactacgcctctggataacgaggatgtgcgatgataggtcctccactatatctatctcagatcctgcacaaaaagtgcagcaagtgtaggatgagtacataaacaacgtgtacctagtaagtatcaagcctaatctcgaagtggtagagacgagatggccgactttgacactcactaaaggtcaataataataagtggaataaattataattattcaaattagcatgattcagagaatttaacaataattttattcaattagcagaaataataaaaatccatcaaatgcaacaatttttaatctattaattaaatccttcaattttaataaaatttccaatttatcaaatagctttacaagttgcaattaaatttcaataaatttctaatttatcaaataactttacaagctgcaataaactgtccaagtatcgtataattattattattattaagcagatttctgccgaggtcgtacgacccgatccaaagtattgtatacactaccgagggacgtgcagcgcaatccatagatgcatctatcctgccgaggcgttcggcccgctccacaagaaagggggacattttcttatgtacctccagaatgagagtatatttattataagataaattctggaggaagaacaatttctcttaacaattaattaatttaaacagaaaatttaagcatatgagattttcctcctttaatatcttccctaacaattcacaatatatatatatatcaaataatttaattaagtaatgactacaatttacacaagtaattcatgcttttgagtcctaaactagctggactttagcattaatagtagctacgcacggactctcgtcacctcgtgcgtacgtagcctccacaattagaaacaattattactttaattacctatggggtaatttccccctcacaagattagacaagagacttacctcattttgctccaatttaatccactagtaggccttttcctcgattatccaacttcgattggtttgaatctaactgaaaataattcgatacaatcactaaaatttataggaatcaattctgtaagaaaatactatattttcaataaaaatcccgaaattaattaaaacttcgaccgtggggcccacatctcagaatctggcaaaagttacgaaatccgataacccattcaattacgagtccaaccacaccagtttcactcaaatccaactccgaatcgataccgaaatctcaaaaattcatttatatgagatttctaaaaatttcccaaatttaaatctcaaaacactaattaaatggtgaaaacaatgatatatttgtgtatatagaccaaatccgagttagaatcacttaccccaatgtctttnnnnnnnnnnnnnnnnnnnnnnnnnnnnnnnnnnnnnnnnnnnnnnnnnnnnnnnnnnnnnnnnnnnnnnnnnnntaaaatcgcctccgctcaagctccaattttgttaaaaatggcgaatgggacgaattccctcttttataaattctacctagggcagccttcggaactgggcctcgaactggcttcgaccatgggcctcgatcgtggcttcgaccgtggccctcgagcctaagccttgatcatggattcgatcacaggctcgacccttgacttcggtcatggcctcgattatggcatcgagcctggcccttcgatcatggcctcgatcctagcatcaagcctcagccttcgatcatggcatctagcctgagccttcgaccatggcatcgatcatggcatcgagcctgggacttcgatcgtggcttcgatcacaagctcgagcttgagcctcgtcaaccctgggctcgatacctgggctcaatatctgggctcaatagctgggctcgatcacaacccagaatatccaacataagaggaaaaattgcagcagcttttaagtccaatatttgatcctttaatcatctgaaactcacccaaggccctcgggacctcaaccaaatataccaacaaatcctaaaacattatacggacttatttgaaacctcaaatcacataaaacgacgctaaaaccacgaattatgctccaattcaagcttaatgaaacttaaaatttccaacttctacattcgatgtcgaaacctatcaaatcaagtccgattgacctcaaattttgcacaaaagtcataaatgacataacggagctatgaaaatttttaaaactgaattccgactccgatatcaaaaagtcaactccccggtcaaacttccaaacttaaattcttggtttagccatttcaaacctaatttcactacagacttccaaatacaattccgatcacactcctaagtccaaaaccaccatacggagctattgcaatcatcaaaattttattccgcggtcgtttgcacataatttgacatccggtcactatttgaacttaaacttttaagtttttatcaaaattctatatctcgggctagggaccttggagtttgattccgggcatacgcccaagtcccaaatcatgatacggacctatcggaactgtcaaaacactgatccgagtccgtttactcaaaatgttgaccaaagtcaacttagttgagttttaaagctctaatccatattttaatccatttttcacataaaaagttcccggaaaattttacggactgcgcacgtaagtcgaggaatgataaatagtgctttttgaggtcttaaaacacataattaattattaaatttaaagatgacatttttgggtcatcacagttaggctcggcacttacagagtacatggggtcggttgtactcatactatactctgcacttcttgtgcagataccgaagttaatcccatcggcatactatagatatttcttggattcagctatcagaggagacttgaggtatagttgcacgacgttcgcagctctgaagccccttccactttattttagctgtctgcttactttcagacaactttatttttatttagacccttgtttgtattattctagaagctcgtgcacttgtgactccagttctgggatggtatttagacatcgttattattttggttgttcatttaaatttcagatattatttcggttgttggtctctttactgttctagaagctcgtgcacttatgactccaggtctgggatggtatttagacatcgttattattttggttgttcatttaaatttcagatattattctggttgttggtctctttactgtttaattaagatgaattgttaaaaatggttaaaatcattctaacgttggcttgcctagcaagtaaaatgttaggcgccatcatggtcccaaaggtgggaatttcgggttgtgacactttgccactgtctcccgcatagccgagaggctctccctattaagttcctcgctctgtgaggaagtccctattccttgaatttcacacctatagtgatggaatgttttctcaggaagctcgtatactttcctcctttttggaccgccaacagtctccaaccatattattttagcatcctcgtacgaaggttgggttggctcgccagattcaccagctggctgactacgaatgaattcctccacgttacaatggtagcggccctatattattatttaaattaaattagtatttaaaaattcttataaaagtaaattataacacttaaagaaaattaaaagcttacatatgcagtctctacccgttcctcaacccatctatctccaccccctctttcttcttctttaaaatatgcgtctccttgaatagctcatcatggctcattagacgcccaaacttcttttcctgaaaataaattaatttagttaataaatagaattgatatacttagaaaagtaaaataatttaagcaattaccaatcttcttcttattgtcccgatgctgatagcaccccagtgtgcaaggagcctcccttctcggatgagtgagctttctttcccttttcgctcttctgtaagagatcctcggtctgccattgccttaacaaatcatcccataaatgctgcagacaccaattaggcttcttgttcttctttttaccatccgagaaatgatccgacaatctcttgcaggctttactagatggaaacatcatatatataaattattaaactgctcaaagaacatttatactttaaactgattgaaaaataattgagatatttccataattattacaacttaatttattctacaattataaattaattaaatcatttttaattaattaagataattaatttttaataattacacccaaaatgttcaacaattatccctaaaagttcaattcacatccaaagagttcaaccattacccctaaaagttcaattcatatcctaaaagctcaacccgtaccctaaacaattaaattaataccctaaataatttaattaacctcacacaacataagctccatccgaaaagttcaacacttaccaataaaaattcaattcataccctaaaagttcaattcacaagaacaaatcctaaaaacacaattcaattcaaagttaaacattcaattcataataaaactactgaggtcaatacaaacttaaacattgaatttacaccctaggtaatcaattcagttcaattcaattttaacatgacctaaaccctagatttcaataaaattcaaatttaaacaattcataacgaaataacaaaatattaaaattatacaaacaatgtaagttcaaatcgaaagttggaagttttaggaggtggagggggaggggcaatggaggccgtagcaacggacatcggcggcgggggcagtggcgacgtggggtagggaatgggatttgtgtgagggaaataaagaaggagatggggaagggtgttatgtgtgtgagggagaagagaatggggagttagaaaattttgagaagagagtaagagaaatgagggaaaaatcccgtatttgggatctggaattagaattaccgaccaacgttggtcggtacactaagtgaccgcgcgttgactgtgtttgactattaaccgaccaactttggttggttatttttttttaaaaaactaaattatttttttgtgtttttatttcttaaaatattataaactataaaaaattattataaactataagcatttattttattcacatatatatttactataaataattataaactataagcataatctgtataaataactatattaactaattaattttaataaattataagcatatatgttattcacacatatatataattaatcaatcataataataaaaaataaaggtatatagtatatgagacgtttattttattcgaattccacatttcgtcttatacattcattcattttataactaattacaaatcacatagattaataaatatcggtcaagatgttttaccttttatattcatctatctaagttaattttctaagttataattaagttgtcatgacccaaaatctacctagtcgtgatggcacataacccaaccggtcaggtaagccaattaacaactattcaattcaattaatatttaactgactctaatatactccccaaggactggtagtacaaatcatgagcttctaagattagaatttataaagctggtatgaaataaaacatcatctgttcgaaacgtacataaacaatttttttttataaatctaaggctaccatgaacaagaggcagctacaaccagaacaaaggtatgtattcaaatccagctctcgtccatcacagcagcatcaacatccaatatctgcacgcaaggtgcagaagtgtagtatgagtacaaccgaccccatgtactcaataagtaacaaacctaaccttannnnnnnnnnnnnnnnnnnnnnnnnnnnnnnnnnnnnnnnnnnnnnnnnnnnnnnnnnnngtgacgagctggataacaggccggagtccaacaccaatagcaaacaacagttcataacaacataatgaaagtaataaaagaagtatctgagagataaaatgttcaaatcattcacagttccagaaaaataggcatatttttcaagtatatcagcgaaaacccaaatcttttgccgaaatcaccaaaatatgaatacgttttgtaaaaatgtgattttttccccaaaacctttcaacaacagataggatgtttcattttcaaatggcatgaggaaaatacatctctatgcctacatgtcaatgagtatgtgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgacgcaatatcgtacatcatgagaaaaatgcatcaatatgcctgtatgtcaagtgtgcatgtcaatgcgatgcaactcaatgataaaaccatgtgcatactcccagagtattaattcacccagtcctccaattcacttagtcctcacagtcacttaatgctcaaagtcactcaatcctcttaatcgctcgacactcgcactcagtaggtacttgcgctcactgggggtctgtacagactccggaagggctccttcagcccaagctctataatctgcacggactagtcacgtgctatagtatcaatatctggatccgcacggacaactcacgtgttatagtataaatatttagatccgcacggacaactcatgtgctgcacgaacaactcaggtgctataataagacaatctggcatgctgcggcatgcaacctgatcccataattatcctcacaatcagtccctcggcctcactctgtcgtcaatctctccagtctatcaggctcacaatgtcataaaactagcccaaaataatgatatgatgtatcaataaataacaatagagactgagatatgatatgcaatgaatgaatatgactgagtatgaaattatagtttaaacatataattagatagtcaaaataaccatatggagctattagaactatcaaaactctattccgtagtcgtttgcacaaaaagtcaaatagatcaagtcttttcatttaagcttctaaacaaggattgttctttcacttaaatcccgaatcatccgaaaaccaaagccgacaattcacacacaagtcataatacgcattacgaagctgctcaagacttcaaattgtcgaaaggagcatatatgttcaaaacgacaagtcaggtcattacattctcccccacttaaacatacgctcgtcctcgaacgtgccaagagttgttcctaaaccttcaaatcactattccaccttaccactagggctgttcatttggatcggatatccgaaatccgaaccgatccgcttaatttcagatttcggatttcagatatttggaacggatttcggattgtgtttattaaattttggatattcggatcggattcggattggtataattgtaaaccgatccgatccgaaatccaaaattattagggcatgtataaatattaaactttaatttcggatagtctgtacttcctttacatcttcctccaagttattacctttacaattgctggatttagctatattggcaccatagtactctcataattgcataaacatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgaggcataataatccgatccgaaatccgaaaatctgatccgatccaaactttaaaatccgatccgatccgatattaattcggatcagattcagattgcattttgtagaatccaaaatctgaatccgaaatgtgctaaatccgatccgatccatgcacaactctacttaccacgcacatacccggtggtgatcccacgccaccctattccatataggcgtgacaacacaacataattgaagatcatcactttaatcttagtccgtaaaacttataacccaatttccaacatctagaatttcttacaagacccgaatctcacatctacacactatataagtttgaacaaactgtatcaagtcataaccatgaccccagatatagtcacataacatactacacaactcacatactcgtagcaataatttctaatcaccatagtgcttaaaaaaaatgaactcgataccgttgataaacctcatatcaaaaaccttcgtacactgccaataatgaaagaaacactcaaaaactcataaccactcatcagatcaactagtcatggagctctctcgctccaaccagaaccataatcactttctaagctgactttcgatattattctcccaaatataccgtaattaaatctgatagtattcattctaggtccaatgacctcatctcatcaaacacaaccactttattgacttgaaaccccaacataacctaatatttacaaccaactcctcaaattttgtgaagaggataaccgtaggcgcatgtgcacaattcctcaaatacactactcaaataatttttatcgtagaggaaggaaaacaatgaaatcaaataaattatcaaagaaatgaaattcccacacactgcacggacaattgcttcggtgcccgcacatgggctcaaacctcacatatatgcccattcatagcgcgtagctataaaaaataattaatgcaactagtgtctccactaagtttaaataaaatactcacctcaaacaggtcacaaccctgaaacaacatgcttctgagaactcccagtctccaaattcataggacacatgaatcaccgtaactggtccctactccaacactcgaatgactaacaaatctttcatgtacgatcatcccattgacaatcaagtcaactttctcaaccggattcaaattcagatctcaacacatacatcctgttggtagaaaagaaactctccgctcaacattataaagagcacacctccgtagattactccgcatgagataacccacatgctttgcctaaaattggcatcttgatataccctttcgcatccacaatcactatgcgatcaattaatctccctaagtccgaactcatcaacaagacatgaaaatctacttcgctccataattaaataatatgaaagatcctttaacatattcatactcgagactatacgtcaaatcaagacagacaccaagtacccaataaaaccatctcaagcaatctattctcgtcataatcaaactatctgaacacattccgcagtcacgtcatgctgatcatatagctattcaacccctcatcgagccacaaattccactcatagggacactaccggacatatgagtccaaatgtacaagttcacacaactgaagctaccgagcctaagatgtagtctaaacctagcctcaagtactccagactggcccatcgcccaaaacacagaatacacatctcgaacctcattcatggaatcataagccgacgatgcacaactgataccgagtgcttacatgcgcacatgaatgcgtggaaggaattcaaagagttatgtttcaagctgaatcaatttcgcacgataaggaaagaaagctggaaattatcctaaatgtcctgtagcctctcgaagataagtatggacgtcattatacctattcgcaaaactttactagacacttgctcatgacttgtcaaacctatgaacctagagctctgataccaacttgtcacaacccaaaatccacctagtcgtgatggcacctaacccaaccggtcaggtaagccaattaacaaatattcaattcaattaatatttaactgactctaatacactccccaagaactggtagtataaatcatcagcttctaagattagaatttacaaagctggtatgaaataaatacatcatctgtttgaaacgtacataaacagatttttttataaatctaaggctaccatgaacaagaggcagctacaaccggaacgtaggtatgtcttcaaattcagctcccgtcgatcataacaacatcaatatccaatatttgcacgcaaggtgcagaagtgtattatgtgtacaatcgacccatgtacttaataagtaacaaacctaaccttatgttgaaagtagtgacgagttagatcacaggttggggtccaacaccattatccaacaacagttcataacaacttaatgaaagtaataaaagaagtagctcagagataaaatgctcagctcgttcacagttctaaaaaaataggcatgtttttcaagtatatcagcgaaaatccatatcttttaccgaaatcaccaaaatatgagtacgttttgtaaaactgtaatttttttcccaaatacttttcaacaacagataggatatttcattttcaaatggcatgaggaaaatacatctctatgcctacatgtcaatgagtatatgaagtcatggatgacgcaatatcgtacaacatgagaaaaatgcatctttatgcctttatgacaagtgtgcatgtcaatacgatgcaacttagtgataaaaccatgtgcatactcccagagtatcagttcacacagtcctcccagccactcagtcctctcaatcaatcagccctcacagtcgctcaatcctcacagtcactaaatcctcccaatcgctcggcacacgtactcagtaggtacctgcgctcactgggggtgtgtactaactccagaggggttccttcagcccaagcgctataatctgcatggacaactcacgtgctgtatgtataactcacgtgctatagtatcaatatctaaatccgcatggacaactcacgtgctatagtatcaatatctggatctgcacggataaatcacgtactgtacgaacatctcacgtgctataataagccaatctggcctactgcggtgtgcagcccgatcccataattatcctcacaatcaggccctcggcctcactcagtcaggaatatctctaggctctcgggctcacaatgtgatgaaactagcccaaaataatgatatgatgtatcaataaataacaatagagactgagatatgatatacaatgaatgaatatgactgagtatggaattacagtttaaacatataattccatagtaaaaatgacctcagtgggtcccaataataccaacatttgcctaagcatgatttctaatatgagtcacatctcagtttctataacacataaaaatacatggaaaaatacaagttaattgactatacagctctacagaatcaaccgagtctcaatttctaaggtgcaagttgtaacgacccgaccggtcgttttgagtattacaatcccgtttccctatttactactcaaattgggctttacagttgttgtgtgactggccagggcaataggttcgggtccggtgaggttttggaataaattgaaacacttagttccaaggtttaaagtttaagttaaaatagtgaccggatgtcaacttttatgtaaacgacctcagaatttagttctgatgattccaatagctccgtatgctgattttggacttaggagcttgtccggaaaattatttggaggttcgtattggaattaggcttgaaatgccaaaagttgaatttttgggaagtttgaccgggggttgactttttgatatcggggttgaaatccgattctgaaaattttaataggtccgttatgccatttatggcttgtgtgcaaaatttgaggttaatcggacgtgatttgatagaattcggcattgtttgtgaaaacttaaaatttgaggtcaatcggaccggttgtatatgagtgatgttctcccgaggggctgtttatgattttatcactgagttgcatcgcattgtcatgcacacatgacttataggaatagagatgtattttcctcatgttgtacaacatcatatcattcatgatttctcacacattttgacagatgggcatagtgatgcatttgttttacacaggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaattttatctctgtattacttctggtattattttctttaagttgttatggactgttgtggactattggttttggacccgatcccggtggaagctcgtcactactttcaacctaaggctaggtttgttacttactcagtacatggggtcagttgtactgatactacacttctgcatattgcgtgtagatgttggttgttgttgttgctgtgctcgatggttgtgggattgaagatgtacctgcgctcctgttgtagctgcctcttgttcatggtagccttagatttataaaagctttgtttatgtattattcaaatagactatgtatttattttatctcctctttgtatactctattcttagaagcccatgatttgtactaccagttcttggggattgtataagattaagatctttatttacttaaattactttaataatggttattggaattggataattgaaagttggcttacctagcaggttgggttaggtgccatcacgactagttagattttgggtcgtgacaaggtggtatcagagctctagtttcataggttctacaagtcatgagaaagtgtctagtagagtcttgtggatcggtatgatgatgtccatacttatcttcgagaggttacagggaatttaggatatatacttcccatctttccttctttatcatgcggaattgattcagcttgggacataactctttgaattccttccacgtattcgtatgcacacatgagcactcggtattagctgtgcatcgacggcttgtgattctttgaacgaggttcgaggtgagtattatgtgttttggtgatgggccggtctggaggacttgaggccatggttagaccgtagcttgagctcggtagcttcagttgtaacctgtataattggactcatatgtccggtaatgaccctataatggaatttgtggctcgatgagcggtggaatagttttgtgatgagtatgatgtaactgcgggatgtgttaagacgatttgaatgtgacgtgaagtgtttccttaaaatgtaaaggaaggccatagggtgcttgattttcgttttgatgtgacgtacagtctctagtgtgaatgttttgaaggatatttcacgattgttaaattttgggacaaattaatttttcatgtctggttagtgagtttggactcagaaagactaagttatttgacttcgaaagggtatatcaagataccaatttgaggttaagcaggtgggttattccctgcggagtaatctacataggtatattacttatgatgtgagtggagagttttttttctgccagtcgggcatatgtgtggagatttgaatttgaatctggctgagaaagttaacttgagtgtcaagagaatgattgcgagcttagcaaatgatttggggtattgttttggttggcgttgcatgagtttgagaagaagttttgttgaacagactgtggcattatgatagtaatagagtattggtattgtgagttatggaatgttttaatctatggctttgagccaagtgggggagcctgttattgataattcaatttcatgattatatgtaaaggtttagttttaggctgaggcatactggtgggttagttatgacgtgcaaaagttgagatcgatgatgactcgaataaggaaattcctgggtacgggttatattgcacttatgagtatatgaaaatcgtgggatgagtgagttgttataggtgaatgatgtagtgcgcacaaagtatcaatttgataggttgtgttaaagtagagttacttctttgagtattgttgtgctaatggggcacgtgtcttttggcccatttgggcggtgcaatttagatttgagcaaagtgggtgacttccgagagaattctagtaggtttgagaattttatatagcaattgagaatttctccagacttgtgtatggataaaacctgagatttgcatttgatggttcctggacttacgaaagttctgtatgactagggattctacattttagtataatgaaggtgagaagaacagttttagattcacataaggtatttgcagagtgagtgttatagttgtggtgtttctggaggtggttaggaataatacatttgcttatgggccgtagggcgttgtggttctatgttagggttcgtggggtgaattgtggttaaagatcgtggtgttttagcaaggagaagtatcaatctgaagacaaattcggaagggacttggagaaaataggacaactgggtagtagactggactagtatggtaatggtaggatcggtcctttgggtaattacgatgtggtaagactttgcagatattttggtggcaatatttttgggtttggtgacctgcgtggcttggttgagttggagagattcagtcctgatggcttggttgtgcaaatggattccaaagtatttttgatggtttctaccgatgtggagaatgtgttgtgtattgtgatttcctcctagaaagaagcaagagaaatgtttctaactaaaagggtatgtaaattattggtgactcaaagttgataatgagattcttgtgcttgtcacatgatggcataatggatgtggtgtgttgtgtgggattatgatttacatgtacaaggtgacagttcagtcttgaagagaaggtaacgaatgttggacaacatgggcggtttcaaatgactagatgaatacgattactactaggtgtatgagaagggtgcgtatttcagaaggcgcattatattttgacttacatatgtttaattagtattgcggtactcacatggttgataaactgctgatattcaaattttgccaagtggaacggaagaacttttaaagtatttctcatgggatgatcgtgtatgagagaggtgttaggcattcgggcgctggagatggaatcaaatatggtgattcatgtgttctatggatttggagatttgggagttctcaggagaaaattgtttcatggttatggactgtgaagttgtggtcggagctacctagatgatagaatgtgttgtgattcagtcattatggattttggagggatttgtatctatttgtgggtaacccgagttgatttgggggtccattggtaggcccaattaagatgtgtattctacaccgagccggaatggttggctccatactgctattgttgagggatatgccattcggttgatgttgaacttattcgtgtcctgaaatgaactgtgagttacacctttatgctacaaggagctgtgattcattggttatgtgcacatatggtatggttctatttgagctttatagcggaatttgagtgcgatgagtgtttgggtattacatgattgattgcgtaatggttatgttctttcaggttttgtgtggcatttttgtcatttgcctctctgttgttattgattttgagcggggtggctcgaggtatatattatggaccagcatttggatggggtcacgcattgcagcggagttatgttaaggtatgaaccttgtgttagaatcgggtgatggttctacggtgtatgatgaatttttagcgtttcgttgtggcagtacttgttaatctggcggggcagttctctcatttgagttattttccatgattgagtacatttgaattgttgcgtattggtacgcggatggcacgtgatgtggctctgagttatattggtgcggcatgtctatggaacaattgtgtttagtaaaataaggtcagtggacatggaataggtactatcaggtttgaaatggtatattcgagaggataatattgaaattctgcttagaaagtgattatggttctggttggggcgagagagctccatgacttgttgatctgataaggggtcctgagatttctgcgtggttcttttattatcaacagtgtacgaaggttttgggatgaattttggttagatatggggtttaatactagtacctggttggttttggagtagttactgtgatcaggaatggtgctacgagcatgcgagttgtgtaatatgctggctgattatatctgtcattatagttatagctcgatgcagcttgttcggacttatacaacgtgtagatctcagattgaggtcttgaaaagaattttggatgttaaaaatttggctccatgggttttgggctaaggttaaattaacgattttcagttatgttgtgtggtcaggcctatatagaatagggtgacatgagatcacccaaagtacgtgtgtggtaataaggaaccatgatttgatggcttggaaacaactcttggcacgtttgaggatgaacgtatgtttaaatgggggagaatgtaacgacccggccggtcattttgagtattacaacatcatttttccatttactgctcaaattggttttatagttattgtgtgactggccggggcaattggctcgggtccggtgaggttttggaattaattgaaacacttagtttcaaggtttaaagcttaagttaaaatagtggccggatgtcgacttatgtgtaaatgacctcggaatttaattctgatgattccaatagctcagtatggtgattttggacttaggagcgtgtccgaaaaattatttggaggtccgtagtggaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagtttgatcgggggttgactttttgatatcggggttgaaatccgattctgaaaattttaataggtccgttatgtcatttatggcttgtgtgcaaaatttgatgtcaatcggacgtgatttgataggtttcggcgttgtttgtggaaacttaaaatttcaaagttcattaggcttgaattgcatatgattcgtgtttttagtgttgttggatgcgatttaaagattcaactaagtttgtatgttgttttaagacttgttgctatatttggttgaggtcccgaggggctcgggcgtgtttcggatggtattcgaattatgtttccttcattttttgcactgctggtagctgctgatttctggtgttccaaaccttcttcgcgatcgcgaagatcggggcgcgatcgcgtaagcttatttggggtagaggtattttgttctatgcagtcgcagagaaaggaacgcgatcgcgtaagtgtattaagccgtgcttcgcgaacgcgtggatgaggtcgcgttcgcgtaaaagggtttgagcagtagatgaagggaggcaattgctttacgcgatggcatggggctgaacacgttcgcataggtttgtgaggcagtgatccgcggtcacgtgagtgatttcgcgttcgcgtaaggtaaaatgtgtgggcagtctgctttgtgcttcacgatcgcgaggacatttccgcgatcgcgattaagaaaatttgggtagtggaaaactattctttgcgatcacgtggggatgttcgcgatcgcgtagagcaaatgactgggcagagagtttaagttctgaaccattgttgacggattggagctcgggaagaggcgatttttggaagattttcagaggaaacaacggggtaagtgttcttacctcaatattggttaaattacctgaatttattattgtttttatcaacaaatcagtgttttgggttgaaaatagtagaaaacttcatagattttaattgaggatttgaaggccgagttgtggttggatttgagaaattttggtatggttggactcgtggttgaatgggggttcggattttgtgagttttatcagattccgagatgtgggccccacaagtgatttttggggcgtaatttcggatttttggaaaatattagtattttgatatgaaattaattcctataatttttgtgagctgaatcaaattaattgtgactagattcaaccgagttagaatcacttaccccaatccatatggtgaaaatcgcctcaaaaatcgcttcaatccgagctccatagctccaaatgtgttaaaatggccgaaacctcaaaatatatcttctgtccaggcatttactcttcgcgatcgcgaagcacaaaatttttcagccccaaaattgctcttcgcgatcgcggaaaacttcgcgatcgcgaagaacaaactccccaactcttccagacagcctctagtataatggtcataacttttgtacaaaactccaaattgcaaatggtttaactttctgaaaactagacaccaagggctataactttcatttgttgctcatctcccaattccttatagatttctagatataagcttccaaagtcagccctgtgcaacagagatttccaaactcttcccagacagcctatagtgtatccaccataactttttgtacacaactccaaatgacaaatggtttacatttctgaaaactagacatcaagggctacaactttcatttttggatcatctccaaattccttatagattgcgagatataagcttccaaagtcgggtcagtgcagcaggattttcctctacgcgatcgcgaaaaggcttccgcgatcgcgattcacagtgcccaaacagcaaaattgctcttcgcgatcgcgaccatttgtccgcgatcgcgatgcatacctctgtggccaaaaaccagcaactaagaatggcctagaaatggtccgaaaccaccccgaaactcacccgagcccctcgggacctcaaccaaatataccaacaagtcctaaaacatcatacgaacttagtcgaagcctcgaatcacatcaaacaacgctaaaactacgaatcgcacctcaattcaagcctaatgaactttgaactttcaaattctatatcttgtgccgaaatacatcaaatcaatccggaatgacttcaaattttgcacacaagtcataaatgacataacgaagctattccaatttccagaatcggattccgacctcgatatcaaaaagtcaacccccggtcaaacttcccaaaaattcaactttcggcatttcaagcctaattccactacggacctccaaataatttttcggacacgctcctaagtccaaaatcaccatacggagctattggaatcatcagaattaaattccgaggtcgtttacacataagtcgacatccggtcactattttaacttaagctttaaaccttggaactaagtgttccaattcattccaaaacctcaccggacccgaaccaattgccccggcaagtcacacaacaactgtaaagcccaatttgagcagtaaatggggaaacggggttgtaatactcaaaacgaccggtcgggtcgttacattctcccccacttaaacatacgttcgtcctcgaacgtgccaagagttgtttccaagccatcaaatcactgttccatcttaccacacacgtacccgggggtgaacccacgtcaccctattccatatgagcttgacaacacaatacaactgaaatcattgatttaactttagcccataaaccttggaatttaatttccaacctttagaatttctttcaagacacgaatcttacatttacaccctgtatgagtttgaacaagctgtatcaagccataaccataaccataaccacggacataatcacctaacatattacacaactcgcatgctcatagcaccattcctgaccacagtgactactccaaaaccaaccaaatactagtattaaacccatatcgaaccaaacctcatcccaaaaccttcgtacactgttgataataaaagaaacatgcgaaatttcatgaccacttaccagatcaacaagtcacggagctctctcgccccaaccagaaccataatcactttctgagccgactttcaatattatactcccgaatataccgaaatcaaacctgatagtacccattctaggtccaatgaccttatattactaaacactgttccatagacatagacaccaatataactcagagccacaacccgtgccatccgtgcaccaatacgcaacaattcaaatgtacccagtcatggaaaatgactcaaatgagagaactgccccgccagattaacaagtaccgccacaacgaaatgctgaaaattcatcatacaccgtagaaccatcacccgattctaacacaaggttcataccttaacataactccgcaatgcgtgaccccatccaaacgctggtccataatatatacctcgagccaccccgctcaaaatcaataaccacagagaggcaaatgacaaaaatgccacacaaaacctgaaagaacataaccattacgcaatcgatcatgcaatacccaaatactcatcacactcaaattccgctataaagctcaaatagaaccgcaccatctgtgcacataaccaatgaatcacaactcctcgtagcataaaggagtaactcacagatcatttcagaacacgaataagttcaacatcaaccgaatgacacatccctcaataatagcagtatggagccaaccattccggctcggtgtagaatacacatcttaattgggcctacctatggacccccaaatcaactcgggttacccacaaatagataaaaatccctccgaaaatccataatgactgaatcataacacatttatcatctggctagctccggccacaacttcacagtccacaaccatgaaacaatctgctcctgggaactcccaatctccaaatccatagaacacgcgaatcaccatatttgattccatctccaccgcccgaatgcctaacacctctctcatacacgatcatcccacgagaaatactttaaaagttcttccgtgccacttgacaaaatttgaatatcagcagtctatcaaccatgtgagtaccgcaatactaattaaacatccgtaagtcaaaatacaatgcgccttctgaaatacgcacccttctcatacacccaagtagtaatcgtattcatctagtcatttggaaccgcccatgttgtctaagaattcatgaccattctgcccaaacttcgttaccttccttcaagactgaactgccaccttgtacatgtaaatctaacttccgcacaacacataacatctatcttgccatcatgtgaaaagcacaagaatctcattatcaactctggtcaccagcaaattacatatccggttagttagaaacctttatcttgcttccttccaagaggaaatcacaatacacaacacgtttctcacaccagtagaaaatatccggttcccatggtagaaaccatcaagaacactttgaaaaatccatcttatagtctcaagccaccatcataattaccatataaataccacaaccgaaacacccactctgaaaataccttatttgagtctaaggccgtttcattcaccttcctgataccaaaatataaaatccataatgatatacaaaaatgccacaagtctcgacaccatccaacttaaatctcagattttagccgcaaacaaatccgccaaaaattctcaattgttacatataaatctcgaatccattagaactttctcgagaatcaccccctttgttcaaatccacattacaccgcccaaatgggccaaaagacacgtgccccattagcacaacaactctcaaagaagtaactctactttaataccacctatcaaattcatactccgtgcgcactacatcattcacaaataacaactcactcatcccacgatttttcatatactcataagtgcaatataacccgtaaccaggaattttccttattcgagtcattttcgaactccacctctgcaagtcatcactaattcccaagtatactttagacccaaacaaaatttgacacatacccatgaattgatttgtctatagcaggctcccccacttggctcaaagccatagattaaaacactccataattcacaatacccataccctattactgtcataataccgtagtcagtgccacaaaattcttctcaagctcatgcaatgccaaccataaaaataccccaaatcatccgctaagatcgcaatcattctcttgatactcaagtcgactttctcagccaaattcaaattcaaatctccacacatacgccccactggcagaaaagaaaccctccactcatattacaaggaacacacctacgtagattactctccaggagataacccacctccctagcctcaaattggcatcttgttatatcttttcgcagccacaatttctacgcaatcactaaatctttctgaaccgtttggaagttgatacgcgcagaatggaatttctggagcattgcttagcttgctcgacattggatttggcttattcgaggtaagtaactcttctaattttggagctgagggtatgaaccctgaatatatgtattatgtatatcgttgggaggtgacgcacatgctaggtgacaggcgtgtggacgtgcactatagaaattgtgacataattgtttctgtggaattttgtagttaaataatcttggcattttccatgcagctttatgagttaaagaaattgagctgaaaagcatattaaaattcatgttgaggctatgtgccaatattattgggacccatagaggtcatattgctgtgaattgttgtgttaaattgaaaattcatactcagtcatattcatttcattgcatatcatatctcaatctctgttgttatttattggtacatcatatcatcatttttgggctatttttcataacattgtgagcccgagagactggagagattgatgactgagtgaggccgaggacctgattgtgaggattagtatggatcagggctgcccgcctgcaacatactttattattatagcacgtgagttgtccgtgcagcacgcgagttatccatgcagattatagcgcttgggctgaaggagcccctccggagtctgtacaccccccagtgagcgcaggtacttactgagtgcgagtgccgagttctgagtgactgggaggcatgagtgattgtgagggatgcccgagtggcatgagtggttgtgaggtatgcccgagaggcatgagtgactgtgaggtttgccggaggggctgtatatgagtgatgttctgcccgagaggctgtttatgattttatcactgagttgcatcgcattggcatgcacgcataacatacatagagatgtattttccttatgctgtacaacatcatatcattcatgatttctcacacattttgacagatgggcatagtgatgcatggttggactcgtggttgaatgggggttcggattttgtgagttttatcggattctgagacatgggccccacaggtatttttggggcgtaattttggatttttggaaaacattagtattttgatatgaaattaattcccataatatttgtgagctaaatcaaattaattgtgactagtttcgagccgtttggaagttgatacgcgcataatggaatttctggagcattccttagcttgctcgacattgggtttggcttgtttgaggtaagcaactcttctaatgttggagctgagggtatgaaccctgaatatatgtattatgtaaatcgttgggaggtgacgcacatgctaggtgacgggcgtgtgggcgtgcactatagaaattgtgacataattgtttctggaattttgtagttaaataatcttggcattttccatgcagttttatgagttaaagaaattgagctgaaaaacatattaaaaatcatgttgaggttatgtgccagtattattgggacccacaaaggtcatattgctgtgaattgttgtgttaaattgaaaattcatattcagtcatattcatttcattgcatatcatatctcagtctctgttgttatttattggtacatcatatcatcattttttggctatttttcatgatattgtgagcccgagagactggagagattgatgactgagtgaggccgagggcctgattgtgaggattagtgtggatcggggctgcccgcctgcaacatactttattattatagcacgtgagttgtccgtgcagattatagtgcttggtctgaaggagcccctccggagtctgtacacacccctagtgagcacaagtacctactgagtgcgagtgccgagtgctgagtgactaggaggcatgagtgattgtgagcgatgccctagtggcatgagtgattgtgaggtatgtccgagaggcatgagtgactgtgaggtttgcccgaggagctgtatatgagtgatgttctcccgaggggctgtttatgattttatcactgagtttcatcgcattgtcatgcacacatgacttacaggcataaagatgtattttcctcatgttgtacaacatcatatcattcatgatttctcacacattttgacagatgggcatagtgatgcatttgttttacacaggctatccgaaaggaaaatgaaacatcttatttattattgaaaagattttgggagaaatttattgttttcaaactattcacatttttggcaacttcggcaacgatttgggtttttcactgatgtatttgaaagaaagaactatattgttttgaaatcatgatttggctgagcattttatctctgtatttcttctagtattatttcctttaagttgttatggactgttgtggactattggttttggacccgaccctggtagaagctcgtcactactttcaacttaaggcttggtttgttacttacttagtacatggggtcggttgtactgatactacacttctgcatattgcgtgcagatgttggttgttgttgttgctgtgctcgatggttgtaggattgaagatgtacctgcgttcctgttgtagttgcctcttgttcatggtagccttagatttataaaagctttgtttatgtattattcaaacagactatgtatttatttcatctccactttgtatactctattcttagaagctaatgatttgtactaccagttcttggggattgtataagattaagatctttatttacttaaattactttaataatggttattggaattggataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacctaacgggttgggttaggtgccatcacgactagttggattttgggtcgtgacacacgcccacacgcctgtcacctagcatatgcatcacctccaaacaattcatataacacgtagaatcatagttcataccctcagctccaagattagagatgttatttaccttgagcaagccaaatttaataccgagcaagttgtacaatactccgaaaattccattatgtgcgtatcaacctccatacgccttcctatctccccaattcaagccaaacaattcgtatctattcaaacaacgtgcaaattaatcacaatttactctaatgcttacaatttaataaattacaaaaatttccaactccgctcgaaaaattgatagtgggctccacgtcttgaaatccaacgaaactcacaaaattcgataacccattcaattacgagtccaaccatactaattttactcaaatccgactccgaatcgatgttcaaatttcgaaaattcattttatggaattgtagaaaattcctccgatttctcttgaaaaatcaataatctaacgccaaaaacgaagattaattcatggaatataatcacaagggagtcaataacaattaccccaagttgtgtggtgaaatttgcctctgaaaatcgcccaaaccgagctccccaattctgttttcgtcaaaaatggaaaaacctcccatttatagggatttttagtgttcgagcaccacaggtggcgcggggcgccacatgtggcacagggcgccacatgtggcacagtttccagcatcccaaaaattcccagcaccagggctagcgccccacgcaaccctgggcgatggtggcgacggaatattgttcccgatatggaaatgggcataactctctcatacgatgtctgaattcaacgattctttttgctatggatccataatttcagtatggatataatgaatttggagctcatttgattaatatgataccacttatgcttgaagaaatgacgtcgaaacattctggaaatatccaaattaaatttcgttaaccatccgaaatccacccgaggccctcgggacctcaaccaaatataccaacaagtcctaaaacatcatacgaacttagtcgatgcctcaaatcacatcaaacaatactaaaaccatgaatcataccccaattaaagattaataaactttaaatctcttaactttcaaacctcgcgccaaaatatatcaaatcaatccggaatgaactcaaattttgcgtacaagacataaatgacataacgaagctattccaatttttataatatgattccaacctcgatatcataaagtcaactccccggtcaaactttcaaactttaaatttcctatttttgccatttcaaggcaatcttaactacggacttcaaaatgaatatctggacacacgcctaagtccaacatcaccatacggatctattgaaaccatcaaaactccattccggagtcgtttgcacaaaaagtcaaattggtcaactcttctcatttaagcttctaaataaggattgctctttcaattaaatcctgaatcatccgaaaaccaatgccggcaattcacacaagtcataatacgcattacaaaggtgctcaagactttaaattgtcgaaaggagcgtagatgttcaaaacgacaagtcaggtcgttacataagtatatgagtaattttacacacacaaacacatatgcacacacatacattatattgtaattgatgatcaatcacatacattactacgtacgaaaactttatcaattgatgaattgataaaccaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattttaaatatgtttagtcgattgttattgtcacgacccaaaaatcacacatgtcgtgatggcgcctatcccgatactaggcaaaccgacaacatcaataacccacaattttttttaaatattggaaacataataattaatttaaggggaaaaatcccaccaataccgaatataaatttactcccaaaatccggtgtcactgagtacatgagcatctatacattacaagtctggaaaatacggtccataatagtctaagaccaaatacagtaaacaaggagataggggaggagagacaaggtttgtgaaacatggcagctacctctcagtctccgaaaaatcaactgtgtgaaaataatcaacacccactgtgtccgggatcacctggatctgcacacgaagtgcatggtatagtatgagtacaaccaactcagtaagtaacaataataaataaagaactgaaagtagtaacgagcttctcagctaagtccaaacacagcactttccaatataaaagggtaggcatgctttcaagttcaacatttaaaactctacagtaatttcatatcaaattttgactaaaacagaaaataaagttttttccaaaatttccaaaatagtgatatatgacagttgagatgcaacaaataatgaaatcaatgcatcctttcagagtaacagtcacggagtcctcacattcactccaacctcacagtcactctttcctcgcagtcactctttcctctcaatcacttagcactcgacactagcactcagtaggtacctgcgctcactgggggtgtgtacagactctggaggggctccttcatcccaagcactataacaagacaatcatggcataaatcaatgaaacatgatgcgacgtgcagcccggtcccatacatatcctcacaattaggccctcgacctcactcagtcatcaacctctatagtctctcgggctcaagatgtcataaacattagcccaaaaatgataatatgatgtatcaataaatagcaacacggactgagatatgatatgaaatgaatgaacatgacttagtgtgaaattacaatttgaacatataattcaaccacagaaaataaccccagtgggtaccaataataacaacatatgcctaagcatgatttttattacgagtctcagctcaattttctctaatacgtagagaatgtacggatattaacatataattcaactacacagttccatggaatttgaccaagtcataattcctatggtgcacgcccacacgcccatcacctggcatgtgcgtcacctcaaaaccaatcacataacacgtaattcggggtttcataccctcaggaccaaatttagaattgttacttacctcaaaccgtgtaattctttattccactatgtccttgccatgagaattggtctccgaaagcctcgtatctatccacaattaattcaattcagtcaataccaattattgtaattaattccataaggaaatactaattttccaataaaaatccgaaattaactcaaactttgcttgtggggcccacgtatcggaacccgacaaaagatacaaaatatgaacgcccatccaaccacgagtccaaccatacaaatttcaccaaattccgatatcaactcgaacttcaaatcttcaactaaagtctttgaagatttctaccattttctacccaatctttacccatttaaactcaacaatatttccacaaaccttattggtatgtgtatgtataaataatactcttacagtcaagaatcatactcccaataacccatctttacccaaactcgaaattgaagaattgggggaagaaattcttacctctttgaagccctagtaagatccttgtgaaatcttcaagtcttgaacaagaattgatgaataattgactaggtcttcactttttctctctaagatgctctcaccactctctaaaatatcagagttttgctccaaaagagtctctttgcctcaatatattgaaatagggtcggatcaaaaattaaaaaaattgaagcgccgacactaatctgtggtcgcatatgcgaccgcataatgcttctgcggccagcataatgcgccgcaaacctggtctccaaatctgcctcacctgcttcactctgctgccattatgcggtccgcagagtgattctgcgaccgcatagtgggccgcaaaaatgttttcttctaccaaaaatatttctttaccccctagtgcattgttcaacccgaaaagtttggcaccataaaaccttaatttcctttgtactaatttcctttctataacctttgtactaattgatctacctcgacaccacaaaaccttaatttccttagaaaaaattctccggggtcattacacataagtcaacatccggttaaccttttcaacttaagttctaaatcttggaactaagtgttccaaatcattccaaaacctcactggacccgaaccaattacccccggcaagttacataacaaatgtaaagcataaattgagcagtaaatgagggaacggggttgtaatactcaaaacgaccggccgggtcgttattgttatattattaactcatttacttaatgttaataacttctttcatttctttaatttgtgatccatatatacatgtcacatatttttagtattaattcttctatattttattcattcatcaccaataatacattacatagattaatcgatataggtcgagacattttatttttaatattcatcgatataggtcgagacgttttgtttttaatattcatcgatacatctaagttagttatatgtcgatgaatcaatttacaaatagatatattggatgatgatcaattatatatactaattagattattgcttcttcacaagtctttccccaaaagaacccgaccctgtggccctaacgtttcgtgttcttagatgcggctatacctatatatatatatatatatatatacacacacacacacttcgttgtactactttaactatatatagcttgttatagtatatgttagtgtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccagaaattacatctaccaaccaaagttggttggtaaaatattcccctacaataaccgaccgtctttggtcggtaaatttaactataaattttataaaatattttaaataataatataattattaaaatttaaaatgtggatccacattaccgaccgatgttggtcggtaatcaaaaatattctttgactaagcaagtctgaccactggggtcaaatgtttgaccaatataccgtttaaaaaaatataaaatatttttttggtagttttcgtccattgtgacagttttttggttgcttttgtggaccgagcaacgttggtcggtatcgcttggtcggtgtttcctggatttctagtagtgatatggcatgtgttacgttgttgacgtaattgtttaaccaaaaaataagatctttagtcaaagcctatttttagaagaactcgggttattattaaccaaatgattccttacttcctcagtaattcacttaaaaggaaataaagttgacaaaaagtaactaaaaagaaagaataattgattgcactgaataaacaagagaaagtgaatatatttctatagcactccgaacgtgtctttacaaatgagattctcctcccttatataggagtttaaaaatataacgtttcctcctatttatggcggaatcattatgagctttaacgacattaattgtccgttatgattggtaatcgtaactgtctatgaagattttgtaacgattctgattccccttcttcattaattgtaggtctgtgaatcttccctctttccagtcttgattcattccgctcgtgcctcttcaacaattattttaggttcgaacattgcttatccattatctcgtgggtgtttgccccgtacctcttgtggttcatacaccttttaaatgaattatgtcagttgtcatttccttattgttctacgtatcatgctctgtcagctaaatataattccacgtgtatcatttatttaccaccaataaagatagtcgccccactttctgaatattctacaattgtatgttcggtaagtggtaagtatttatggcaggaattctttgccgccatttcccaagcatcattgtgctttcttcaaaattaacgtgtcgtatgtcacttccatttaatgcatatgccacgtgattttgatgattgtttctgtggcttctcagtgtttttaggacttttcatacttcttaggttttatgaaacctttattctacagtgttcttcttcttcattcttcctttttttgacgcatatccctctgttaattccttatacaaccatgtattcatcaactcctgaccctcgcaaagtcgtaattgttgatgaacttgctccttcatctgcttctgtgagaagtagaagaggtggcagacttcatagtttaggttcgctgtccactcgtggttcttcatctcaaaccactaccctcacttcttcttattctaaacctagggcttctttaacccctagatcttcttctagaaatagggaatcgagtgagtctatacgtgaaccaacggttgatgaaattgttccacatcaattttctttctcatctgatcgagaaaccataagaatcaagtttcttctttagcttcttatggtcgtgccgatctttatcctactcaaattaccactggtttaatttctcttgttcgaagagaatgtaaatagaaacctgacttcctagttttagttcctgatccaaaccaaagaataacctacaatcaggctggttattcctttatttatacatatcctttcactttaggatttagaccacccattgacccagtaatcattgagttcttccgcttttttaatgtatgcctgggacaaattggtcccattgtttggagggttgttgcatgccttcattacctatctaacttggcttccttgcctttcacctttcatcatttgcttcatctttattccctcaaattatttcatgaaggggtgttttcacttgtggccagaagcaagagggtattggttatccctgaggataatagagatcgtggttggtatgctcgctttgtagctgctcccacaagtgcattggtaggtaatgagaatatgccctttctagaaaagtggaattttgcacgtaagcgtttttcctttaccttttcttttctttcttgaaacaagaaacttttaatctcgtgtctactttttcagcaaccatggaagttttcgaggagattcctaacttccgtgcttgggtagaaaagttattgtcagttgcccctatggagagtaggtcttggaagtacctttctcaaaggtttggttggaaagttaaaacacacggtaccttttctgttcaatttctcttcttctcttgtgttggcttaggagcttcttaccaaacttctctcttttgttaggattttctattcgtggtgtcagtcccgcgtctatttcttctacaagactttctgtatctcttgctcaagagagaattttgagctcttcatcgaaaagaaaagtgaatggttctcgtggatctgagggtggagaagaataggaagagggttctttagtgcgcatgcctcgggttaggaggcgcattatttccgatgatgaagctacccatcctccaagttcaatcccttcgagacttttagatgagcccgaaagtgctacattagtgatttccgatgaagagatgaatactcgtccttgtgattctgctgatcagttgtttacccgtggttttgataatgaagcctttggtcccgtttctgaagagttgcctctagcctctcttctagtgttagtccttgttcgttctaaagctcccctacatgaagttgctgctactgctccctccgtgactgcttccaccttctctactattccagttgctactacttctcatgcagaagttgggccttctagtagcaataaagcgatgaagaagattatcattgaggttcctgagagtgggaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagagtaggaaacattggagagtcacgactcattaacttggatgaatgatattgttcattcatctatgaaggttcgagttttaactttacttcttttcttttccttgttgttttcttttatttaaccacaactcccttcctttattttttagatcaatctgataggcacgaagcttatgaaaaggattgttcataccgagcaacaagtcattgattaccttaccgaagctgacaactggaaggagcaatttgagggtctttaactggagaaggacgttttggttgaagagaagaatgccttggagcaacaagcgaagatggttgcggctgagttagcaattgaaaaggcatcttcaagtcaagttggtaaagacaagtatatccttgagtcttcattcgttgagcagctttcgaaagccactgaagagataaggggcctgaaggaacttcttaaccagaaagagacttaatgccggagagttaattcaattacttacacaaactcaagaagatctccatgcctcttctgataagatcaagttcttggagagttatcttgcccctttgaagactgcctttgatgtttccaaagttgagaaagaagagctgaggttgatgttcccgaaggtgacgatcctattcctggtgaagttagtgctcaagcccctactccccaagctgaatcttctcctgttgctgatgatgccaccttggatgctgccccttagttttatttgaaactttttgatgcgaagtttttttttctttttggaatggatgttagtttttacccctatcttgttttggagtttgataacaaacaagtaccttagttttggctaagtttaatatataaatctttgtttattttgatgttgagtttttgttttactctttggcttttaaacctgcatttaaaatgctttaatattttgttattttgatagacacgaatttttataaaagagggcccttttataaacaacactaatgaagaagatgtctcaacttcatattggtgtaaatatatgaaagtaatagaaaaaggaatattttgaggaagtttcatgaataatttgaggaagtttcatgctttgaactttcaaattttatataacacttttcatgtatacaaataacattttgtacaatatctacacttctttcataactattttctttgtaacaagtttcaaaattttgggtctattgagtaacccgtgactaattattgcccttaacctataaactcgtaggaacttgaaatgcagcttgtgtccatcttgtatctttcccgtgagtttataccttatcaaggctacttcaaagttttttgagtcaggcttgttttttggctcttgattagctcttgacttttgacttttgggctgattcaggcttgaattatgacttttagtcttctttgcctttttatatacagttccccaagtgttagatctttgaagtataaaatctcgagcacttgattgttcctttaatttggtccatttcctgaaaaggaaaatacatacgggactcagaggtatacatttagatgatgactgctaaaccctttttatttccatcagaaaggttgtaacctagacagggaataattctgtattccgcatgtctttcgggtctaatgttatcatttggtatgggctagcttttagcctatcatctaaaattgttagtataatttaaaagaacaaaataaaatcacagttgagcgatacctgatcgtgggtattttctttgcctagaagtaatacttctttaaatgaagaacattccaattcgacagtagtaccttcccttccatggtttccaacttataagccctttttccagcgatgcttcaaatcttgtaaggaccttcctaatttggacacaacttccctgaaccagttgcttttgttgtttgaaaaacctttttgagaacaaagtccccaatcttgaagtatctaagatgagcttttatgttgtagtatcgctcaataatttgcatctgagctgccattcttattagagtcgcttctctcttttcctcgagtaaatctaaattctttctcatctcttcaccatttgattgatcaattgcttgtgtaaatctcgtacttggctcacctatttcaactggaattaaggattcagcaccataaacaagtaaaaatggagtctctctcgtgcctgtctttgttgtcgttcgataagcccataatactcctggtagcacctcaggccacctgccttttgattcctctaatctcttcttcaaattattaataataaccttatttgttgattcaacttgtccattggccacatgatgataaggtgaggaagttatttaattaatctgctaactctgaaaattttttgtgactttcgtgcctatgaactgtgggccattatcacatacgatttctcttggcactccaaatcggcatataatgtttcgccaaataaagtccatgatttccttctctcgtacctgtttgaaggctcctgcctctacccatttggaaaaataatctattaatactaacaaaaatcgtacctttcctttagcttgtggcaatgatcccatgatatccatcccccacttcatgaatagccatgggaaaataaccgtatgtaatagctctgttgggtaatgcatgttattgccatatcattggcatttatcacactttgccacaaaactttctgcatcttcttccattttctgccagtagtatcctgctctaattaaagtctttagcaaggatcttcctcctgcgtgatttccacaatgtcccccgtgtacttctctcatcacatattttttctgagcaggtcccaggcatcttgctaaaggttctctgaatatttttcgatataaatttcctcgaattaagcagtaacgtgaagcttttcatagaagtaactgagactctttcttgtcttcagttaaggttccatacttcagaaaattaacaaattcgtttctccagtcccaagttaaattattgaaatttacctcatttttatcttggtcgagtgctgaatgaaacaaatgtattacgatagcgttttttgcatttgttatttccgcaactgacacgagatttgctagtgcatatgcttccgcattctcttccctgggtatttgcacaattttccatgtctgaaattgtcttatcaattctcgtgccttttccaaatattgctgcatgcgtgcctctctagctatataagtcccctgcatctggttaactaccagctgggaatcacttttaattatcattttctctatagccaattctcgtccgagttctaaacctacaattatagcctcatactttgattcattattagtaattggatagcattttattgcttgtcttatactttttcccaaaggtaggattaaaacaatacctaaacctgctcctttaacattagaggaaccataagtaaatagagtccatgtacctggattagatccagtgaatacctgtagttccttttctttttcaggaactatttctgtgctaaaatccgctacaaaatttgctaaaatttgtgattttattaccgttctaggttggtacataatattatattcactgagttctatagcccatttagctaatctttctgacaattcttgtttatgtagtatactccttagagggtaagcaattattatagagatatgatgacattgaaaataaggtctcaactttctagatggcataactaatgctaaagtaagtttttctaagtgatgatatcgagtctcagcatctaacaaagatttactaacataataaattgaagattgtttacctttatcttctcgtactaaaaccgcacttaccgccatttctaatactgcgagatagatgagtagcctctcttcatcctttggcttagctagcaggggtagatttgacaaatatgcttttaaaattttaagggcttgttgacattcatcagtccactcaaattgatttttctttttcaatactgaaaagaatttaaaacttttctccgaaaatttggaaataaatcttcccaaagctgctattctccctgtcagcctttgtaccttatttttgctcgtgagtatatctggaattttttcaatggctttgatctgcgcaggattcacttcaatacctctgttagatacaagaaaatctataaacttacctgaagccacgctgaaggcacattttttttggatttaatttcatattatttttgcgaagaattccgaaggtgcttgaaaggtgttgaaagtgatctcctgctcgtgcagattgactagcatatcatcgatatagacttcaatagtctttcccgggtgttcttgaaacattgtgatcaccaatctgtgatacgtggccccagcgtttttcaaaccaaaaggcataactttgtaataataagtccccatgtgtaataaatgaagtttttttctcatctaagggatccatatttatttgattataacctgaatatgcatctaaaaaactcaaccgctcatgacatgaggtagaatcaatcaattgatctatatgtggtaaatggaatgaatcttttgggcaagctttatttaaatcagtataatctacgcaaacccgccattttctattcttttttggaagtaccacagtattagctaaccagttcgggtattttacctccagtattgaaccgatttttaaaagtttttgtacctcatcctgaatcactttatttttgaaagagccttgcttatttttcttttgattgacaaggtacgagggattttcatttagtttgtgggtcatctcctccggaggtatacctgtcatatctgaatgcgaccaggcaaaacaatccgcgttagctttaaaaaattcaactaacttacctctcatttctcggctcagcttcgctccaatataaacttttcagtctggccattgctcgaatagtacaacagcttccagttcttcaattgttgttttgatgttttcattctcctctggttcttgaatgacatcaggtctaaaatctacatctgtttgccttaagccactttcagctgagatccgatttaccatatcttcgacgggattcttgttcgtatcttcattcatcgtacgcgaatctaccactgaattgatatttttagaaacctgttgatctccacggatttgccgaattccccattgtgaaggaaacttaatgacttgatgtaacatagatggtacaacatccatgtcatgaatccatggcctcctaagaatcacattataagtcatgtccgtgtctattacttggaatttcgtatccttgataactccttctacaaatgtggtaagcactatctccccttttgtaataacggttgaattatcgaatccagataaggatcgttcttttggtactatcttgtcgcccatttgcatttcgttcaccactcttagaagaataatattcatggagctacctggatcaatcaaaactcattttacattagtattatgtataagtaaagatattaccagtgcatcattgtgagggattatcaagccacctgcatctgcatcatcaaatgttatactatcttcttccaaaacatggcgaactcgcttcccgtgggtcacagtgaactttgacgtctttttcgcagctgtgtatgttacaccattgacttcttccactccgcttatcacgctaactgttcttttttggagacggaggatttggaggttcttgtctatttttcatataagattgcttgcctttctcgctaaacaagttggttaaataatattgctttagcaaatgctctactttaccttgtaatagtctacaattcgctgttttatggccatgatcattatgaaactcgcaccagaaatctggatttcttctgcctgggtttgatctcatttactttggccaccgtaccttatctcccatattccttaaaatagctaccaactcagatgtgctaatattaaaactgtaatcaccaatccttgcattcatgtcagtatctctatcacgtacatcttgttcttttctgaacctggatgatgatctcgcatctttgttcctcgatctagggtctgaccgtacattttctggtttggaccgtgagtcccgcctcgcaggtcccatataaggctcgtaccaatttttataggaccttttttcagactctgaccgccttgaatttgttctttcatcaacccttgactgtgcgacgatgtcttcttcaatccatagcttggtgatgtacctgttatatacatcgttccatgttgtagcagggaattctcgtaagctttccttgagtcttctcgtgacttctgagctcttttcattcaaattacttgcgaacgccatggctgcccaattatcaagtactcgtggaagaatcattctttcacgttgaaatctatccacaaattccctgagtaactaagtatctccttgttttaccttaaagatatcttccatccttttttcaactttttgagctcccgaatgtgcttttatgaataaatttacaagctcagcaaaagaaccaatagaattttcaggtaaaagagaaaaccatgttaatgcccctttcgtgagtgtttctcgaatatttttgaccaaaattgactcaatttcttgtttggtcaaatcattgccttttacgcctgttgtgaatacagttacgtgatctcatgggtcagttgttccatcatattttgggatgtcaggcatttcgaacttcttaggaatgggcagtggggccgcgctcggcttccatggttgttgtgaatatttatcgatatccactcccttaatcgcaggtggtacaccaggtatttgttacatgcagtcgttttgctctttcgtctgtttctgcaaagttagtacaaaattttataaatcagagttatttggtgtacctgaactcccatcacgtgattcattgggagttcccccgcttcctgaattggcaagccccgagcatggattttctatagttgccgtattatttgggggaggagttagtggtgcagttggaaatcccctaacaaaatcttggagagcattgttcacatgttcaacgatcaattgttttaaagcatattgcttgacagtctgctcgtctccatgttgttcatttgtgtgagacgtggatctttcaggtgttccttctcgagaatgacgtggagattcctgtggtaaagaaattggaggagatcctccctcctgttggttacttatgttgacagttgacagttgacatgatttggttgtgacaaagaaggatttggaaagtaaaaagattatcaattttccggtaacggaacaaatttgtttaaccaaaaaataagatcattagtcaaaacctatttttagaagaactcgggttactgataaccaaataattcctcacttcctcagtaattcacttaaaaggaaataaagttgataaaaagtaactaaaaagatagaataattgattgcactgaataagcaagagaaagtaaatatattttgataacactccgaacgtgtctttacaaatgagattctcctcccttatataggagtttataaatataacgtttcctcctatttatggtggaatcattatgagctttaacggcattaattgtccgttatgattggtaatcataactgtctatgaagattttgtaacgattctgattccccttcttcattaattgtaggtccgtgaatcttccctctttcgagtcttgattcattccgctcgtgcctcttgagcaattgttttaggttcgaatattggttctccattatctagtgggtgtttgcctcgtacctgttacgcttcatacatcttttaaatgaaatatgtgagttgtcatttcctcattgttccacgtatcatgctctctcagctaaatataattccacgtgtataatatatttaccaccaatacattaataaatggaaatcgttgttcagatagtatattacattaaattgtaagtactatttttcaacgtatgtaaacctgtcaaacgcctttgctcctcctacgctaaactatagccaaagtattaattacttatattgctcgcaagatcaatttaagtaaatgtttatctactgcctatgagaagcagaaccaattttctaaaatctaaaaaataaaacaacaacctgttatgacaagtgcattaaaataaacgagaaagagaaattaaacacacaaagaattctaaaacttgatcttacgagttacgagctacacattaatattgcattgtaccttttgtttcttttacttaacaataaaccaagaggctaattgtcatatatatgtaagtgttagattattttcttcaggcaaaaaaactagacgttaaacatctctccacgatactttgactgtccaagttggctgtagctaagctgttaattagctcaacatttctcctctttgaactcggggcatctcccaaggaagaagatgaaagctcaatatcgagttctcgtgaacgtctccgtggcctcactctattaatctcagtaacattagattcaatcaagtgagggaaattgagtacagctcttgaaccgcgcagtttaaatgcagttctgtcataagccaatgctgcatcctcaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgcatattttccccatggtctcctcctcactcctttgtatttcttcttttccagtggcacctctgagtttggctccttattttctgctgtctcgatatgatcttgatctgcatataaattttcttgattgtgttgtgcaaatatggtgttttcacaacttgattgtctcggtgtttggatggtgttattggatgaatttagttctgaaaagatttgggaaaagtcaggatcattgaagagatgttgcatggtgtcaagaaaattttgctgatcaaactctaatggtattccctgcatctttttttttttttttttatgttaaagttctttttgtgattgtggtgtacactttggtaatgagaattagaaaatgatgatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggggcctggccgtgggtcttaacattagtattattatatggtttcgtgagtaagtagttcatgaatgtgggagattaagttgtacttttctagccaccagtcaaaatcttataattaaatttggattgttttcagaaagggaattatatgagagaataggtctccaacggcaacaatgcttgaaagtgatgcctcctgtatattggtaattgtattaatattaagttgaagacattgtaaaatcggatatcacttgatctccatatcaaattaagtaatttactcttaataattctagattagaacaaagtatatatcattcaaaatatatataaccctaatgtccgaggcacctcaactaattttacgggatacatgccacctcttaccagcaacatatattagataaatatattattttacaatataattgattactgtaaacatgaagcaagaataaattctactagtatgagatatatcacgttgtatgcataaaagtctatcaccattcaaaataactttccaccttacctgataaatactaatcactcaaacaaccaagacaatgcaagtctgaaagttcatagtattaactcattttagagctaatttttctaccacttgtcatatcactctgctttttttttttttcctcatccgatattcgatatttactttggccttaattaatttggattcgtgccgcgtgaaacctctaattaaaagaaaagtgctctctactataaaaaaaaagggctcacacgtgaaacctctaattaatgatgaaataatcttattcattcccttacaactttgacagtgtcttatcaatcttaatagcatgtttggcaaagctgaaaaaatcagcttattttgataagtgcatttttcaaaagtacttctcgagaaaaatagtttgtgtttggctaatcaatttaagaagtacttttgagtagcaatttgtgtttgaccaagattttcaaaaaatacttttaagtatcaaattacgataaagacatgaagagatgtacttaatagttaaaattatataaataaataaataattataaatatttattattaaagataataattaagtttttattttatttaagtaaaatataaaactaaattgaaaagtactttatccttttaaaatgatttaactatatcaaaaaataattcaataaatatgaactcaaaagttattatatattacttaatagtttaaactaagtaagactattttggtatatacaatattttgttaagggtatttttggtagtaagaaaattcaaaactgcttctgcttccggagagaagatacttttttctgcttctcccaaaaaaataccttttttcctccaaaaagcttgaccaaacactccaagttaagaaaaaaattgcttttttttgaagaaaaaaaatatttttgacaaaaaagaaggttggccaaataggctataagccatctgttcgtcgattttgcatgaatttacgcgtttgggccactttcattcaaaaagcattttaactgctgttaagttaattctatcatgttaactttcaacctcatcccaatttttgaataatagaaatgtcaatcgttattttatataattttcttatatcataattcaaattaacataaaaatcattcatataaagaattgatgtgattttttcctttcagactacattttaaattattacctatctttgaataaagtggacatatgttgacctcaacggttattaaaactatattgtgtgaaaaacttattatgtattttttaaaattaaagtcattcacataggatatactgacccgaggttattaaggtatggccaggcccctatctgtctataaaattacccaaaagaatagtatacgaaggaagacataaatcttagcagccatgaaagtacgaagaaaaggagaactcattgattgctccatttaacatgagagaggactcctctgtcattgtacattttgaactaacaataaaaaaaggccaaaagagttcctcttgtcaaaagcgaagcggattcatgatttaaattttatgggttcaatttttaaggtttttggcattgaacccattatattcttaaagttatgggttcatatccactatttttacaattttaatgaatttctacatataaatttttacacctcatcaaaagttatggattcagttgaacccgttagttgttcactacatccacctctgcctcttacaatcacgaaaaagattaaccattttaaaaaaagaaaatgaccattctttattctaattctgaaatttacatatccatttgatcattcttcgttaaagctttaaatcataattgaaagcgtgaaatactagcatgagccaaagtagttctaagcgtccccttacaagttacatcatattagtagaaaattcaagtttgtctagtgatgtaatttacaaatccatgtgaataaaatctaagcgagacccaaacctattgtagcagccaaccaaatatagcctaataatatttggctggtaaatgtttttcaaagatgaagaaatatgcagagatcacgtttaatttttgttcttgtgatgtcactagtgacatcaagaagatgttttttcatccctaaaaatagggacttcttcatttgtaagcatccacttaacagagagaaacgtatttgtaagaaaaaatattgagagtttgagcggtattgttgcaaggatattttaaaagagagttttcttttgagtgtgtcagcctcgagaatattgtgctactcgagtgcttattcactattagaaaatgcctaaaaatcgtttgccgatttctgacggaaatctgtcgaagtgcaaaccgatattcagtaggaaatggacaaaataaaaaaatttataactgaaccgaccgaagtttgtcggtaaatttagtgccaaaaatccgaaatacaatttgcgtccgtaatttcaacattccgatcgaaatcagtgtcaaactttaacttttgtgtagaaaataaaatataaattaaataatttttgataatttccgactgaaattggtcggataattaaacctgaaaaatatttttcaatttaccgaccaatttcagtcggtattgaagtcaaacttttgatcaaacatgaataaatatataaattatttttaaattataaaaataattagaattttcgaccgaaaatctacaccccttatataatatgattcaaaatcatcagccgaaaacctacaccccttatatattccgtatgatgcacttgcatgcgttattcttatacttgagcagtagtccgttcgagaaattgagttgatcttcattggtgaaccaattctacttgaacataggataaaaacattcaattaatttatttaatttaaaactgagttgtgtgacccatgtatgttattaaaactgagttgtgtgaaaagtttattatgtttatttcgttaaggtcattcacctagaatatactgatccgaggtgacgggattttgccggacctctatctgtctataaaatcacccacgaaatatatgaaggaatcagacataaaccttaacctctaagaaaacaagaagaatgaatgaattcattctcatacaaagatatgtttgcaccatttatcacaagagaggactcctctctcattgtacattttgaactaacagcaaaaaaggtcaagatcattcattttataatcaggaaaaggattaaccattttaaaaaagaaagtgaatattctttagtttaattctgaaatgtatatgtcctcttgattattcttctttaaagctttaaatcataattgaatttaacgttaaatacttgcatgagctaaggtagttctacgcatccgcttataagttacatcatattagtgaaaatttcaattttgttgagaacaaaactaacatgccataatgaattttttaaaaagaaactactaaaaaggagcgtaagaatttcttggtccaaaattaaatgtctcttaagacaataaatggagtactaatataagcgagttctctttggttagattcttttacaagaaaaatttttggaaaaaaaaaatcaagcgggttgagtaattgtatttcgaaactaaaataaaagtaaaaatctaaaggtaaacttttctctaaactaacacgaatgccatcggaaaaatattatctaaaaaatcaatcaaaacacgcaaagtaacttctttaattatgtttcaaaaatttctttaagataatattttaaaaagaaattaaacctaatcaactagatctaaagaccatttcataggctctattagttattttctatatcttaaccactcgggacgttttgttagtgacaagttatacactgtaataggtgatggaaaattcaaaatatactgtatatcttccagaacaatcaaaacttgaaagcagtggcggcccccccggctgctgttgccccctaaatcttacggttgagtcataggcaacgaaaaacatttgaaaaaggtaatttgtctgatgtgataattcgagtggactgaagactactgctaagacttttttgtttttgttctttcgaattgatatatatgttggttttgttacttctattttccactctttcaacaaaattacctcaaactttataatattagatagtactagttttagtgtacgatgtgttccacgcgaacattgcgtcaattaataaaaaatagaaaaatatataaataatgaacaaatgtttgaaaaataacaattttagttaaaataaatgcaaataattgtttaaatgataaaaaaatattttattaacatatgtagcagttaaactcaatatatatcttctgaacatgatgatgaattaaattaaattagttgtattagtaatatatgacatataaaatcttttttaaattaccgtaaaagaaatcaatagataactttcaacttagttctagtttatgaagataaggtttcatttttttagaataaaatagataagatattaaaaatgaagttaagatatttttcacaaactatttgattttttcaagtattacaaaagagattgataaaaattagaaacatgctctacttttttaatcctacttttttcaattgtgattcgtagtttttctttaattttttggtatttatagatcttttttctatatggtgatatatatatatatatatatatatatatatatatatatatatatatatatatatatatatatatataaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgtcatccctagtttataaaaattataggtaagctaaatgaacctattcttgtgtaaaaataattaataaatttattttcgcggagtctatattgtcttgctattacttgctatcggtacctcttttataattctctattgctatattcgatttagttttccaattatattgttttgttattacttgctatcagggattcttccatcttcttttaccgagggtctatcggaaacagtctttctgccctttcaggatagggataaggccgcgtacatcctaccgtccccaaacaccacttgtgggattagttgttgttgttgttgttcttttgttgttgttgttgttcttcttcttcttcttctttgctacatttgcccaaaggtcaaataaaattaatgaatatcctaaatttatttcagtccttgatggaactaccaattagctttaaagttttaagaatttccaatgacgaggataacttttcaaaattatagggggaacaattataacttatgtgatgacccgataggtcatttttaattttaaccttcatttatgtatttcgagatctcgaatagctccattcagcttttctcaatttgcatgctcaatccgtatctttttctggaaaacttttatatgaaaaaccatagaaagtgtgaaattttgcctttaaaactcatttgagttgatttcggtcaatgttttgagcaaattgactcggatcagtgttttggcagtttcggtgggtatgtatcgtgatttgagatttgagcgtgtgcccgaaattaaattttgaagtccctagcttggattatcgccatttgacggaaagtaaaaatttaaaggtttaaagcattcttaaatttggccataattagatttttgttaataccgggtcccgagttggattccaagagtttgatcagctgcgtaataatatttatgatttcagtacaaaatttgaagttattccgaggtgcgtaggcatattttccgttagtttttgaaaaaaagggcttgattttataaagcttgaatttataagtttgaccgatagttgactttgatgatatcaggtttggattatggttccggaaattttagtagcttcgttatgtcatttgtgacttgtacgcaaaattttgggttcattccgaattgatttgacatgtttcggcacgagttatagaattaaaaatttcataaactcataagtccgaatcaacgcacgatttgtaatttcttcattgttatgtgtgatttgagacctcgtgtaggtccgtaatatattttgagacttgttggtatgttcggacggggtctcgaggggttcgggtgagttttagagtggtttcagaccatttctaggccatttttgactgctggtttttggctacagcagtatgcatcgcagaaatttctgttgcacatggctgattttgaaagcttatatctcgtaatttgtaaggaatttggagatgatccaaaaataaaagttgtagctctttgagtctagtttccagaaatgtaaaccattgatcatttagacatttgtaaggaacgttatgatcgattaactaaagcatattactgtagttgttttgcctggcagtgtgcatcgcataaatttctgctacacaggggtgactttggaagcttatatcttataatctgtaaggaatttggagatgaaccaaaaataaaagttgtagctctttgagtctagtttccaaaaatataaaccattcatcatttagacatttgtatagaaagttatgatcgactaactgaagcatgttactgcagttgttttgcctgacagtgtgcatcgctgaaatttttgctacacagggctgactttagaaacttatatctcataatctctaaagaattaagagctgatctaaaaatgaaacttgtacttctttgaacctagtttccataaaggtaaactatgtatcatttggacatttgtacaaaaagatatgatcgatttactgaaagctggtactgcaaatgtttgcctggcaataatgagacaagtcgcatttcacacatgcgacttgcctggacaaaatgtataagtccgtagttcgatatttttgatcatttttagagctttagacctcagttttgggtatgtgttccttatcataaatcatttatatttcatgattccatgcttatttacatcatgaatccataaatttaattgaataaaatagttttttttgtaaaatctttcaaaaatgaaaaatgaagatttgaaaggtgatccgatatcggaattcgataatttttgaatggttgaactcgtatcggaataggtgtttggattttgtgaatttttgttggttccgaaaagtgggccccgcgttgactttcagttgacttttagaacaaaattgaaaatcgacatattattatccgaaattattttctataaatttaattaatttataaaaatattttgattagattagagctgtctgaacggcgttttgcgcaagtaggctattttgggatatcggcctaactccgttaaggtaagtgtcttgtctaactttgtgggaggggggaggggggggaggggggaaccaccccttaggatttgagatgattgtgtcattcgtgttatgtgaaggtcatgtacgtggggtgacgagtgggtacatgagctatatgagatatttgaccagtttggaccgttaagctccttttatacaattgattgtaaatattgtttcatgattatatattttgttgttaaaattgtttgtacgcactttacttgaaattgttagcccatgttccatccttgttgtcaagttcacccttatatgctaattattgattgtaatcactcgttgaatttatgttttacctgttatatgccttaattgtcaattgatgctcataaattgtgccttggcttatggattgttattttcttgctatttgactttgtaagctatcgtgtagcatttttcattagttgtgacttctttgtgtaacctcgttatctcttttgattttgtagtataccgtagtcggttgtaaattgattgcttaatttgttttgcttgaggatctggttgaacgccgcaacatatatgatttattactgtgagggatcaggttgcatgccgcaacaaatatgattattattgtgtgggatcaggttgtacgccaaaacagatatgattaatattgtatgggatcaggttgcacgctgcaacaaatgtacaaatataaaattattgtgatattaaggttaatcccaattgtgattctcatgatgcatttcatgctaggacggttactgtggtttcttaaatcacttcattgtattttgatcataattaattaaccgtcaatatattaaaaagggaacaatatggacttcttgtgtgaatcatgcatcctatgtgatatgttaagttgctgagaatatagcagaggcaaataaaaaaattttcaagttgttccccttgtgtatctttcaaacataaaactcatatcttattcggagatttactaaattaaatggtgatgatatttttactctaattaatatctcaaccttctcattattttattgtcgtgtaatttacgtgaaaaattattatttcgttttaccttaataaatttcatatttatcttgttaaaacttgattgaatgccttattttgtataaatacaatattttatcagatctcatatacttctaaactaaactcaattgatattctatttgtacaacccttccacaattttaactatttaaatcctaaattggcttaatgactcagttgatgcttcactgtatttaatttggaaattatatttaattgtgtttaaattattcattgctcatcctggttgacattgatacggaaaacacatggtagcacgagggttttgccgtgcaaaagtaattcggaaagatgtgggcacagtatgtcacatgtgtaagaattggcagccgtgaatcatgaattgagattgcgaggagtgatacctcgagtagtttatgtttaaatacatgcattaccaataatttatttgattgatttgtcatatgatttcgtgctgggacccactcatatattatttgatctctaactatgtggttgcttaattacttgattattttctcgttgctacccgtgttttcactgtttttattgttggtttgaattggaaattcttcttttattggcctgacattgatatccttttcttgttagctttatgtaaaattttgtacaggtttatatgtctggtaggtgtcttgacctggcctcatcactattctaccgagtttagacttgatacttactaggtaccgccgtggtgtactcacgctatgcttttgcacatctttttgtgcagatccaggtacctcagttttgttgataatcttgataattgattggacattgttgtggagacttaagatatacctattgtcccgtttgcaggccttaaagtcaccttctgatattttcctgcactgttgattctattctggaacatttatatttagagaattatttctagtaaactcttagagcttgtgacttgtactaccgggtttggaatattgtaggaaatttctatttcatatttaatacttgttggttgggtcaccactaattcagtaagtgttaggcttacctagtccataaaactaggtgccatcacgacatcctacagagggaaatttaggtcatgacaagttggtatcagagctctaggttcataggtgctacaagtcataaacaggtttagtagagtcttgcggatcggtacagagacgtatgtacctatcttcgagagactacaaaatctattaggaaattcactttttttattccttatcgtgcgatattgattcagcttgaagcatatatcttatattcattcacatccattcatatatgacattgcgcactcggtatcagttatgcaccaatggctcgtgatgtcgtggatagactacgagggagccagagattgtcaaacatcgtctcaacgtgtggtcccgactgaggatgcagaaggatcacttagagatttacgtaaggttgcaacagattgaggcatctggttgatgagtacaagttgtgaaggttagtattgtggatcatcagacattgtgtcctatggcttcatgccaagtgggggagtccactatagacgaacatattgctgggtcatgtgttatattagttctggcctgagatgtacatatgtggtattgaaaggttccacaaaatttgcacatgtttaaggtctgagattttgcaggtgataatattgggacttgcggtatgactgcgtccttaataatcctatattttagtatcaaaggagttagagaaacaacttcaaatttacagaaggtctattcaacgtggacgtctcagttgcggcagtatgggtgcttcagagaaagtatggtggttgatgagtttatgggctacgtggttcgtgccaagatttgtctgtactgagctttatttttgggatcgtcgtgtacaaataggggggagtattaccctaaggaagaatctaggaatatatgaagaaatggtcagctcggcggtgctgggtcagcgtagcaaataaagaaattggcctttggagagataattctccaccggtgtttgtggcaagtctatgaagagggtagaccagccaatgcaacaccacctacttgggcttagtttttagaggtgtttttgagggagtttgttccctagagtctatggaatgcgtggcgcacaaagtttgaatggctgcgttagtacaccatgatggtgttagaatatgccaccaagttcaaagagttacccatcatactcttactttggttcctacagccagatagcgagtccacagattcattaaaggactcagttatgatcttagattctgtatgactcgggggctacaagctgatacttcattatagcaagtggtggaaattgccaagatgttagaatatgtttgaggtgaggaaaaggaaactagggagaccatgaggcctcgaggttctggagaattcaatggatgctactcttcagctataactcattatggcggagactcgagcagttggtcagctcattccacgcatcagattactcaaggtgcaccagtaagttcttttactgcaccaccggcacgagattcctataatggttattctagttatccgacatagattcaatatgagcaacaaaactcgtagaggggttgttatgagtgtgatgatactaggcacatcatgagagattgtcccagactttggagagacatattacaccagagcactcaagccacgggctccattttagttgctactctacctacatattcagttaggggtggaggacaggcgggtagagggcgtcctaaaggtggaggcccgacccgttgatataattgctatgaattggctgaggctattacaccatatggtgtcgttataggtatgatttaattcataatagatgagtactattcttattttgattcgattccgattatcgaggtgagatctcctttcatgctccttatatggtgagtttgtgaatttatactctactcctatgtgtatccttgttgggagatttgatggtgttagcccatgtctatcattttgttttgtatactattaagggctatgagtccaaaagttactttttgttactcattacagtgggttttgatgtaatgttaggataattaattacaaattgtgaattatattccctaccagtatggtttttttttaaacaactataccactcgccagcacttgcctagtggctaatatataaataaaatcccaaaatgggtccaaagcttacaagatgtccaaaccaaaatagaagttgcatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagatagaaaagctaaaatctaatgaactagctattacaacatgataagtgtatgtgaatccaattgtcattggaaaataccaagcatcacctatcaagctctcactaggcgccagggtatactgtccataggctaaaatgaattccaaacatctccaccacaaagttgaagccagcatagtcttccaagtgtagctactatatgatctccatatgcagtggactgattttgtccaagtattaatcatgtgctcactcatcaaaattaatgtgtagaagaggaacctggctttaggcaggctttgcaaggcaaaagccaagcttgagctggctttagataggctttgcaaggcaaaagccaggcttgagctggctttaggcaggctttgcaagggcaaagccaggcttgagctggcgttaggtaggctttgcagggcaaaagccaggcttgagctggctttaggctggctttgcaaggcaaaagccaggcatgagctggccttaggctggctttgcaaggcaaaagccaggaatgagctggctttaagcaggctttgcaaggcaaaggctaggctttgaaattgtgcctttttgtgatcttgtaagcttagatccttccctactagaacttttaatgtagacatcattctaaacattgctaaaccatcctcaaattgagcatgaaagaatgctaataccactgagaaatgattcaacaatctccaaaaataccatatgatgggttcaacattttccttagcatttggacatatcagaagtaggataaattgtaccatcccacacctgcttattgcattttttctgtacactatcaaagcacccccagaatgagcatggaaccatgctaataccattggaaagtaccttaatagcatactgaatgagacaaagaaacatgcaggtttgtgcagagtctaatcctgtgaagccatcagtctggggttcttctctttgctatcctaaccctaaggttaggtgattgatatttgtctggattgatcaacctcctccctgcactaggcagttcagagaaagaatgttactcagatgtacctgcaaaagagaacacaatgttagctataaattccgccattgagttgccttctctgaacacatgttgaaagatcacattgaatttgtccttcatctctataattttcttcacatcctgtgcaattacccaaggaggatcccattccccttctatcgccttcttcatcactaatgaatcagtctcaagtatgagagggtgaagatcatgctccacataatattccaacccttgaagaatagccttagcttcagctaccacattagttgtcactcccaggtctactgccctagcatacaccatatcaccttcatcatccctcacacaaaagcctagggagctaggtccaggattgccctttgaagctccatcagtattacatttgtaccaaccatgaaaaggaagctgccatgttactcttgtagtgatcaatataggtttatatccttcaaagtattgaatcatgtctggccataacaatggaatattagggatccaagcatacctcacccttgccagttgatgcaatgtcctatttatctcatgaatcaccctatttgtggacactgaaccaccatgtttacctgcatttcttctcttccaaagctcccaagtgatgatagctggtactgcttgaaatagtggctttaattttggacaacactgagcataccaccaattccttataatctgcttcaattgaatcaattgcatagaaattccagcagcccccatgaacaagttccataccttagaggcagtaggagttgtgacaaatatatgcttaatggattcctcttggggctactgacaacaccaacacctagacattaccatttgcccttgcctcctccatatgttatcggtggctattttctgcctccacaatctctacaagaagaaggatatcttgaatgccaaacctttaatccacattaacttgaattcctgattaggatcagccctatgccttaatatttgccaagcactgctaacactaaacttgcctgaaggagttgccatccagtatggcctatccctatatctctcactgccttcataatgcacatttagccttatatgttctgcaattttctcattgaaggtttgatctagcaactgatcatcccatgcttccccttgccgcagttctgccacctcctaaagacctttattgattggaaagtcttcaggtaatacgtgataaagtgcacccaatccagtccaattttcatgccaaatattagttgttccactctttaattcccattcgatctcatgttctacttcttccctagcattcagcatttgtctccaaacatgagaccctcccctaaaatgcaccactattggtagctccttcttgcaatacttattccacatgaaattagaccacaaagattttgtggtcctaaacctccaccatagtttagcaaacagtgcccttgagacatcatgtaaggacctaaaacctaggcccccttcctctttaggaaggcaaagattttgccatgaagcccaatgtctgcttctcccttcttcctttttgctccaaaagaacctagcaaaagtcttatgtagacgccccatgatgctcttttggtggatcaaggactgataacatgtgaactggcatactttgcaacacactagagatgagtgttgcctttcctccaaatgacaacaactttcctttccatgaatgcaatttagccttcaccttcttgataagatcctcataatagtccttcctccttctagtgtaaaaaataggacaccctagatatgtgaaggggaatttacatcttgcaaatcctgtaatagctccaactgcctgaaataattcattagcaacctttgaatgcatgtagtatgaactcttatctttgttgatcatctgacttgatatcttctcatagtttcccaacactgccataatcttgctcaaagagggaggatgagcagatgcaaagattatcgtatcatcagcatatgccaagtggtttaaaggatcagaccacttaggcattccaaatcccacaaatgacttgtcttcaaagagcttattcaaagaccgggtgagcctggctttaggcctggcgttgccagcctatcgccaggtgagcttggcttgttgtccttcttcaccttgacttctgttgtctttgttgtgcccagctgatcattcttaatctcaactgcatcactccataagacctttgtagagtttacctcatcaagatcctcaatctgcccagaatctttaaatgtttgagatagaatctcatgacaagatttgtttgtggtcacattgagttgttttagctcctcattgctagtcccaaaccttctatgaacccagtcgattgtgggttccttaatagccctttcatcaatacattgagcactaggaacactggagttaaccttagctaattcttgatcatctttaggagttgaagactgaatcctatatggaatagggttaccattatgctcattttccaccaccttctcgactgcttccttcttcacacgcttatgttcctcttgagtattgactttcttttccttctcctggcccttcttagcttgcttttccccatgttccttcttcttaccattgctatgatcctcacctttgccttcagtaatttgtagagtaagctcatgaacttccttaacctctagtgcattaaacttgttcttggttgcaacttcctcaactttggccttccctttacccttgtcagcttcctttccttgtttgttatcaacaatgtgacccctattatctcattggtatttgttcttccttgcttgcatccattcctatttggcatgattagtagtaggcttaccaaccacctttccactagttaggacctttgttgaatttgtagcagtcccaattgcatcagaactcatcacaactgccttctccttgctttgttcctcaacacatttttcaaatctcttgtgtaattcaggatgaattacctagcattctacctcactatgcccctgtgttttgcaaggtttgcaatattttggcatataatcatacttaatcctgatccacttcaactcttctggtccagattcatcagcttcttccacaatcttaatacgacgagggaacttacttaacaggttaacttccaccttcaccttagcacaactaggtctagtaccattttgagtggctaggtctacatgtaatggattactaacagcacgagctaaggaaaatacacattccttcccaaagaaattaggaggcagttctggaaagcaaattcaagcaatggcaatgggagtctcttcatcaggtgtccaccatggattgcattttgtacaacgcatctgccacatgtctgactgagcttttaaataaaaagctggctttgaaagaagatgaacatagtcctccaataaagacagcctaatcaacacatgattatcttcaattaaaccaactgagcaatggcctttaatctcacattgaattggaatcactttacgtaattaactaataacatgcttcccatacgaaaatttcccaagaattgcaagtagaagtctttgttgtacgatagattgcttcacttcttgtttcttccacttcacaactggttctccgtgaaggaactcaactggtttcaatggtagcatagcgaaggtttgcataagggcattaatggcagtaggttttaaaagttttgagtaatccatggattggggattgttgtttgttgtcgtagataattgggcgatgggctgcactgaagctcgggcaacagtcatcacaggaggattggttgaattgggtgtcaaaatgtttgagtaatctagagtttgtggattgatagttggtgttgtttgtggttggataatgttggaggagggcagaccagccggaaaagatggcgggtcgccaggcatcgcggccattgaagctcaaactcacaacttttcgcgatgaacagtgaagcgatgctactgttcactacactgtagcagtgaaacagtagcgaaatcactgttcacgccactatttggcactattcaccatactgctttgcactgtagcggctgttcgcgcactattcaccgctacagtgacggcgaaattttgagagcaaaattctagagagaattttttagggcttcagttttacaaagagatcttgaatgactctgtgggttgcgatacgtgccagtatgggggttcattatgtgttgtgaccttgtttaagggaaattattttaaagaagaaaatggaaagatttcgattggcacgatgtgcatattacttgttattcagagctgaggatgggatcctctcattttaatatgatttgatatgtttaaatcaggctacaagccatggtgggagttatataaggacgagacccttgtgatgaaactttatgtgtttaaattctcccttatgaaattaaatttgtgctatagtactaatagggagtcatgcatgttagaattatttgataatactcgtatgtattttcctgtgcatatttaactatattcgtgttgtaattattgagttttaacctacgaggtgggtgctcaggtggcgttaaatgtgactcgttaattcgggtaaataattatgaggtcttcatgcctgtgtctcgttgttagtaaggtgaaggtttggaacgagatttttgttaacatgaggctaattggcgatgctgtaactaattaagaatacctattaagaccagagatgtggttataggcatacatatgatgtgtgcataggcacgagttgctaccgccagttgaggctaataccatgcgttgacatgaaaatcagactttttgaaaatatttggagtgtgagaaatttggttttaaagttataaatgtagataaaagaaataatctcaattgagatggtattgtcagacgtatgtcgattgcggtgacatagaatcacccacgagtatatgtgtaagagaaaaatcaacagtttgataaccttagaataattctagccatgttcgaggataaacgtttgttttagaggtagagaatgtgatgatccgataggttatttttaattttaaccttcatttatgtattccgagacctcaaatagctccatttagccttcctagatttgcgtgctcagtcggtatcttttgcggaaaaacttttatgtgaaaaaccgaaaacaatgtgaaagtttgcctttaaaactcatttgagttgacttcggtcaatgttttgagcaaacagatatagattagtgttttggcggttccaatgggtccgtatcgtgattttggatttgggagtatgcccggaatcaaattttgaagtctctagcttggattatcgccatttgacgaaaactagaaatttaaaggtttaaagaattcctaaatttggccataattgaatttttgttgatatcgagtctcgatttggattccaagagttcgatcagcttcgtaacaatatttatgacttgtttacaaactttgaagttattccgaggtgcgtaggcacgttttccgatagtttttgaaaaaaataaaaggcttgattttataaagcttgaatttatatgtttgaccgatagttgactttaatgataccgggtttgaattatggtttcggaaatttcagtagcttcgttatgtcatttaggacttgtatgaaaaatttgagtttattccaaattgatttgatatgtttcggagcgagttatagaattggaaatttcataaactcataagtctgattcgacgcgcgatttgtagtttagccattgttatgtgtgatttgataccttgagtaggtccataatatgtttttagacttgtttgtatgttcgtacggggtcccaaggggctcgggtgagtttcggagtggtttcagaccatttctagtccattttaactgctgtttgtttttgctacagtagtgtgcatcacagatatttctgctgctcagggctgactttggaagcttatatctcgtaatctgtaaggaatatggagatgattcaaaaataaaagttgtagatctttgagtctagtgttcctaaatataaaccattcatcatttagaaatttttaaagaaagttatgattgattaaccgaagcatgttattgttgttgttttgtgtggcagtgtgcatcacagaaatatctgctgcacatggctgactttggaagcttatatctcgtaatctgtaaggaatttggagatgaactaaaaataaaagttgtagtcctttgagtctaggttccagaaaggtgaattattcatcatttgaacattcctactaaaatttatgattgattaactgaagcctattactgtagttgttttgcctgacagtgtgcatcgcagaaatttctgatgcacagggctgactttgaaagcttatgtatcgtaatatgcaagaaatttggagatgattaaaacatgaaagttttagccctttgaatctagtttccaaaaggtaaaccattcataatttgaacatttgtacagaaaggtatgaccgatttactgaaggctagtagtgcaaaattttgcctggaaataatgagacaagtcgcatttcacacatgcgacttgcctggacagaatgtataagtacggagtccgatatttttgttcatttttagagtattagacctcgattttgggcgatttcagacctcgatttttgttcacaagtttgaactgggtaagtgttctttatcctaaatgatttatatttcatgattccgtacttatttacatcatgattctgtaaatttaattgaagaaaattggttttttctaaaatatttcagaaatgaaaaatgaagatttgaaaggagatccgatgtcggaattcaataatttttgtatggttgaactcgtatcagaacgtgtgttcggattccgtgaatttttgtcgggttccaaaaagtgggcctcatgttgactttaggttgacttctagaataaaattggaaatcgacgtattattatccgaaattgtttcctatgaattgtaattaatttataaaaatattttgattagattggagccgtccgaatctcgtttggcgcaagaaggctattttgggatatcggcctaactccgttaaggtaagtgtcttatctaactttgtctaggggaaacctccccttagaatttgagataattgtgtcattagtgttatgtgaaggtcgtttacgcgaggtgacgagtgggtacacgacctatatgtggtatttgaccggtttggagcattatgcttcttttatacaattgtaacgacctaacttgtcgttttaagaattaacgccctgttcagtaacttaaggtctcgagcagtttcgtaatatgtattatgacccgcgggtgtggttgagtttgattttcgaaagattccgaattatattaaaagaacaatgcttagtagaagcttaaatggaaagagttgacatgagagttgacttttgagaaaatgactccagaatggaattttgatgatgtcaatagcttcgtatggtgatttcggacgcatgcgtgtgtccggatttaggacaaatcaacacattttggcgaaagttggaaatagaaggtttttggaaagttcgaccaaaggttaaaattttgataacgaggtcggaattcaattctggaaattggaatagctttgttatatcatttatgatttgtgtgcaaaatttgaagtcattccggattgatttgatacgtttcggcgcaaaatatagaagttagaagatttgaaaactcataatatgattcgatgcgcgattcataatttcggcgttgtttggcatggtttgtagcctcgaatgagttcgtattgtattttgggacatgttggtatatttggttaaagtcccgagggcctcgggtggattttggaaggttaacagagcaatttggacttgaaggaagctgctggaaaatgacagcagctgttggaatcgcacctgcggaattatgggcgcaggtgcgaccatcgcaggagtgagtgaaggggagctgggcaaggatgatggagaaggccgcagaagcgacaacatttgagcagaagcacaagcgcaggtgcggccactatgctcgcagaagcggatgcagcacacgtgcgcattttggctcacaaaagcgaggccacagatgtggaaatatgtccgcagaagcggaaactgggcagaatattaaagacaaaaaatggtcatttcgccattttcgttttggatttttggagctcggacttgagtgattctggaggggttttttcacgacccaaactctctccgtataacgtcgtgacagcacctagtttctacgactaggtaagcctaaagaattgcggaaaataataaaacgaaaacaaaatttatcaactaactacaatagatactgaataaccaataacaatgccgctcggcatgtacaataaccaaaacactggacgtacacaactttttccaaaacctgtaatatcataagtcacaagctacaggaggaaactagtatctctatacaccggagtctaacaaaagaagtacaaaaggtaaatggcatagccgaggtctgcggacgcaacagatataccttgaagtctctgtacaacagcaagcactctcagctagtagcggggctgataaaaatcacctggatttgcacacaaaaatatgtacagaagagtagcatgagtataccacaacggtacccagtaagtgccaagcctaacctcggtagagtagggacgaggtcaggtcaggcctactggtatataataaaaaagcaggaaaatataacagtataataagagactggaatttaacaaaacaaaaacacagcggtataacaatgcaacacacggggataaacagcaggggatctcccgagataccgtcttgtggtcccaaaataaataagcagggagaactcccgaggtaccgcctcgtagtctcaaaagtaaatgtgcaaggagaactaccgtggtaccgcctcgtagtctcaaaagtaaatatacagggagaactcctgaggaaccacctcgtagtctcaaaagtaaatgtgcagggagaactcccgaggtaccgcctcgtagtctcaaaagtaaatatgcagggagaactcccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaaagtaaatatgcaaggagaactcccgaggaaccgcctcgtagtctcaaaagtaaatatgtagggagaactcccaaagaaccgcctcgtagtctcaaaagtaaacacacagctcaatcgataaatagcatagttaacaccaagaattctacagttaagactgataaagagcaaggaaaagcaggaaatcaactaggcatgcttcacagagttcaaataagcagttgaaacacgtagacatacgatattagactaaacaggataactacacatgttggaatagctcaaataagaatgaaaatagactaatactcatttaaacaatataactcatattaaaggaaaaacaggttgctactcagtaaaataaatcggattctacaacaaatagcctgtgtacgtactcgtcacctcacgtacacggcgctcacatatcacaacagtaccaaatcctaaggggatttccccccacataaggttaggcaaaccacttacctcaaaccaagctcaatcaatcggtaacaatgccttttccacgaatatccgactccgaatggcccaaatctagccaaaagaaattacatatcataaatacaactataataaaataatctaattaatgaaaccaaaactttaacaacaatttcaaaaatcgtcccagaaagtcgacccaggcccacgtctcgaaatcgggaaaaaatcacaaaatccaaaaatccattcactcacgagtccaaccataccaaatttatcaaaatccgacctcaaatggccactcaaaacccaaatccaactcttcaaatccccatcctcaaactcccaaattccaccttaaatacacactaactaggttgaaaaataaatgggaaagcaagattattgataaaaaataagcacaagggacttacctcaagaaatatctcgaaaatgctcccaaaaattgccctataccgagtttgcaaagtccaaaatgacaaaaatcacgaagcccttcggttttaaacactgcccaggcatttccgcacctgtggatcctgggctcgcacctgcgcgtgcgcttgtgcgaaaaatgagagtttctgcgcaaaccacttattcccctctgcctctgcacctgcgatgaaggggccgcacctgcgcgtgtgcgcctgcggggtcctgtctgcttctgcggtcttagttcgcacctacggtcatccttgcgcatctgcgggcatcacagatatgtccttttccaagaacctgcgacccctgaccaatccacccaactccgcttctgcgccatattgctcgcacctgcgggctcgcacccgcggtcagccttacgtaggtgcgattacacaagaacctgcccagcaccagaaaatctcctaagtccaaaatgacccgttaaccatccgaaactcacccgaggccccccgggacctcaaccaattatatcaaccagtcctaaaatatcacacggacttagttgggcctttaaatctcatcgaacaacgctaaaaatatgaattacgcatcgattcaagcctaatgaacttccaagtttcaaacttctacatacgacgccgaaacctatcaaatcaagttcgattgaccttaaattttgcacacaagtcatatccaacattacggacctattccaacttccggaatcagattctgaccccgatatcaaaaagtccactacaggtcaaaatctccaaaaatccgactttcgccatttcaagcctaaatcagctatagacctcaaatttacagtccggacacgctcctaagtccaaaatcacccaactgagctaacagaaatgacggaactccatttcggagtcatcttcacacagttccgactactgtcaaaatcctaagacttaagcttccgtttagggactaagtgtcccaaaacactccgaaaccaaaaacaaaacctcccgacaagtcacataagcagaaaaagatacgggggaagcaattaaaagggaatcgaggctattactctcaaaacgaccggccgggtcattatagatctttcacaagcttggttggggtaagtgttctatatcctaatttgattatatttcatgaatctatggttatatttatcgtttaatttgtatttagatggaggaaatcaatatttttgtaaaatattcaaaaaatgaaaatttaagatttggaagtcgagttgttactggaattggataaaattggtatggttgaactcggatcggaatggatgttcggatttcatgaaaattatatcgggttccaagaggcgggctccacactaacttttgttgactttttagaataattttttaagtcgatgttttattgtcaggaattgtttccgatgaattttaatgaagtgatacaattaatttggatagagttgagcggtccgaaggtcaattcaagtaagaaggagattttgaaatatcggcataacttcaaaaaggtaagtatcttgcctaaccttgagtgggggaattaccccttaggcatcgagtcttatgtttcatttgtgaaatgtgaaaagtcgtgtacgcgaggtgacgagtatgtactcgggcttatatgtgcaaaatttattgagttaaagtcttaggcatattgtgtagtaaattgaataattgttggcatttatttaatcatctatttgccatgcctaaattcgcatttgttgaatttatttttatatgacaatttgatgtgattattacttgtttatttatgtgaattccgtgagtttgatggttggatatttcttggaatttaatttcattatggattttccctctgcaaataattaattaaacaagcttaagaagaatgtgttgtcctatgctgagttacttttccatctatgttattgtttgaggttttatatacattgtgtggagccttgggctatttgttgtgaaattaattaattttgttatatccttggaattggttgtggccattgggcaaattgtgatatgaatttttttttgttatgttgacgtgataatattccgtataaattgttgtgttatttgagttattattttgaggatataagagtggcatttcactgttgatattatgtgggtataagggtggcatttcactgttgttatatgtgttgggttattatctgggcagagcgataagggtggctataggagcgataagggtagctattgttattgtcaggactgagggataaatgaggctattatatgagtgatgagggtggctacaggagagataagggtgtctattctcagggatgatatgtgatgatgtggagttgttgagttgatgaattttatgtgatgttgtgattttccttgtgttcatttttataccttgtgcaatttgtcttgttgttggtaaactgataatagtttgatttacgttgaaattgagagcatgtggctattgccaggcggattatgaaaagaaacgtgggcacgaggtgccgtgagtaaataatgatgatattggcacgtgaattgttattgcatttgtgatatgaattgtgggcacgaggtgccgtagttaaatgatgatgatatttggcacatgagttttccctgcggttgtgatagagaaatgggcatgaggtgccgtggaaatataaaagtgggctgagacccgtattttttgatcttgaaatgatgtgtcacagggtgacttttattcaaaacatatttatttgaaagaattatatttgaagatatttatttgaaggatttatatttgaaagatatttatttaaaagaattatatttgaaagatatttatatgaaaagagtatatttgcaagatctttatttgaaagaattttatattcaaaggatatttattcgaaagaaatatattcggaagttatgtattcgaaagaattacatgtgaaagatttatacttgaaggacttgtttaattggttgtacttgtgtttcttattcgtttgagtaataattatgatgttcttgctactttgctgtttacatcactaattgattgttgttgctatcactgccatctatttttcattatttttgtatactatattgcacaggttataagactagtgagtgtcttgactgtacctcgtcgctactctatcgaggttagtcttgatacttactgggtaccgactgtggtgtactcatactactcttctgcacatttttatgcagagccaggtattgaagatatcagactcgtaacaagttagagtgggatcgcaaagacttaaggtagagctgcttggtcgtcgcagttccttggagccttttcatttttattgtactgccatttctttttcgaacaatattttaaatctgatccttgagatcattgcatatattcagttagagtttatgactcagtattaccggtcttgggagtttgttatatttgtaattatttctgttattggtttaaaaaaaataaaaacaaatggcaattataaccgacttacctagtcttagagagtaagtaccatcactacgcctgtggtgggattttgggtcctgacaaattggtatcagagccctaggttcataggttctacgagtcacgaacgagtctagtagattcttgcggatcgttacggagacatctgtacttatcttcgagaggctaccaaactgttaggaaatttctacttctttcattcttatcgtgcggatttgttgattgtggaatttgagcctttttatctctattctctcacagatggtgaggacatgcactaccggtcagctgagcatacactcgcgtatactgctagggccgcaagaggccggggccgaggtagaggccgaggaagggcacgtgccatgactagagcacctgtctgaatagcagttgaggagccaccagtagctccagttgggggacaggtaccagaagcacctgttgttacccccaaacttcaggagactttagcacagttcctgagtatgtttggtacattaactcaggcgggattgatctctgttgcaccaaatatttcgtacattcggggagaagctcagactcctaccatgactataaaggagcaggttcacattggtcaggtttcggatgtagtaccggtataaccttttatacttgttcagcttgaggtcaggccagaggcaacagaagaagtacaaaagagacttgagaggtttaaagggtatagtccacctactttcagtggcacagcttcagaggatgcccaaggatttctagaaaagtgccaccgtattctccacaccatgagtattgtggaagtgagcggagtagcctttactacatttcagatatcaggcgcaacgtatcagtggtggcaaatttaggaagaagttagaccagccgatgcaacaccaccaacttgggctcaattttcgaaaatatttttaaaagagtttgttcccagactatccaagatgcgtggcgcacagagtttgaacggttgcgtcagggcactatgacagtgtcaaaatatgctatcaggttcggtgagttggcctatcatgcacctatcttggaacctaaacttagagagcgggttcacagattcattgatgggctggattatgatcttaaaatatgcgtggctcgagtgttgcaaactgatactccatttcaacaagtagtggaaattgcgaggaggattgaggatgttctagatgaggaaagggagtctaaggaggccaaaaggtttcgaagctatagagggttcggtggattttactcttcagctcgagtagtcggccagctcagtccacacatcagattactcagggtgctccagtaagttcttatagtacaccaccgacacagaattcttacaatggttattccagttatccgacacagactcagtacgagcaaccacgacctcaaaggggttgttatgagcgtggcgatactaggcacattatgagatattatcccatattggggtggggtggattttatcagaatgctcaggatatgggccccaatacagttactaccccacgtgcacatccagttaggggtggaagacaggcgggtatagggcgccctagagggggaggcccagcctattgatatatttgctatggtgtggcgaaggccactacaccagttggtgtcgttataggtatcctcctgatttgctataaagggatatttccccttaatttgattcggttctgaatattgaggtgcgtcctcctattatgcttcgcttataggtgagcttcgtaattttgtgacccacttatatatttatacctgttgggtggtttgataatgttagcccgtgtctatcatttttatttttgtacaccattgagggctataagtccaaatgtgactttttattactcactataatggatttcgatgtgatttcagaatagttgaattcaattttatgaattatatggcctaccggtatgatgattcattatgtgttgtgaaaactgtttatgaaatatattgaagagaagaaagaaaggaaattgaaaatttcagttggcacaatgtgcaaaatacttgtgattcgaagttgaggatgagatcctcacatttttatatgatgtggaatatttaaaccgggatacaagccgcggtggaagttatataaggacaaggtccttgtggtgaaatatttatgagtttaaaattctccctttgtgaaattaaatttgtactatagtaataatagggagtcatgcatgttagacttaattgataattcttgtatatttttctgtgcatatttagccatattcgtgctgtaaatattgggttttagcctataaggtgggtgcctaggtggcgttaaatgttactcgttaatttgggtaaataattatgagatattcatccctcgcgtgttgctgtgagtgttacgaaaagttaaaattagattttggtgaatatgagatcaattgaggatgctggaaattagttataaatagctattacaaccagagatgtggttctggacatacatataatgtgtgcgtaggtacgaattgctacagccagttgagactaataccatatgttgatgtcaggaattcaaaatttatttggagtgtaaggaattggcttaaaggcttataagtgtgaataaaagaaataatctccactaagatgattttgtcggacccctgttaaatttacggtgacataggaccatctatgagtatgtgtgaaataatgcactcagtaaattaatgtcatcagaaagattcttggcacgttcgaggacgaacgtatgtttaagagggggagaacgtaacgacccgacttgtcgttttatgaattaatgccctgttcagtgacttaatgtctcgagcagcttcgtaatatgtattatgacctgcgggtgtggtcgattttcatttccggaagattcagaattaaattaaaagaacaattctgagttgaagcttaaatggaaagagttgacttttagcaaacaacctcggaatgaaattttgatgatgtcaatagcttcgtatggtgatttcggacgcaggcgtatgtccggatttggatttggaagtccgtaggacaattcgacacattttggagaaagttagaaatataaggtttttggaaagtttggccgaatgttgaaattttgataacgaggccggaatttgattctagaaattggaatagcttcattatattatatgcatgatttgtgtgcaaaatttgaagtcattccgcattgatttgatacgttttggcgcaaaatatagaagttggaagatttgaaaactcataattcgattcgatgcgcgattcgtaatttcggcgttgcttgacgtggtttgaagccccgactgagttcgtattgtattttgggacatattggtatatttggttaaagtcccaagggcctcgggtggatttcggaaggttaacggagcaatttggacttgaaggaagatgctggaaaatggcagcaactgttggaatcgcacctgcgtaattatgggtgcaggagcgaccatcacagaagtgaatgaaggggagctgggcaaagctgatggagaaggctgcagaagcggcaacatttgcgcagaagcgcaagcgcaggtgcagccactgtgctcgcagaagcggaggcagcacaggctgtagcaaaagcgattggctcgcaaaagcgaggctgcagatgcggaaatatgtccgcagaagtggaaactgggctgaatgttaaggaccaaaaattgtcatttcaccattttcgttttggatttttggagctcggacttgagcgattctggagggatttctcacaagcttggttggggtaagtgttctatatcctaaagtgattatattttatgaatctatggttatattcatcatttaattcgcatttaaatagaggaaatcaagatttttgcaaaatctttcaaatacgaaaatttaagatttggaagtcgagttgttatcggaattggataaaattggtatggttgaactcgtatcggaatgagtgttctgatttcatgaaaattatatcaggctccgagaggcgagcttcacgttgacctttgtgactttttagaataaatatttaagtcgacgttttattattcgcaattgattccgatggatttaattaagtgatacaattaatttggatagagttgagcggtccggaagtcaattcaagcaagaaggcaattttagaatatcggcataacttcaaaaaggtaagtgtcttgcctaaccttgagtgggggaattacccattaggcatcgagtcttatgttctatttgtgaaatgtgaaaatccgtgtatgcgaggtgacgagtacgtacttgggcttatatgtacaaaatttattgagttaaagtcttaggcatattatgtagtaaattggataattgttggcatttatttaatcatctatttgccatgcctaaattcgcatttgttgaatttatttttatgtgacaattgatgtgattattacttggatatttatgtgaattccgtgagtttgatggttggatatttcttggaatttaattttgttatggattttccctctgcaaataattaattaaacaagcataagaagaaggtgttgtcctatgctgagttatttttccatctctgttgttgtttgaggttttatatacattatgtggagccttgggctatttgttgtgaaattaattaattttgttatatccttgaaattggttgtggccattgagcaaattgtgatatgaattgttttttgttatgttgacatgataatattccgtgtaaattgttgagttatttgagttattattttgaggatataagggtggcatttcactgttgatattatgtgggtataagggtggcatttcactgttgttatgtgtgttgggatattgtctgggcggagaggttactataggagagacaagggtggttgtaggagcgataagggtggctattgatattgtcagggcgaagggataagggaggctattataggagtgataagagtggatataggagagatgagggtggctattgttagggatgatatgtgatgatgtggagttgttgcattgatgagttttatgtgatgttgtgattttccttgtgttcatttttataccttgtgcattttgtcttgttgttggtaaattggtaacggtctgatttacgttgaaattggaagtctgtggctattgttaggcagattatgaaaagaaatgtggcatgaggtgccgtgagtaaataatgatgatattgtcacgtgaattgttcgtacagttgtgatatgaattgtgggcatgaggtgccgtggttaaaaggtgatgatatttggcacgtgagttgtccgtgcggttgtgatagagaaatgggcatgaggtgccgtaaaaataggaaagtgggctaagactcgtattttatgatcttgaaatgctgtgtcacaaggtgactattatttgaaagatatttatttgaaagaattatatttgaagatatttatttgaaggaattatatttgaaagagatttatttaaaagaattatatttgaaagatatttatttgaaaagagtatatttgcaagatctttattttaaagagttttatattcaaaggatatttattggaaagaaatatattcagaagttatttattcgaaagaattacatgtgaaagatttatacttgaaggacttgtttaattggctgtacttgtgtttcttatttgtttgagtaataattctgatgttcttgctgttttgctgtttacatcactaattgattgttgttgctatcactgccatctatcttccattatgtttgtatactatattgcacaggttattagactagagagtatctttactgtacctcgtcactattccaccgaggttagtcttgatacttactgggtaccgactgtagtgtactcatactacacttcggcacatttttgtgcagagccaggtattgaagatattggactcggaccaagttagagttggatcacaaggacttacgctagagctgcttggtcgccgcagttccttggagtctttccatttttattgtactatcatctctttttcaaacagtgttttatatccaatccctgagatcattgcatgtattcagttagagttcgtgactcagtattactagtcttgggaggttgttatagtaataattattttcgttgttggtttgaaaaaaagaaaaacaatggcttgaattgttattataatcggcttacctagtcttagagactaagttccatcacgatgcatgtggtggcattttgggtcgtgacaacaattgattgtaaatatcgtttcatgattatatcttttgttgttaaaattgtttgtacgtgctttacttgaaattgttagcacatgttccatccttgttgtcaagttcacccttatatgctaattgttgattgtaatcacttcttcaattcatgcttcacctgctacataccttaattgtcaattgatgctcatagattgtgcctttgcttatggattattatttctttgctatttgatttcgtgagctatcgtgtagcctttttcattagttgtgacgtctttgtgtagcctcgttattccttttgatttattggtataccgtagttagttgtaaattggttgcctaatttgtgttgcttgaagatcgggttgcacgccgcaacaaatatgatttattattgtgagggattgggttgcacgtcccaacagatatgattattattgtgtgggatcaggttgtacgccgcaacaaatatgattaatattgtatgggatcgggttatacgccacaacaaatgtacaaatatcaaattattgtgatattaaggttaattccgattgtgattctcatgatgcatttcatgctaggacggttactgtggtttcttaaatcacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattaatcgtcaatttattaaaaatggaacaatatgcacttcttgtgtaagtcatgtatcctatgtgatatgttaagttgctgagaatatagcagaggtaaatgaaaggattttcaagttgttccccttgtgtgtctttcaaaaataaaacccatatcttattcggagatttactaaattgaatggtgactatatttttactctaattaatttttcaaccttctcattaacttattgccgtgtaatttgcgtgaaaaattattatttcgttttaccttaataaatccctgtaacgacccaacttgtcattttaagaattaatgccccgttaagcgacttaaggtcttgagaaggttcgtaatatgtattatgacccgcgtgtgtggtcgagtttagttttcgaatttaattaaaagaacaatcctcattttgaagcttaaaatgaaaagagttgaccagagtttgactttgagaaaatgactcaggaatagaattttgatgatgtcaatagcttcgtatgatgatttcggacataggcatgtgtccggatttggatttggaagtccataggacaatttgacgcattttggcgaaagttaaaaaatggaagctttttagaaagtttgaccggaagttgactttattaatatcggggtcgaatttgattctcgaaattggaacatatccattatgtcatttatgacttatgtgaaaaatttgaagtcattccagattgatttgatacacttcggtacaaagtactgaattatgaaatttcatagctcataattcgattcgaggcgcgattcattgtttcggccgttgtttgatcttatttgaagcctcgactatatttgtatcatgttttgggacttgttggtatgattagagcttgggtgtatttttggatcattggttgaaagacaagtaaagttaagaaatttaggagtttgaccatggtcaatattgggtcaagacgacctcttttcagtgttttgagagggcgagcaggtccgtagcatgttttatgactgaaattcatatatggtttgtgtccgggaggttctggatgagtttcagagtggtttcgcatcatttcggagaagtttgagtttgttggtttttggtgaggtactgttcattcgcaattgcgaaaacaccattcattataaatcgcgaacaatttatcgaaattgcgaaaatactgttcattcgcaattgcgaactatttatcgcaattgcgaacactattcatgggagggttactgttcatttgcaaatgcgaacctgggcaaaaatttaaggattaaaaatctgtcatgtaatgaccctgccggtcgttttgagtattaccacctagtttcccccatttactgctcaatttgtgctttacagttgttgtgtgacttgcttgggtaattggttcgggtccgatgagtttttggaatgaattggaacacttagtttcaaggtttaaaacttaatttaaaatagtgaccggatgtcgacttatgtataaacgaccccggaatggagttttgatgattccaatagctccgtatggtgattttagacttaggagcgtgtccgaaaaattatttggaagtccgtagtaaaattggtttgaaatggcgaaagttgaatttttggaaagtttgacaagagagttgactttttgatatcggagtcggaatccagttctgaaaatttttatagatctgttatgtcatttatgacttgtgtacaatatttgaggtcaatcagaatcgatttgataggtttcagtatcaaatgtagaagttcgaaattcttaagttccttaagcttgaattggggaatgattcttggttttagtgttgttttatgggatttgaggtttcaactaagttcgtatgatgttttagtacttgatggtgtatttggttgaggtccagagggcctcgggtgagtttcagatggttaacagatcaaaattttgacttaaacaactactagattttttttgcagaaaagaacaaggctggaaaaataaaggtcaggaaatcgaggtcatgaaaatcgaggtcataaaaatcgaggtcatgaaaatgaaggtaatgaaaattgaggtcataaaaatcgagggtaggaaatcgaggtcatgaaaattgaggttaggaaatcgagggcagcgcccggacaaaaactttaagttataaaacagggggtttcgtcccatttttccatttttgagaaatcggagcttggggagtggcgatttttgagagattctcaaggaaaaaatcaaggtaagtgattctaactcggtcaatatacacgaatatatcattgttttcatcatttaattagtattttgagatggaaatttggggaaaatgaggaagtgttcttgggctagaattttgaggttttgaattggattttattatcgaatttgactaaatttggtatggttagactcgtgagtgaatgggctttcgggttttgtgacttttgtcggatttcgagacgtgggcgagaggtcgagtttgaggcgattttggatttttggctataatttcatattttcttgtggaattgattcctttagcctatattcattgtattgtactgcttgtggccagattcgggacgtttggagaccgatttgagaggcaaagacattttggagtagagttctactcggattgaggtaagtaacacttctaaacttggttatgagggtatgaatccccgaatttggtgttatataaattgcttgtaggtgacgaccacgatagttaacgagtgtgtggacgtgcaccatagaatttgtgacttgaataatttctgtggagttgaaaaattaaagaatcatgttattatcaatgtatcctccacgtgttagagacatttagctgagatccctattaaagatcatgtttaggctacgtaccggtatttttgggacctatggggtcgagttgctattgaattgattgttttaaattgtaattccatactcagtcatgttcatttatttcatatcatatctcagtctatgttgttatttattgatacatcatataatcattttgggcttattttcatgacatttcgagctcaagagactggagagattgaggactgagtgaggctgagggcctaattatgaggatatttatgggatcgagttgcgtgccatagcaaaccatattggctttatatatattattattatatggatcagggctgccctccagcagcaggccttatagtctttattattattacgggatcggactgcacaccacagtagaccatatcggctttatataacgcttgggctgaaggggcccctccagagtctgcacgcagccccagtgagcgcggttgatttatatcgattgggatgaaggagtccctccggagtctgcacacacgcccaatgagcgcggttgatttatattgaggaatgtatcttccgtggacatgtatcttgtctgaagcatttatattgagggatggatcttccctgggcatgcatcttgcttgaagcatttatattgagggatggatattccctgggcatagatcttgcccgaagcatttatattgagggatggattttccctagacatggatcttgtccgaatcattgatatttggggatagatcttcccctgtgatggattggccatatactgagtgattgagtattttagattgtgagtacacagagttttcactaaggtgcatcatatacagtatgtacattggcatatagatacaaagatgtcacattcctcgtattgttcagaattgatctattttatttgtactgaaagcaactgttgaactagaaagcatgcctacatttctgtattgttattatttatactggactgtacctgcggagctcatcactactttcaacccaaaggttagtcttgttacttattgagttggttgtactcatactacactctgcacctcgtgtgcagatctaggtgctttcggacatggcgaccattagatcttagagtgttatcagttggagactatcaaggtagctgtctggagttagctgaccttgactccatttctttcaattattgtacttgtcacgacccaaaatctcacctgtcgtgatggcgcctatctcgatactaggtaagccgataacatcaataacccacgatttccttaaagtttgaaaaacataataatttgagtttaataaaagacctcacaacttcagatgcaaacactcccaaaacctggtgtcactgagtacatgagtatctaatataaataaaattctggaaaatacagtctataatagtatgagaccaaatacagtaaacaaggagatcgggaaagagagacaaggtctgcgaaacacagcagctacctctgaatctccggggaaaaaaaattcaactgtgcaaaagaatcaacatttgctatgtcagggagcacctggatctgcacacgaagtgcatgatgtagtatgagtacaaccaactaagctagtaataataataaataaggaactaaagatagtgacaagctacacagtaatagttcattttcagtaattccagcaaagaatagacatgctttcaaatccgacagtttaagtcaaatcagtttttaaacagttcaagttcaggtaatccggatataaaatctttcagaaatttcacaacaatgacagatagcaactaagtgcaacaacagataaaaagcaagtacaacctccaagggcaacagtcactcaacttaacacaacatctgaatcactcggcttccagccctcagaactcacactcaataggtacctgcgctcactaggggtgtacagactccggaggggctcctacagcccaagcgctataatccgcacggacaactcacgtgctacatggacaactcacatgctatagtatccatacctcaccgacaggccctcggcttcacttagtcatcaacctctctagtctctcgggctctcggaaatcacaaagatcaacccaaacaaagataacatagtgtatcaacaaaaatcaagaaagattgaggtatgatacgcaagtaaaaatcatgactgagtagaagacaccaattagcaaataattcaacaagtacgcgacctctgcgggtcccaacaatactatcacatagtctaagcatgatttgtggtaaaatttctataacacagggagagcatatagctagcaacaagttatacaactttacagttccacggaatggaccaagtcccaattcgtacggtgcacgcccacacgtccatcacctagcatgtgtgtcacctccaaaatacgcacataatctaataattcggggtttcataccctcaggaccagattttaaaactgttacttacctcaaactgtgtaattctttattctgctaagtctttgcctcgtgaattggcctccaaacgactcaaatctagccagcattaatccgatttagtcaataaaatttattggaattaattctataagaaatactaattttccagcaaaattcgaaatttagctcaaaaaatcgtccgtggggccatatctctgaacccaacaaaagttacaaaatttgaaagtccattcaaccacgagtataaccataccaattttaccaaaatccaaactcaactcgaccctaaaatcttcaaattaaaccgagaaggttttccaaaattttcaacttaatttacccattaaacgataaaaacaaccatggattcaggtaatttgatcaataatgagttaagaatacttgccccatttttttccttgaaaagctcccaaaaattgcctttttccgagctctactccgtcaaaaatggaaactgggacgaagtcccattttcagagcttaaactttctgtccagacctctcttcttcacgaacgcgacaggtccctcgcgttcgcgaagcacaaaatcgtgctgcccaacatttctcttcgggaacgcgagacactgctcgcgaacgcgatgctttaccaagcttttcttcacgaacgcgaaggcaaaaacccatgcccactattttccccttcgcgaacgtgatacccaatcacgaacgcgatgaacaacccagctcctcttcgcgaacgtgatgggaaaatcttgcctgcctcaaattctccttcgtgaacgcgagggcccacttgcgaacgcgaagaaggaaaccagaaaaacacaccagcagttttcagccaacatgccaagtccaaaaatgatccgttaacctcccgaaacttactcgaggcccccatgacctcaaccaaatataccttcaagtcccataacatcatacgaacttagtcgaaccctcaaattaactcaaacaatgctaaaaccatgaatcattccccaattcaagcctaatgaactttgaaatttcaagttttcacaaacgacgccggaacctatcaaatcaagtccgattgacctcaaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacagacctaaaattttcagaatcgaatttcgaccccgatatcaaaaagtcaacccccggtcaagcttcccgaaaatttgactttcgccatttcaagcctaattccactatggacctctaaataattttccggacacgttcctaagtccaaatttaccatacggagctattagaatcatcataattcaattatgaggtcatttacacatgaatcaatatccggtcaacgtttcgcacttaagttttcaactaagagattaagtgtctcatttcactctgaaatccttccggacccaaaccaaataactcggtaagtcataagaacaattgtaaagcataaattaagcagtatatagggaaatagggttataatactcaaaatgaccggccgtgtcattacagtactgttctatactttcagatagtgttttgtcaatgagactttgtattcatattagatgctcatgtaatcagtgataccggattttgggagtgtatatatatgtaattgtgagatttcttccactgaatttaaatattatgttttcaaacttaaaagagatggtggtttattgagattgtcggcttgcctagtattgagataggcaccatcacgacaggtgagacgtcggtacagagacgtctatacttatcttcgagaggctgccgaacccttaggaaaattttactttcttgtattctatcgtgcgaatttgttgattccggaaactaaaattctgttattctattatctcacagatggtgaggacacgtactaccggatcggatggtcagccaacagtgccaccagttaggcccgcaagaggccgtggccgtggtagagccctgggccgaggtagaggtcaaggtatagctcatgcaacagttggagcagcacctgtagtaccagcaattgctccaactcaggagcagattccaaatgtagttgagccggtgggaccagctcaggtaccagctgtgaccattgtgattccaggccttcaggagactttagcctagatattgacagtgtgcactggtcttgctgaggtagttttggctcagggcgcacctgccacttctcaggccgagagagatactcatacccctgtttcccgtactccagatcaggtagtgcagggacttgaaatactggggacactactagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtagttcctattatggcagatgatgagtagaggagacttgagatatttgggaggtttctacctccatcatttagcagtgctgagtcagaggatgctcagggttttctggataagcgccagcggatgcttcagacaacgggtattctggagaccagtgggatctcgttcactacttttcagttttctggagttgcctttagttggtgggaggcttatgagaggtgcatgccgattggtgaattaccacttaaatggcatgagttctccgttctcttttttgagaagtttgtgccgcagtcttgtagagaggaactacgcaggaagtttgagaagttacatcaatatgacatatttgtgacgtagtacgagatgcgattttttgagttggctcgtcacacagtttggttggttcccactgatagggaaaggattaagaggttcattgatggcctcacatattaactacggttacttatgactagggatagggtatctgttgccacctttgaagaggtggtagacattgctcggcagatagagatggtccatagctaggagcgtgttgagagggaggccaagaggctcgaggttggggtggttctggtggggtaccttctgtaggacagtcctaccacatcaagggttgttcttacagacacggtcaccggggtgaatcatccagccatggttcatacggttctcatcagggccagtcatctctcagtgcacttctagcctagagtacgccatgtgctccctccgttcaaggatcatctgcaccaggttcttctggtatttattttggttctcgaggtccacctcagaactgatcagccttttcagataggggttgctttgagtgtggagacttgggccacataaagagatattgtccctgccttatgcgaggtccagttcagcagatgagtcatgttacgacttctgcaccagctgctccaccagctgctccaccacctgcccaaccagctcaggatggggctcagtcagctaggggtcgcccaagagggggaggccaattaagtggtggtcaggcccgattttatgctttttctgccaggccagatgctgttgcttcagatgtagtgatcacatgtattgtttcagtgtgccacaaagaggattctatattatttgaccctggttccacatattagaatttttatcatattttgttcattatctggatatgcctcgtgagtccttagtttcacatgtttatgtatctatgccggcaggcgatactataattgtggaccgtgtgtatcagtcatgtgtggtaattattgggggactagagaccagagttgatcatttattacttagtatggtcaattttgatgttaatttgggtatggtgagttatcagatgttttgatatttggctttgagccaagtaggggagcctgccattgacgatttgatttcatgtttatgtgttgtactggtttcggtttgaggcatacatgtgaatcgattataacttgcacagattgagatcggggatgacttgagtaagaaaatttcttgaatgatggttatattgcactttatgaaaaaaaatcatgaaatgatcaaattgttattttgaagaatgtactgcgcacgaagtatgaatttgattggtggtgttaaggcagggttacttctttgggggccgttgtgctaatggtacttgtgtcttttggcctgtttgggtagttaatatctctgcattaacttgccgatttgagtagtgatagcacaccttgcacatgcctagtacatggcgtgttatttgtacctgtccaagagcatgagaatcataattcatttatcatatacatgtgtacttatttgatcgttcatgtataatatgcttggactggaggcctatgaccatgccatgtggtttatattattggcacgtgagttgtccgtgcgagtccagatatttatactatagcacgtgagttgtccgtacgagtgatgataatgtgagctctagaagagctggttactctgattaaattcgtgtgtcttggttctactacatataatgagcttatagcattgaagttgtggtgatgcttattgaacttgcaatactgttctctacttcgagacatcttccatttgggtacaaggttgagcagttgtggcttgagttgtattggtgtggcatgttagtgggatagttatgtttaataatatatggtcattggacctataatgggtactataatattttatgatggtatattggggtttaattactagtaccgggttggttttgagtagttactatgatcgagaatggtgttgcgagtttgcgagttgtgtagtaggttatgcgattatatcttgagttatggctatagctttctagagtttattcatacttatacagtgtatagatgtgaaattcgagtcttgaaaaaaaaagaaaaagaaaaatctaaatgttagaaattgatttccaaggattatgggctaaggttgaagtaatgatgttcaattacatggtattgtcaagcctatatggaatagggtagcatgggatcacccccgggtttgtgcgtggtaagatggaatggtgatgtgatggcttggaaacaactcttggcacattcgaggacgagtgtatatttaagtgggggagaaagtaatgacccggccgattgttttaagtattaccacatggtttcccccatttactgctccacttgttctttaaagtttttgtgtgatttgcttgggtaattggctcgggtccggtgaggttttggaatgaattggaacacttagttctaaggtttaaagcttaagttaaaatagtgaccggatatcgacttatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaccctggaatggagttttgataatttcaatagcttcgtatggtgattttggacttagaagcgtgtccgaaaaattatttggaagtccgtagtaaaattagtttgaaatggcgaaagttgaaattggcgaaagtgcgtagtaaaattggtttggaagtccggagagttgactttttgatatcgaggtcggaatccagttctgaaaactttcatagatccgttttgtcatttatgacttgtgtgcaaaatttgaggtcaatcggaattgatttgataggtttcggtatcgaatgtagatgttgaaaattcttaagttccttaagcttgaattggggtatgattcgtggttttgcgttgttttatgggatttgaggtttcaactaagttcgtataatgttttagtacttgttggtgtatttggttgaggtccagagggcctcgggtgagcttcggatggttaacaggtcaaaatttggacttaaatagctgctggaatgtttctgctggaaaacaaatgaggctggaaaaatcgagatcatgaaaatcgaggtagtaaaaatcgagggcaggaaatcgagctcatgaaaattgaggtcatgaaaatcgaggccagggaatcgaggtcatgaaaatcgaggtcataaaaattgagggcaggaaatcgaggtcataaaatcgagggcagcgcctggacagaaatgggggtttcgtcccactttttcatttttgacaaattggagcttggggagtagcaaattttgagagattctcaaggaaaaacatcggggtaagtgcttctaactcggatttggtcaatatacacgaatatataattgttttcatcatttaattagtgttttgagatggaaatttggagaaaatgaggaagagttcttgggctagaattttgaggttttgaattggattttgttatcggatttgagtaaatttggtatggttagactcgtgagtgaatgggctttcgggttttgtgacttttgccagattttgagacgtgggcccgaggcctagtttgaggcgattttggatttttggctataatttcatattttttggtggagttgattcctttagcctatattgattgtaatgtactacttgtggctagattcggaatgtttggagactggtttgagaggcaaaggtattttggattagagttctagtcagattgaggtaagtaacacatctaaacttggttctaagagtatgaatccccgaatttggtgttatataaattgcttggaggtgacgcacatgatagttaacgagcatgtggacgtgcaccatagaaattgtgaattgaaaaaattctgtcgagttgaaaaattaaagaatcatgttattatccgtgtatcctccacgtgttagagaaatttacttgaggcacctattaaatatcatgtttaggctacgtaccgatatttttgggaccaatgaggtcgagttgttgttgaattgattgttttaaattgtaattccatactcagtcatgttcattcatttcatattatatctcagtctatgttattatttattgatatatcatattatcattttgggctgattttcatgacattttgagcacaagagactggagagattgaggactaagtgaggctgagggccaaattgtgaggatatttatgggatcgagctgagcgccgcaacagaccatattggctttatatatatatatatatatatatatatatatatatatatatatatattattatactgcccgccagcagcatgatttataggctttattatttcttatgggatcgtactgcccaccgcagtaggccatatcggctttatatagtgcttgggctgaaggggcccctccagagtctacacacacccccagtgagcgcggttgatttatggcgcttaggctgaaggagcccctccagagtctgcacacaccccaagtgagcgcggttgatttatattgagagatgcatcttccctgtacatggatcttgtccgaagcaattatatttggggatgtatcttccctgggcatggatcttgcccgaagcatttatattgagggatggatcttccctgggcatggatcttgcccgatgcatttatattgagggatgtatttccctggacatggatcttgtcctaatcattgatatttggggatggatcttccccctgggctggattggccatatacagtactgagtgattgagtattttagattgtgagtacacatagtttatgctaaggtgcatcacatacagtatgtacattggcatgtagatacagagatgtcatattcctcgtattgttcaaaattgatctgttttatttgtactgaaagcaactgttgaacttgaaagcatgcctacatttatgtattgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagattgtactcatcactactttcagcccaaaggttagtctttacttattgagttggttgtactcatacaacactctccacctcgtgtgtagatccaggtgctttcggacacggcgcccgttagatctcagagtgttatcagttggagactatcaaggtagctgcctagagtccgatgaccttgactcccttttttcagttattgtactgttctatactttcagacagtgttttgtcaatgagactttgtattcatattagatgctcgtgtactcagtgacaccgggttttgggagtgtttatatatgtaattgtgacatttcttccgctgaatttaaatattatgttttcaaacttaaaagatatggtggtttattgagattgtcgacttgcctagtatttagataggtgtcatcacgaaagatgagattttgggtcatgacatgtcatttcttcattttcgattgggatttttggagctcgaatttgggcgattttgaggatttcttcacaactttgactgggataagtgttctatatccgaaagtgattatatttcatgaatttatggttatatttatcgtttaattcgagtttcaatggaggaaattgggccttttgtaaaacttttcaaaaataaaaatttaagatttggaggacgattcgttattggaattcgataaaattggtatggttgaactcgtatcggaataggtgttgagatccgtgaaaattttgtcgggttccaagaggtgggccccacgttgacttttggttgactttttagaataaaattttaagtcgacattttattatccgaaattatttccgatgaattttaatgaagttatacaattaatttggataaatctgagctttccggaggtcaattcaagcaagaagacgattatagaatatcggcataacttcaaaaaggtaagtatcttgcctaaccttgagtggaggaattgccccttaggcatcgagtcttatgtgccatttgtgaaatgtaaaaaaaaatcgtgtacgcgaggtgaagagtatgtattcgggcttatatgttcaaatcttaagtgtttaaagtcttaagcaatttatgtagtaaaatggatatttgttggcatttattaaatcctctatttgcagtgcctcaatccttgttgtcgaatttgtttttatatgacgatgtggtgtgattgccaccttgatttttatatgaatcccgtgtttttgttgagttgatattttatggagataatttcattatggattatttatttgcaaatagtttatttaataattttaaaaggaggcaaagtgttaaatcttgaaatattattctgttgagtggttcacttccggatatttttattaagattttgtgcacattatggtcgagccatgggctccttattgtgaaacataatgtgttgttgatttctgtggcaagttgtaatatttaagcacttgtggtgcaatttatgagatgtcgtgatattgttgggaggtttgttcgggtgtttgcacgaggtttatgtcatgctattgttactattgatatatgcacatgcggcgtgataaggtatgctatatatatttgtgggtttgtgcatgtagcgagacaaggtggaaatattattatgtgcgtacgacgagataaggcaggcatttgctttattattgcgtgcgtggcgagacaaggtgggctatgtcgggaatgatttgtgattacttgtgatgatctggggtcattgttgttgaaatttatttatgatttgggactacgaggcggtatctcgggagtgcccttttgttgatatttctctatggctgcacttgcctttcgttatttaatttagtttttcggtaatatgtaaattcctttgttctccgtgatgtattatttgacttaatattaaatgttttgtatttattgtagtattatgttagctttggcttttttgtactagactatgatgatttgtatttctggtttgtacttgttcttaatgattgagttattttaaataaaagaattactattatgttttaatttaataagttttatatccaaatcagtagcttatctgatgctttattttaactaaaatgtcactttccccactcaaactatttcaaaaataaactcatttctttgttgaattcttacttggtttaaaaatagtaaccttaatttattgaaaataaattgatcgtgcagattttatgtactgatatatttggcaagagagttgtccgtctggttgtgatagagatatgggcacgaagtgccgtgagaatatgaaagggggttgagacctgtattttatgatttttacataaggattatttatttgaagaaatatattcgtagggtatttattcgaaagaattatatgtgagggatttatatttgaaggacttgtttaattggttgtacttgtgtttcttatcgtctgagtaataattatggtattcttgttgccttgttgtttatatcaccagttggttatagttgctatctgtcacgacccaaaatctaattaatcacgatggcacctaacccaacccgctaggtaagccaactttcagttatccaattccaataataattattaaagaaatttaagtaaattacgttcttaatcttatacattctccaagaactggtagtacaaatcatgagcttctaagaatagagtatacaatgctggtataaagtaaatacatcatctgtttgaaaagtacataaacagagttttatgaatctaaggctaccatgaacaagaggcagctacaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaacacaggtacatcttcagatccagctcccacgaacacaacaacatcatcaaccaacatctgcacgcaaggtccaaaagtttattatgagtacaaccgaccccatgtactcaatgagtatcaaacctaaccttaggttgaaaatagtgacgagcttgtaccaaggtcgggtccaccaccaattaccaacaacagttcataataacgtaaagcaagtaatacatgaagtaacttagagataagatgctcagcaaaatcatgatttccgaaaatagttctgcctttttgaaaacaataattttcccaaaaatcttttcaataataataaataagatgtttcattttcttttcagataaccagtgtaatacaaatgcatcactatgcccacctgtcaacatgtgtgagaaaccatgaatgacgtgatagcgtacaatatgaggaaaatacatctctatgcctgtatgtcatgtatgcatgtcaatgcaatgtatctcagagatgaactcgtgtactgacactctcagagtactcaatctcactttatcacacattccactcatcatgcccaatcactcagtactgtacatggccaatccggcccagggaagatccatctcggaatatacacatcaactgatcatcagtcactcagtaccaagtagggccaatccagcccgtggagaagatccatctccagggaagatccatctcggaatatacacatcaactgatcatcagtcactcagtaccaagtagggccaatccagcccgtggagaagatccatctccaggtatataatgcttcggacaatatccatgtccagggaagatccatccctcaataataaaaaccacactcactgggggtgtacagactctggaggggctcctacagcccaagtgctataatccgcacggacaactcatgtgctgcacagacaactcacgtgccataatatcaatatctggatctgcacggacaactcacgtgctatagtatcaatatcagaatcaatcgggccctcggcctcactcagtcagcaatctctccagtctctctcacgggctaacaatgtcatgaaactagcccgaaaatgatgatatgatgtatcaataaataacaacagagtctgagatatgatacgcaatgaaatgaatatgactgagtataaattttcaattcaaaataaaaaattcacaacaatatgacctatgtgggtcccaataatactggcacatagcctcaacatgattatttatactgcatagaaaatgccaagattatttgactacaaaattccacgaaaataattacgtcataatttctatggtgcacgcccacacgcctgtcacctagcatgcacgtcacctcccaaaaattcacataatacatatattcagggttcataacctcagctccaagattagaagagttacttacctcgaacaagacgaatccaattccgagcaaggtaaacaatgctctagaaattccattctacgggtattaactcctgaacgactccaatctagtcacaattaatttgatttagtccacacaatttataggatataattccatataaaaaaactaatattttcccacaaaatctgaaattacactccgaaaatcgcccgtggagcccacgtctcggaatccaacgaaactcacaaaatccgacaacccagcaaattataagttcaaccatactaatttcactcaattccgactccaaatcgatgttcaaaactcaaatattcgtattatgaactttaggccaacacccccaattttctctttaaattcatcaaccatttgcttaaaatgaagatagattcatggaatataatcacaagggagtcaagaatacttaccccaagttgtgtggaataattcctctccaaagtcacccaaaatgagctccaaaatccaaaaatgggtgaaaatatcgaaccctcgaacttaaagggttctgcccaggcnnnnnnnnnnnnnnnnnnnnnnnnnnnnnnnnnnnnnnnnnnnnnnnnnnnnnnnnnnnnnnnnnnnnnnnnnntgcgcacccacttctgcggaaaaatgtcgcacctgtgctgccctgcttcctcaccattttccgcttatgcgaatcactacccacatctgtgcaatcgcaggtgcagaaatccaatcgcacctgcgacctctgttgacaccctccaactcctcacctgcgctcgagctgccgcacctgcggccaagaccctcacaggtgcgatcacaccagaagggctacaacttcagcaacctcactactcaaacttttgatccgttaatcatccgaaactcgcccgaggcccccgggacctcaaccaaatacaccagtaagtgctaaaacaaaccacagacctactcgaggcctctaattatatcaaacaacatcaaaacgacgaatcataccccaattcaaaatctatgaactttgtactttgaattctatgtcttgtgccgaaacatatcaaataaatctaaaatgacgtcaatttttttacacaagtcacattacagacctattccaattttcagaatcgaatttcgaccccgatatcaaaaagtcaactcccccgtcaaacttcccaaaaattcaactttctccatttcaagccaaattccactacgtacttccaaatatcaatatctggatatgcacgaacaactcacgtgctgcacagacaactcacaggccataatatcaatatctagatctgcacggacaactcacgtgctgcacagacaactcacgttctatagtatcaatatcataatcaatcaggccctcggcctcactcagtcatcaatatctggatcggcaaggacaactcatgtgcttcaaagacaactcacgtggcataatattaatatctggatctacacggacaactcacatgctatagtatcaatatcggaatcaatcaggccctcggcctcactcagtcatcaatctctccagtctctctctcacgggctcacaatgtcatgaaactagcccgaaaatgatgatatgatgtatcaataaataacaacagagactgagatatgatatgcaatgaaatgaatatgactgagtataaattttcaatttaaaataaataattcacatcaatatgacctatgtgggtcccaataatactggcacatagcctcaacatgattatttatatgattctcagctaaaattcttcaacatataaaactgcatagaaaatgccaagattatttgactacaaaattcaaaggaaataattacgtcacactttctatggtgcacgcccacacgcccgtcacctaccatgcgtgtcacctcccaacaattcacataatacatatattcagggttcataccctcagctccaagattagaagagttacttacctcaaacaagacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttctgcggaaaaatgtcgcacctgcgctgccctgcttcctcaccattttccgcttctacgaatcactacccgcatctgcgccatcataggtgcggaaatccaatcgcacctgtgacctctgttgacaccctccaattcctcacctgcgctcgagctgctgcacctgcggtcaagacccttataggtgcgatcacaccagaagggctacaactttagcaacctcactactcaaacttttgatccgttaatcatccgaaacttgctcgaggcccccaggacctcaaccaaatacaccaataggtgctaaaacataccacagacctactcgaggcctctaattacatcaaacaacatcaaaacgacgaatcataccccaattcaaaatctatgaactttgtactttcgaattctatatcttgtgccaaaacacatcaaataaatctaaaatgacttcaattttttcacacaagtcacatttcacattacggacctattccactttccagaattggatttcgaccccgatatcaaaaagtcaactcccccgtcaaacttctcaaaaatttaacattctccatttcaagccaaattccactacgtacttcaaactatcaatatctggatatgcacggacaactcacgtgctgcacagacaactcacaggccataatatcaatatctggatctgcacagacaactcacgtgctgcacagacaactcacgttctatagtatcaatatcataatcaatcaggcactcggcctcactcagtcatcaatatctggatctgcacggacatatcacgtgcttcaaagacaactcacgtggcataatattaatattcggatctgcacggacaactcacgtgctatagtatcaataacagaatcaatcaggccctcggcctcactcagtcatcaatctctccagtctctctctcacaggctcacaatgtcatgaaactagcccgaaaatgatgatatgatgtatcaataaataacaacagagactgagatatgatatacaatgaaatgaatatgactgagtataaattttcaatttaaaataaataattcaaatcaatatgacctatgtggttcccaataatactggcacatagcctcaacatgattatttatatgattctcagctaaaattcttcaacatataaaactgcatagaaaatgccaagattatttgactacaaaattccacaaaaataattacgtcataatttctatggtgcacgcccacatgcccgtcacctaccatgcgcgtcacctcccaacaattcacataatacatatattcagggttcataccatcagctccaagagtagaagagttacttacctcaaacaagacgaatccaattccgagcaaggtcaaaaatactctagaaatttcattatgcgcgtatcaactcctgaacagctcgaatctagtcacaattaatttgatttagtccacacaatttataggatataattccatatcaaaaaactaatattttcccacaaaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacgtctcggaatccgatgaaactcacaaaatccaacaccccatcaaattacaagttaaaccatactaatcacactattccgactccaaaacgatgttcaaaactcaaaaatacgtattatgaactttaggccaacacccacaattttctctttaaattcatcaaccaattgcttaaaatgaagatagattcatggaatataatcacaagggagtcaagaacacttaccccaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactccaaatcgatgttcaaaactcaaaaattcttattatgagctttaggccaacacccacaattttctctttaaattcatctaccaattgcttaaaatgaagatagattcatggaatataatcacaaaggagtcaagaacacttaccccaagttgtgtggaagaattcctctccaaagtcacccaaaatgagctccaaaatccaaaaatgggtgaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgcccaaaatgagctccaaaatccaaaaatgggagaaaatatcgaaccctcgaacttaaagcattctgcccaggcttttcgcacccgcttctgcgaaaaaatgtcgcacctgcgaccactgttgacaccctccaactcctcacctacgctcgagctgccgcacctgcggccaagaccctcacaggtgtgatcacaccagaagggctacaacttcagcaacctcactactcaaacttttgatccgttaatcatccgaaactcgcccgaggcccccgggacctcagccagatacaccaataagtgctaaaacataccacggacctactcgaggcctctaattgcatcaaacaacatcaaaatgacgaatcatacaccaattcaaaatctatgaactttgtactttcgaattctatatcttgtgccgaaacacatcaaataaatctaaaatgacttcaattttttcacacaagtaacatttcacattacggacctattccaatttccagaatctgattacgaccccaatatcaaaaagtcaactcccccgtcaaacttcccaaaaattcaactttcgccatttcaagccaaattccactacggacttccaaatatcaatatctggatatccacggacaactcacatgctgcacagacaactcacatgccataatatcaatatctggatctgcatggacaactcatgtgctgcacagacaactcacgttctatagtatcaatatcataataaatcaggctctcggcctcactcagtcatcaatatctggatctgcaaagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacaaaaataactacgtcacaatttctatggtgcacgcccacacgtccgtcacctaccatgcgcgtcacctcccaacaattcacataatacatatattcagggttcatacccccagctccaagattagaagagttacttacctcaaacaagacgaatccaattccgagcaaggtcaaaaatactctagaaataccattatacgcgtatcaactcttgaacggctcgaatctagtcacaattaatttgatttagtccacacaatttataggatataattccatatcaaaaaactaatattttcccacaaaatctgaaattacactccgaaaatcggtcgtggggcccacgtctcggaatccgacgaaactcacaaaatccgacaacccatcaaattacaagttaaaccatactaatctcactcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgttctgcccgggcttttcgcacccgcttgtgcggaaaaatgtcgcacctgcactgccctgcttcctcaccattttccgcttctacgaatcaatcaatcgcaggtacggaaatccaatcgaacctacgaccactgttgacaccctccaactcctcacctgcgctcgagctaccgcacctgtggccaagaccctcacaggtgcgatcacaccagaagggctacaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttgaattctatatcttgtgccggaacacatcaaataaatctaaaatgacttcaattttttcacacaagtaacatttcacattacggacctattccaatttccagaatctgattacgaccccgatatcaaaaagtcaactcccccgtcaaacttcccaaaaattcaactttcgccatttcaagccaaattccactacggacttccaaatatcaatatctggatatccacggacaactcacgtgctgcacagacaactcacaggccataatatcaatatctagatctgcatggacaactcacgtgctgcacagacaactcacgttctatagtatcaatatcataataaatcaggctctcggcctcactcagtcatcaatatctggatctgcaaagacaactcacgtggcataatattaatatctggatctgcacggacaactcacgtgctatagtatcaatatcagaatcaatcaggccctcggcctcactcagtcatcaatctctccactctctctctcacgggctcacaatgttatgaaactagcccgaaaatgatgatatgatgtatcaataaataacaacagagactgagatatgatatgcaatgaaataaatatgactgagtgtaaattttcaatttaaaataaataattcacatcaatatgacctatgtgggtcccaataatactggcacatagcctcaacatgattatttatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaagtcatcaaccaattgcttaaaatgaagatagattcatggaatataatcacaagggagtcaagaacacttaccccaagttgtgtggaagaattcctctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgttctgcccgggcttttcgcacccgcttgtgcggaaaaatgtcgcacctgcactgccctgcttcctcaccattttccgcttctacgaatcaatcaatcgcaggtacggaaatccaatcgaacctacgaccactgttgacaccctccaactcctcacctgcgctcgagctaccgcacctgtggccaagaccctcacaggtgcgatcacaccagaagggctacaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcaaccttgctactcaaacttttgatccgttaatcatccgaaacccgcccgaggcccccgggacctcaaccaaatacacaaataagtgctaaaacataccacggacctactcgaggcctctaattacatcaaacaacatcaaaatgacgaatcataccccaattcaaaatctatgaactttgtacttttgccatttcaagccaaattccactacagacttccaaatatcaatatctggatatccacggataactcacgtgctgcacagacaactcacaggccataatatcaatatcttgatctgcatggacaactcacgtgctgcacagacaactcacgttctatagtatcaatatcataataaatcaggctctcggcctcactcagtcatcaatatctggatctgcaaagacaactcacgtggcataatattaatatctggatctgcacggacaactcacgtgctatagtatcaatatcagaatcaatcaggccctcggcctcactcagtcatcaatctctccactctctctctcacgggctcacaatgttatgaaactagcccgaaaatgatgatatgatgtatcaataaataacaacagagactgagatatgatatgcaatgaaataaatatgactgagtgtaaattttcaatttaaaataaataattcacatcaatatgacctatgtgggtcccaataatactggcacatagcctcaacatgattatttatattgattctcagctcaatttctttaacacataaaactgcatggaaaatgccaagattatttgactacaaaatccacaaaaataactacgtcacaatttctatggtgcacgcccacacgtccgtcacctaccatgcgcgtcacctcccaacaattcacataatacatatattcagggttcatacccccagctccaagattagaagagttacttacctcaaacaagacgaatccaattccgagcaaggtcaaaaatactctagaaataccattatacgcgtatcaactcttgaacggctcgaatctagtcacaattaatttgatttagtccacacaatttataggatataattccatatcaaaaaactaatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgttctgcccgggcttttcgcacccgcttgtgcggaaaaatgtcgcacctgcactgccctgcttcctcaccattttccgcttctacgaatcaatcaatcgcaggtacggaaatccaatcgaacctacgaccactgttgacaccctccaactcctcacctgcgctcgagctaccgcacctgtggccaagaccctcacaggtgcgatcacaccagaagggctacaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaaccttgctactcaaacttttgatccgttaatcatccgaaacccgcccgaggcccccgggacctcaaccaaatacaccaataagtgctaaaacataccacggacctactcgaggcctctaattacatcaaacaacatcaaaacgacgaatcataccccaattcaaaatctatgaactttgtannnnnnnnnnnnnnnnnnnnnnnnnnnnnnnnnnnnnnnnnnnnnnnnnnnnnnnnnnattttgaattctatatcttgtgccgaaacacatcaaataaatctaaaatgacttcaattttttcacacaagtaacatttcacattacggacctattccaatttccagaatctgattacgaccccgatatcaaaaagtcaactcccccgtcaaacttcccaaaaattcaactttcgccatttcaagccaaattccactacggacttccaaatatcaatatctggatatccacggacaactnnnnnnnnnnnnnnnnnnnnnnnnnnnnnnnnnnnnnnnnnnnnnnnnnnnnncacgtgttgcacaaataactcacaggccataatatcaatatctggatctgcatggacaactcacgtgctgcacagacaactcacgttctatagtatcaatatcataataaatcaggctctcggccttactcagtcatcaatatctagatctgcaaagacaactcacgtggcataatattaatatctggatctgcaccgacaactcacgtgctatagtgtcaatatcagaatcaatcaggctctcggcctcactcagtcatcaatatctccactctctctctcacgggctcacaatgtcatgaaactagcacgaaaatgatgatatgatgtatcaataaataacaacagagactcagatatgatatgcaatgaaatgaatatgactgtgtgtaaattttcaatttaaaataaataattcacatcaatatgacctatgtgggtcccaataatactgacacatagcctcaacatgattatttatatgattctcagcaaaacttcttcaacatataaaacttcatagaaaatgccaagattatttgactacaaaattccacggaaataattacgtcacaatttctatggtgcacgcccacacgcccgtcacctaccatgcgcgtcacctcccaacatttcacataataatatattcagggttcataccctcagctccaagattagaagagttacttatctcaaacaagatgaatccaattccgagcaaggttaaaaatactctagaaattccattatgcgcgtatcaactcctgaatggctcgaatctagttacaattagtttgatttagtccacacaatttataggatataattccatatcaaaaaactaatattttcccacaaaatctgaaattacactccgaaaatcgcccgtggtgcccacatcttggaatccgacgaaactcacaaaatcggacaacccatcaaattacaagttaaaccatactaatctcactcaattccgactcaaaatcgatgttcaaaactcaaaaattcgtattatgaactttaggccaacacccacaatttactctttaaatttatcaaccaattgcttaaaatgaagatagattaatggaatataatcacaagggagtcaagaatacttaccccaagttgtgtggaagaattcctctccaaagtcgcccaaaatgagctccaaaatccaaaaatgagtgaaaatatccaaccctcgaacttaaagcgttctgcccaggcttttcgcacccgcttctgcggaaaaatgtcgcacctgcgctgccttgcttcctcaccattttccgcttctgcgaatcaatacccgcatctgcgcaatcgcaggtgcggaaatccaatcgcacctgcgaccactgttgacaccctccaactcctcacctgcgctcgagctgccgcacctgtggccaagaccctcacaggtgcgatcacaccagaagggctacaacttcagcaaactcactactcaaacttttgatccgttaatcatccgaaattcgcccaaggcccccgggacctcaaccaaatacaccaataagtgctaaaacataccacggacctactcgaggcctctaattacatcaaacaatatcaaaatgacgaatcataccctaattcaaaatctatgaactttgtactttcaaattccatatcttgtgccgaaacacatcaaatcaatccagaatgacttcaaatgtttcacacaagtcacatttcacatgtcagacctattccaatttccagaatcggattacgaccccgatatcaaaaagtcaactcccccgtcaaacttcccaaaaattcaactttcgcaatttcaagccaaattccactacggacttccaaatatcaatatctggatatgcacggacaactcacgtgctgcacagacaactcacatgccataatatcaatatctggatctgcatggacaactcacgtactgcacagacaactcatattctatagtatcaatatcataaacaatcaggccctcagcctgactttgccatcaatatctggatctgcacggacaaatcacttgcttcaaagacaactcacgtgccataatattaatatctggatttgcacggacaactcacacgctatagtatcgataagagaatcaatcaggccctcggcctcactaagtcatcaatctctccagtctctctcacaggctcacaatgccatgaaactagcccgaaaatgatgatatgatgtatcaataaataacaacagagactgagaaatgatatgcaatgaaatgaatatgaatgagtataaattttcaatttaaaataaataattcacatcaatatgacctatgtgggtcccaataatactggcacatagcctcaacatgattatttatatgattctcagctaaaattcttcaacatataaaactgcatagaaaatgccaagattatttgactacaaaattccacgaaaataattacgtcacaaattctatggtgcacgcctacacgcccgtcacctaccatgcacgtcacctcccaacaattcacataatacatatattcagggttcataccctcagctccaagattagaagagttacttacctcaaacaagacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatctattcacaattagtttgatttagtccacaaaatttataggatataattccatataaaaaactaatattttcccacaaaatctaaaattacactccgaaaattgcccgtggggcccacgtctcggaatccgacgaaactcacaaaatccgacaacccatcaaattacaagttaaaccatactaatctcactcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtattatgaactttaggccaacatccacaattgtctctttaaattcatcaaccaattgcttaaaatgaggatagattcatggaatataatcacaagggagtcaagaacacttatcccaagttgtgtggaagaattcctctccaaagtcgcccaaaatgagctccaaaatccaaaaatgggtgaaaatatcgaaccctcgaacttaaagggttctgcccaggcttttcgtacctgcgcacccgcttctgcggaaaaatgtcgcacctgcgccgccctgcttcctcaccattttccgcttctacgaatcactacccgcatttgcgcaatcgcaggtgcggaaatccaatcacacctgcgacctttgttgacaccctctaactcctcacctgcgctcgagctgccgcacctgcggccaagaccctcacatgtgcgatcacaccagaagggctacaacttcagcaacctcactactcaaacttttgatctgttaatcatccgaaactcgcccgaggcccctgggacctcaacaaaatacaccaataagtgctaaaacataccacggacctactcgaggcctctaattgcatcaaacaacatcaaaacgacgaatcataccccaattcaaaatctatgaactttgtactttcaaattctatatcttgtgccgaaacacatcaaataaatctaaaatgacttcaattttttcacacaagtcacatttcacattacagacctattccaatttccagaatcggattacgaccccgatatcaaaaagtcaactcccccgtcaaacttcccaaaaattcaactttcgccatttcaaaccaaattccactacggacttccaaataattttccggacacgctcttaagtccaaaataaccatacagagctattaaaatcatcatatttcaaatctgaggtcgtctacacataagtcaacatccggtcgacttttccaacttaagttttccattatgagactaagtgtctcaattcattccgaaatccttccatacccgaactaactaatccaataggtcataattcaataataaagcataaatagagtaataaatgtggaaatggggttgtaatacctaaaacgaccggccgagtcgttacactatcactgctatttgttctctattatttctatgttatattgcacaggttatttgactagtgagtgtcttgactgtacttcgtcactactccaccgaggttagtcttgatacttactggttaccgactgtggtgtactcatactacacttctgcatatttttgtgcagagccaggtaaattggagttaggtgatcgctagttagctgtacagatcttgctgtggagactcaaggtaaacctgttgctgcgttcgcaggcttcggtgtcaccttccgatattgttcttgcactattttatttctacttaagaaacagttttatttataggttttctagtaactcaatagagcttatgacttgtactaccggttttggcattttatgtattatatagagatttctactttgcatttgttagccgttaattaatattgttattattttagtaaatattaggcttacgtagtccctaagactaggttccatcacgacatcttatggagggagatttgggtcgtgacaagttggtatcagagccctaggttaataagtgctacgagtcataagcgagtttagtagagtcttgcgtatcggtacggagacgtctgtacttatctttaagaggctacgaaactattaggatagtttcacttcttttattcctatcgtgcaagtttattgatctcggagtttgagttatttttgtcattctatgctttcacagatggtgaggacacgagctgcagttgccgatgatgcttccccaagaggagatgatgctaggggcagagatagaggaagaggccgaagaggagcacgtaacccaattagggcacctaccagagcagcagttgaggagccgctagtatctccggttgggggataggtaccggaggcgcatgctgttacccctgcacttcaggagactttagcatagttcctgaacctgtttggtacattaactcaggtggggttgattccgatcacaccagctacttcactgaccggggaggaattcagtctcccgccgcctacactacagagaagcatgctcacattgctctgtttcaaggtgtcatggtgacacatcctgtggtcccagttcagcccatggttagggttgcaacatctgaggaagagcagcttagactttcaaggttcaagaagtatgatcctcctactttcagtggtttgccttcatagggtgcacatggctttctagaagagtgccatcgcattctccgtactattagtattgtggagatgagtggtgttgcgtttactacattatagctcagggaagcggcttatcagtggtggcgggcgtatgagttgggtagcccagtcgatgcagctccactttcatggactcagtttttagagatattcctgagggagtttgttcctcagtttcttcgagattcttggcgcgcagagtttgggaaactgcgccagagtaatatgacagtgtcatagtatgccattagatgaagtgatttagccagatatacacctgctttggttgctacagttagggagcaagtccgtaggttcattgaggggctcaggcgtgatattcggttcaacatggctcgggagttggagtccgatgtttcattttagcagatggtaaagatcgctcgctgattagagggtatgtgggaccaagagagagaggacaggcagggtcaggaaagagatggcaggcgaggtcaggagagagaggacagggaggcgaggaggcctcacagaccggagagatatgctggtccttattttggaggcaggtgtaatgactcgatcgatccttttgagagtaatagccctgatcccctataaaatacttttctcatatctattttttgctattatgacttgtcgggaggtttcgttttggtttttggactgttttggacaattagtccctaaaatttggaccgtagttggaacagtgtgaatatggcgaccaaatggaattacttcaattccgttagctccgttgggtgattttgggcttaggggcgtgtttagattgtgttttggaggtccgtagctcaattaggcttgaaatggtgaaagtcaattttttggagttttggaccggtagtgaaatttttgatatcggggtcggattccgattctgaaagttggggtaggtacataatgttgatttggagttgcgtgcaatatttggggtcaatcggatgtgatttggttggttttggcatcagttgtcttatttggaagtctcaagttctttaagtttgaatcggaggatgattcatgattttagcattgtttgatttgatttgagggctcgactaagtttgtatgatgttttaggattggttagtatgtttggttgaggtcctgcgggcctcgggtgagtttcagggtgatttgtgagcgagtaggggcatttcagcactctaatgttgttctgggggtctttggaagtgcggaccgcacattttaggagtgctgaggcataaggtaagtgcggaccttaggggaaataaagttgtagcccttcgtgtcttgtttccagaaaggtaaataactcatcatgtggacatctgtaaagaaacttatggctaaaatactaaagcctggcagtgcagtcaccaagagagtgtgtctgcacaaattttgtgtgaccgcaggagctggtatgtgcgaccgcacttggaattgtgcggactgcacatggtgagctcatagaatgtactatataacctaggcttaggttattatttcatttttggaccttgggagctcggttggagacgaattttcgtgggtttttcaagaaattcatcggggtaggtgattctaactcggatttggttaatatacatgaatatatcactgattttatcatttaattagtactttgagatggaaatttggggaaaaattgtagaaacttcataaaccacaaattgaggatttgaaggtcgagttgtgatcggcattggctaattttggtatggttggactcgtaagtgaatgcgtgttcatattttgtgacttttaacggatttcgagacgtgggcccggggaggctttttgggtgtttttctaatttcttgctttagctttgctttcattagctagattagtgtcttgtagctatatttatattatgtaattgatttggctagatttgggccactcggagccggatattcgtgggaaaggcattgtgactgattgattgagcttggttcgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggcttgcctaaccttatgttggggaactttccttaggatttggtacaatttttgatatatgagctccgtgtacgtgaggtgacgagtgcgtacacagactattattgccaaactccattttcattaagtaaaatacatgtcttcctttaactgagctacactagcacatgaatttatcctgtttagtctagaagaacatgtctacgtgaactctgtgctacatgcttagtgaatttcctacttcttccttgactggtacttaatctaaatcgtacgattttgtgatgtagttgtatttctattatttgcgctgcatatttattttgggactacggacctatattccggtagacccccctactctgcatatttacttcgggactacggaacggtatttcggtagatcctcctgctctgcatatttactttgggactacggaacattattcaggtagatcccccatgctctgcatatttactttgggactacggaacggtattccggtagatctcgccctgtttttgcacatttacgtatgggacggtattctgggagatgccctgttgttatatctatgtactgagctgttgacttgctttgatttcattcttgtttaatttcagtacttatttttactgaaatatttcattcagttttagtttattatatatataccagtagggccctgacctgatatcgtcactactcgaccgaggttaggcttggcacttactgggtaccgttgtggtgtactcatgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctgcacatgtttttcgtgtgctgatccaggtaccgcttatcagccgtattatcagtaaggcgaggcagctgttgagacttcaaggtatatctgccgtgttcgcagacctcagagtccctatttactcttccccatgtcaaacacttcttgtatttctttttgttagattctggaatatagaaacactgttctattcccttagcttatgattacgatattccgggttttgggagagttatgtacattttgagagtgacctggtatatatcgagcgatatcttaatttcttatttagaatctacctgtaaattgatagttttagtgtttttgtttcatttccgcgaaggttttaggcttacctagtcgtagagactaggtgccgtcacaatagttcaaggagggataacttgggtcgtgacaagttggtatcggagctctaggttcataggagtcgtgagtcacaagtcggtttattagagtctcgcggatcggtacagagacgtctgtacttatcttcgggaggctatggaactaataggaaaattccacttcatttgtttccttgtcgtgcgagatttttgacttcgaaattctaaacttctgtcttctattctctcacagatggtgaggacacgtgctactggagatgaccaagcacccgcgccccctgctagagccgccagaggtcagggccagggtagaggccgaagacgcccacgtggtgcagccagagcacccaagcgagctgctatagaggaaccaccagcagtcccattcggagcacaggcacctgatatgcctactattactactccagcacttcacgagaccttagcacaattcctgagcatgtttggtacattggttcaggcggggttgattctggttgaaccaactacttcacagaccgggggagggacccaggctcacgccgcccacactccagagcagcaagttcacgttggtcaggttccaggtgtcgtggcgacacagcctggtgtcccattttagcaggtggtagggatcgcttgtcgggtagaggataggtgggtccacgcgagagaggacagacgaggttaggagagagagtacagggaggagaggagacctcatagactggagagatccactggtccttattttgaaggcagggtactacatagtagaggttttgtgggccagccagttcagtttgcatttcaggcttcgcacagtgtttcaagtgttcatgggtctcagggttcccgtagcgcacaattcccacatccaagtcagtagcgaggttgttttgagtgtggcgacactcgccatgtggtgaggattttccccagacttaggagggtgtacctccacagacttctcagccacagcgtgctccaccgggtcctcaggctatgattacagtaccagctgccacctcacctactcagccagctcgaggtggaggtcggggaggtagaggtcaccctagagggggagtccaggccagatgttatgccattcatgctcgtacggaggtagtttcttctgattttgtcattacaggtattgttccggtctgtcatagagatgcatcgctattatttgacctaggctctacatattattattatgtgtcctcttattttgcctcgtatttgggcgtatctcgggattatttgagttttcttgtttatgtgtctactcctgtgggagattctcttgttatggaccgtgtttatcggtcgtgtttgtttactcttagtggttttgagaccagagccaatttattattgctcagcatggtagattttgatgttaacttaggcatggactggttgtttccccattatgctattcttgattgtcacgccaagaccaagacactggctatgccaggtttgccgcgattaaagtggaggggtaccttagattacactcccagttgagttatttcatttgttaaagctcagcgaatggttgagaaggggtgtgacgtgtatctagcctatgtgagagatgtcaatattgatacccttacaattgagtcagtaccagtagtgagggatttccctaatatgtttccagttgatcttctaagcatgccgcccgacagaaatattgatttcgtcattgatttgttgccgggcactcagcccatctctattcctccataccgtatggctccttctgagttgaaggagttgaaggagaagttactgagttgcttgataaggtcttcattcggcctagtgtgtcaccttggggtgctcctgccttatttgtgaagaagaaggatggttctatgcgggtgtgtattgattactgccagttgaacaaagtcacagtgaagaacatgtatccattgcctcgtattgatgacttatttgatcaattacagggtgccagagtgttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctatcatcagttgaagattcgggagccagacatctcaaagactattttcaggactcggtatggtcactacgagttccttgtgatgtcttgtgagctgaccaatgccccaacatcttttatgcacttgattcacagtgtgttccggccttatctcaactcattcatcattgtgattattgacgacattctggtatactcccggagtcgggaggatcatgagcagtatctgaaaataagttatatgaaaaattttctaagtgtgagttttggctagactcagtggaattcttaggccatgtagtatcgagtgatgggatcaaggtggatccgaagaaggtggaagcagtgcagagttggccaagaccgtcataggctacggagatctgtagttttcttggtttggcggggtattaccgtcactttgtagagggattctcatgtattgcagaacctatgaccaggctgacccagaagggtgctctgttcaggtggacaaaggaaagtgaggagagctttcagaagctcaagacagctttaactacaaccccaatattggtattgcctacaggttcggggtcttatactatatattgtgatgcattgcagattggtctcggtgcggtgttgatgcaggacggtagggtgattgcctaagcatccagacaactgaaggtgcatgaaaagaactatcctttccatgaccttgagttagcagctattgttcatgccttgaagatttggcggcattatttgtacggtgttccttgtgagatttacaccgatcannnnnnnnnnnnnnnnnnnnnnnnnnnnnnnnnnnnnnnnnnnnnnnnnnnnnnnnnnnnnnnnnnnnnnnnnnnnnnngcaaaacgatcttaacttgcgtcagcggaggtggttggagctacttaaggattatgatatcaccatttttgtaccgccataggaaggccaatatggtggccgatgctttgagtcgccgggcagagagttagggaaaattagcatatctaccagcaacagagaggcccatggcattggatgttctggccttagccaatcagtttatgagattggaaatttctgagctgagtcgagtattggcttatgtggtctcttggtattctctttatgatcgtatcagggagcgtcaatatgatgaccccaatctgcttgtccttaaggacacggtctagcatggtgatgctaaggaggtcactattgtagatgatggtgcattgaggatgcagggcaggctatgtgtgcccaatgtagatggtttgcgtgagttgattctctaggaggctcacagtttgtggtaatcaattcatccgggtgccgcgaagatgtattaggacttgaggcagcattactggtggaggagaatgaagaaggacatagtagagtatatggctcggtacctaaatttccagcaagtgaagtatgagcatcagcgaccaggtgggttaattcagaacttagagattccggaatggaaatgggtgcggatcactatggatttcgttgttggactcccacggacttagcggaggtttgatgctgtttgggtgattgtggataggtcgaccaagtcagctcattttattaacttgacgaaacgcccgtagaactttgtaaaaacgatcataaaagagtcccaagatgattaccttggcaaaccaagtataaatcctgaagaaccagcaagaacaacaattttctatcttccaaaaatagctccaaacacagctaatagaaggggaaaacgattgcaaagcgtagagattgcgcttctaggcacgggggcaaactttaacgatagaaatcgttaaaaatgcaccttaatcactcaagaacaccatgaaaccctctcttaagctttctcactgttttgggacgaagatgaaatgttttggggtcttaaaagtcggattttccgacttataccacttgtttgacctgacccggttcgcgacccaatttcagcccggacagtccgcggtaaaaacagtcataacgtttaactccaatgtcggtttgatgtgagatttctttgtttgcaaactagacttgtagaccttcgatttggtaggttgtgggtcccataaatctgtatatattgggagaaatgatctgatatatttgacccaaagtttagaaaacttattagagaaatttacgataacttttgccgacctttatttcgcaacttgcttgactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaatgcgtggggtgctaccctgtgatgactacttattccttcgagcagctagctcgagtttatatccgcgagattatcaagcttcatggcatgccagtatctatcatctctgaccggggtacgcagttcacatcacggttccggagggctgtacagtgtgagttgggtactcgagtggagttgagcacaacatttcaccctcagacggatggacagtctgagcgcactatttagattcttgaggatatgctttatgcgtgtgtgatgaagtttgaaagttcttgggatcagttcttgccccttgcggagtttgcctacaacaacagttatcagtccagcatttagatggtaccgtatgaggctctgtatggtaggcggtgtcggtccctagtgggttggttcgagctgggcgaggctaggttattgggcacaaagttggttcaggatgctttggagaaggttaaggtgattcaggatagacttcgcacagcctagtccagatataagagttatgcagatcggaaggttcacgatgtggtattcatggttggagagcgagtcttgctccgggtttcgcctatgaagggcgttatgaggtttggaaagaaaggcaagctgagctcaaggtttattggtccctttgaggtgttacggagagttggggaggttgcttatgagcttgccttgcctcccagcttagcaagagttcatccggcatttcatttttcgatgctacaaaggtatcatggcaatccgtctcatgtgttggatttcagctcagtccagttggacaaggatctatcttatgttaaggagccagtggctatttttgacaggcaggttcgaaagaagaggtcaaagaacattgcatcagtaaaggtttagtggcggggttagctggtcgaggaggcgtcttgggagccgagcaggatatgtgcagccgttatcctcatcttttcaccacttcaggtatgtatctatgcttgtttgaggacaaatgattgttttaagagggggaggatgtaacgacccgtccggtcattttgagagtaatagccccgatcccctattaactactttccccatatctattttctgctattatgacttgcagggaggtttcgttttggttgttggagttttttgggacacttagtccctaaatgggagcttaagtcttagaatttggaccgtattcagaacaatgtgaagatggccccggaatggaattccgtcaattttgttagcttcgttgggtgagtttgggattaggggcgtgtccggattgtattttggaggtccgtagctcaattagccttgaaatagtgaaagtcgatatttttgagttttggaccagtagtagaatttttgatatcggggtcggattctgattccaaaagttggagtaggtccgtaatgttgattttgacttgtgtgtaaaatttggggtcaattggatgtggtttggttggtttcggcatcggtggtcgaatttgaaagtttcaagttctttaagtttgaatcggaggatgattcatgattttagcgttgtttgatgtgatttgagggctcgactaagttcgtatggtgttttaggattggttggtatgtttggttgaggtcttggggcctcgggtgagtttcagggtgagttttgagcgagtacgggcttttcggcactctaatgttgttctaggggtctttggaagtgcggatcgcacattttgggagtcttgaggcataagggaagtgcggacctcaggggaattgtgcgaaccgtacaatttcgtgtgcagccgcacttcaggctgcagaggagtgtacagccgcactcaggaactctcaggtttgctaatccgacttcgaaagcttatatcttttgatctacgacgaatttggagatgattcaaaaacaaaagttgtagccctttgtgtctagtttccagaaagataaataaaccatcatttggacattagcagataaagttatggacaaaatagtaaagcctagcagtgcaatcaccaaaagagtctgacggcacaatatttgtgcgaccataggagctgggatatgcggccgcacttggaattgtgcggaccgcacatggtgagttcatagaatgtactatataaccgaggcttaggttattatttcatatttcgaccttgggagctcggtttgagatgattgttcatggatttttcaagaaattcatcggggtaagtgattctaactcggatttggttaatatacatgaatatatcactgattttgtcatttaattagtactttgatatggaaattcgggaaagaattgtagaaacttcataaaccacaaattgaggatttggaggccgagttgtgattggaaatagctaattttggtatggttggactcgtgagtaaatgggtgttcatattttgtgacttttacccgatttcgagacgtgggcccggggagggtttttgggtgtttttctaatttcttgctttagctttgatttcattacctatattagtttcttgtagctatatttacgctatgtatttgatttggctagatttgggctagtcagagctggatattcgtgggaaaggcattgtgactgattgattgagcttggttcgaggtaagtggcttgcctaaccttgtgtgggggaactcctcttaggatttagtactgcttttgatatatgagcgccgtgtacgtgaggtgacgagtgcgtagacggactattgtcgcaaaactccattttcattaagtaaaatacctgtcttcctttaacagagctacactagcatatgaatttatcctgtttagactagaacatcatgtctacgtgtcttaattgcttttgtaaactctgtgcagcatgcttagagaatttcctgcttcttccttgactggtacttaatctaaatcgtaagatttcatgatgtagttgtatttctattgtttgcgctgcatatttcctttgggactacgaaacattattcaggtagatctcccatgctctgcataattactttgggactacagaacggtattccggtagatcccccctatttttgcacatttacgtatgggactatgggaaggtatcctgggagatcccctgttgttatttctgtgtactgagctgttgacttgctataatttcattcttgttaaatttcagtacttatttttattgcaatatttcattctgtcttagtttattatatatataccagtaggtccctgacctgatctcgtcactactcgaccgaggttaggcttggaaattacggggtacctttgtggtgtactcatgcccttccctgcacatgtttttcgtgtgcaaatccaggtaccactaatcatccgcattatcagtgaggcaagacagctgttgagacttcaaggtatatctaccgcgtccgcagacctaggagtccctatctacacttccccatgtcaaacacttcttgtatttctttttgttagattctggaatatagaaacactattctctttctgtagcttgtaacttatcgatattcctggttttgggagagttatatatatttcaagagtgaccgtggtatatgtcgagcggaatcttaatttcttatttagaatctacctgtaaattgctagtttaatgttttcgtttcatttccgcgaaggtgttaggcttacctagtcgtagagactagattctgtcatgacggtttaaggagggagaacttaggtcgtgatagcagggtacgatatggtagagggtttgtgggtcagccagttcagtttgcacttcaggcttcacacggtgtttcaggcacttatgggtctcaaagtacccgtaccgcacattttccacagccacgtcaacagagaggttgatttgagtgtggagatacaaaccacatggtgagagattgtcccatactccggacagatatggcacaacggggtattcatgcgagtagaggatgctcaagagggggaggcccggcccgttgatgtgtttcatacaataggtctgaggtcgctgtgccagacgatgtcatatagatatggttttgatttattatagagggacctcattcgtattgtgtttcagttctgattatcgaggtgagacctcctatcatgctccatataggacgagtttgtgaattgtacaccacccgcgtatttatccatgttgggagatttgatggtgttagcccgtgtctatcattttttctttgtacgttattgaggactaagagcccaaaagtgtctttttattactcactacagtgaattttgatgtaatttcaggataattgattgcaattttaggactttttatgccctgtcggtatgaggcttcattatgtgttgtgaaattgtttcacaaaatttatttaaagagaagaaggaaaagaaatggcaaatttcagttggcacaatgtgcaaagtacttgtgattcagagttgagggcgagatcctcgcatttttatatgatgtgaaatatttaaaccgggctacaacccgcggtggaagttatataaggacgaggtccttgtgatgaagatttatgtgtttaaggcctcccttgtgaaattaaatttttactatagtactaatagggagtcatgcatgttaggcttatttgataattcttttatgtgttttatgtgcatatttagccatttcgtgctgtaattattgagttttagcctatacggtgattgccctggtgatgttaaatgcaactcattaatttggataaataattaagaggtcttcatgcctcgcgtgttactgttagtgctgcaaaaatttgaaatgagatttttggttaatatgatattaattgaggatgctggaattaattataaacagctataacgaccagagatgtggttatgggagtacgtatgatgtgtgtatgggcatgaaatttgctacaatcggttgagactaacacaatgtgttaatatgaaaaatcaggcatttgaaattgattggagagtaaggaattggctttaaagcttataagtatggataaaagaaataatctctactgagacggtgttgttggaatcgtgttaaatttatggtgatgtagaatcatccgtgagtatgtgtgaaataatgcacttaataatttaaagtcctcaaaaagattcttggcacgttcgaggacgaacgtatgtttaagagggggagaatgtaacaacccaacttatcattttaagaattaattccctgttcaacggcttaagatatcgagcagcttcgtaatatgtattatgacctgcatgtatggtcgagtttggttttgggaatattttcgaatttaattaaaagaacaatcctcattttgtagcttaaaatgaaaaggttgaccagagtttggcttttgagcaaatgactctggaatggaattttgatgatgtcagtagtttcgtatggtgatttcagacttatgcatgtgtccgtatttggatttggaagtccataggataatttgacgcattttggcgaaagttggaaaatggaaaatttttagaaagtttgaccgggagttgactttattgatatcgaggtcgaaattcgattatggaaattggaacagatccgttatgtcatttgtgacttgtgtgcaaaatttgaagtcattccggattgatttgatatgcttcggcacaaattattgaatttgaaaatttgataactcataattcgattagaggtgcgattcattgttttggcattgtttgatgtgatttgaaagctcgactaagttttatcatgttttgggacttgttggtatgatttgacagggtcccgaggggcttgggtgtatttttggatcattggttgagagactactaaagttaagaaatttgggagtttgaccatggtcaatatcgggttaagacgacctctttacagtgttttgagtgcgtgagcaagtccgtagcatgttttatgattgaaattcatatatggtttgtgtccttgaggttccagatgagcttcaaagtggtttcagatcatttcggagacgttttaatttgctggtttctggtgagtgtcacgacccaaaacccattaaaggtcgtgatggcacctaacacagttgtcaggcaagccaaccttgacgaattaatttaattactcattttagtatttgagaatcgaatttttgttaattaaatagtaaagatagaattcatatagtaagtgataaatattttagaacataaattactaaacccataaccactccaaaaatctggtgtcacaagtgcatgagcattaactagggagtaagataaaatacagtatctgtccggaatataaattagacaagaaaatataaataactctgaaggagactctgctggttgcggatcctaatatagaatgcagctcacctaagtccctgcatttagccacacctctgcgcctacaaggccgctagacatatctgtacctgcacaaaaatgtgcagcaagtgtagcctgagtacgtaaataacgtgtactcagtaagtatcaagcctaacctcgaagaagtagtgacgagaggtcgactttggcactcactaagggtcaataatattcaaatagaaatatttaaatcaacatgatttagagaattaacaataattttctttaaccaacagaaataattaaattccttcaaatagacaattccaaatttatttaacttcacaagctgcaattaaaatattaaggtatcgtgtaattattattattagccatgatttctgccgaggtcgtacgacccgatccagagtgtcgtgtacattgtctagggacatgcggcgcgatccatagatgcatctatactgccgaggtattcggcccgctccacaagaaaggaggacattttcttatgtacctccagaatgaggatatatatattataagattaatagaagacgatgtttaatttgttttaacaattaaataatttatacaaaaattcaagtatatgagattccaatcttttactatcttccctagcaattcacaatatagttcaaatatattgattaaataaagaatacaataaatacgcgtaattcatgatttgagtcctaaacaacccggactttagcataaatagtagctacgcactaactctcgtcaaagcagctccgacaattagcaacaattattaatttaaatcacctaaggggtaaatttccccttacaaggttagacaagagacttacctcgacttgctccaatttattctactattaggcattttcctcgattaaccaactcttaatggctcgaatctagccaaaataattcgatacagtcaccaaaaattatacgaatcaatttcataagaaaatactacatttttcaataaaaatccgaaattaactcaaaaatcgcctgtggggaccatgtctcagaatccggcgaaagttacgaaatatgaacgcccattcaaccatgagtctacccataccaaaacaactaaatttcgataacaattcggccctcaaatcctcaaatttatccaagagggttttcaaacctttccaacttaattcaccaattaaatgataaaaacaatgatcgattcatgtaatttaaccaatattgagttaagattacttaccccgttgttttctctgaatgtctcccaaatatcgcctcaatccgagctccaaataggtttaaatggaaaatgggacgaagtcccattttcagaacttaaactctctgcctagtgatttcttctacgcgatcgcgaacattctcacgcgaccgcatagcacaaatttttattgcttaaaaataacactatgccatcacggataatcgcacgcgatcgtgaaacactaactctgcaaacctagattccgaccccgttatcaaatggtgcactcctggtcaaactttttaaaaacctttaaatttctaactttcgccaaataacctcgaaattacctacggacctccaaattaacatctggacgctctactaagacaagaatcaccatacggaggtattcccagactcggaatcccaaatggacatcgaaaacattgaaatgcacttcaacccaaatttatgaaattcttccaaaatgccaactttccacaataggcgttgaaacgctcccgggtcatccaaaacccgatccgatcataaacccaagtccaaattcatcatacgaacctattggaaccgtcaaatcccaattccgaggtcgtttactaaaaatattgaccaaagtcaaactcgcccttttaaagccaactaagttactaagtgctccgatttcaacccaaacactttcaaattctgaaccaatcatccccgcatgtcataaattagtaaaagcacatacagggagtcgtatttaggggaacggggttctaacagccaaaacgaccggttgggtcgttacattctctcccacttaaatatacgttcgtcctcgaacatgctaagaactactccaagtttgctaaaattattgtttaagaccttgagcacctatctgtgctaccacaactaagctgagcacattagcccgagcaaatctgaagattggcccctttgtttaggggaataagccttagatccaaattccaacattcgaaattttctattaggcctgcatccaacatatgtacaccgtttcaatcaccacacgatgtaccattacatgattgtatactctcactgaattcacatcatgcacaacattattcacatgaccataataacatcctctgacaatgatagacaaaattccacgaattcgatgcccataacacacttcatgacacatataagtcatgttccaatcttgcaatgctgccacgagggaaaagatgtgttgaaattcataaccaattatatagtcaacaaatcatatagtccctcctcctgacaggaaccattacctcattatgaaccaaataacgatatttgctctttaatatgcctcgtataaatctgatcgcactgatcccaggtccaaaaatcttgcctcacccagtacaagtcattccggtaataagccaccacaatcactaccaaaagtctcatatgatgccaccatctgccaaataaccacaaaatcgaatgtgatacataaggaataacgaactttggaaagaactacttaacccaagtagcaatttaaacaaccgaaaaggtgttatgaaccttcctcagaacatgagaaataagacatgcaagaatagatatggggaactgtactcaacatcatattgttacggcgtgcaacccgatccaaataacatacccatagcggcgggccacccaatccaccacacgtgacaataaatagggaagtacccattaagccaaaattcttatacctacgaaatacctgaatgtcaaccacaagcacgccaagtgcacaataccatcagatagtgccataccctacaaaactcaagcacgactaaagagtattaaatgacctgcaacttgagagccatcctgcccatataacatcgcaaactatacgggatctcaatacgagtgcgaatcaaaccgcctcacaacccacatagcacaatagacaccacatggaaaggccaacaacagaaataacatccaaggcccgaagacctcttcgaaaacaatgttatgcttaaatgaacacatccagtctaatattgagcccacattcatatttagatccatctacggacctcaagccgattctgatcgtaccgcactggctaataacctttcaaggatccacaataacctccatgacacaaaagaacagccgtcaaattcgaaacaacttccacagtccacaaccaaatgaaccgagcgcccttcagacataaattctcaaattagcgatagtaccgcaatctccatacttagttctaaatctttaaatcaaacaaatacaatattcccgtggaattcactcccacgaccttccgcatcaggtagcaaagtctgcacatccagaccaccagtcatacagtgttgtaaagcgaatcgaaagtccgcaaatcagtacacaaagcctcttacatatgacatcgatctcagtgatgctaaagacaataccagcttaccctaaacatctgaatccttccctgctagttcgagctcatgacatccttgtcaacaccattctgcaaccttgatcctcaactttcaaatttaatgccgctcaccgtacctatctcaccaacacgcgaaaacacaagaatttaatcataactcatgaaccactaataggatacacacttcatcatatatcaaccttttacttaactcattccaggagaaccattgcaacacgcgactgaatttccataaccgcagaaaataaaatcctcaaatagtggtctaaactaccataactcttctgggacccatctacacaaaacaaaccataatactcgaatgcctccaagtaaattcaattgcggcggccgccaagactcgcatgtaccgccacaaatcatgtgtataacttaacacgctgaaggaattgattattgccactatcattcaaattcaacaattactaaccgatctgacttcttctaatttactctggacttgccttaggagtaataatagctccattcaaattatatcaaactcaatccgcactcgctccgagtgactccatttcacgatcccacattggctcaaaacccacgtaccatctcataccctctttgtgcgcacgtttacatcctcaactggtacacccattgtgataattcctccatgaatccggagtcattgtcttccattcctccaatgttacatcgtagcccaaagataacgtagaacactccaagcctctttcataatctattgcaaaagctcgatacttaaccatactaaggactcaaaatccttaggcaccgcactaaaaattttgaatccacaaagaccgttgttgagagtcactcaccctaacttggtttcgactataatcaactccaaggcccttctagcacatgaacaccctctcaaagaagtacccggctgaagcactttccttgtatatcacctccacacgaagcataaaccctgagtcttctcaaaactaaacatgaaccgattaagcccaagtatagcacacattcctccaatccttcactcgaactaccactgacgtgttctttctttactcataataactcaccaatatgcagataatcagaaacctcaaaagtagataaccatgcaatccaatcgtagacaatgaggctctcccacttagcttgcagctaccattgcataaccctggaacctaccaagattccttcttcttcactgacatgaccttgagcaatcgacccgcccaattcctcgaaatcttcctgttaaccattttatgagcactcctaattactagccacattcataggttcgaccttttattggatagccagtcgaattctttgtggaagattcgtcaacaccacgcagccgttaaccttccaatgacgttgcgctaagtacaattaccgcgaaaccaataaaccatcctgagccagtgctcgttcaccaactgtacaagtctgttcacttatcatgggcatcaactaaaggtgcgacaatacattccaatccaaagccatgttgtatccttttgcatatcaagcaacctctttctgtcgcatccaatctcccgccgtataatagccaatattccaaattaagtccgttgacccagtcactgtccaccataaatcccaaataactctaaactttcctcaaggcatatagtcattctaccacagaagtcatatgctactcttccactttcccactttggtcaaactcactcctttaagcaactactcaactcatgtttctcacacttggccttctagaagtttaaccaccgcgaggcaccttccacatgtccttcctcatccttcgctacccagttgttgccttaaatcaatatctatttccgtagcacttgaaccgatagatcgccatcaactttaaacctttacgtggatcatctttctcgagccatcaacattaggataaccgatttgattctgagccacagcacactgcgacccctaacaaccgctttcccaacaccattcacaatattctgcaccaaaggcgaattgaagaaggccataacaccggcgaacttaacacattccatcaaggatgacattaccacatcatagatgaaaattccaccacgctcgaaaataccaagtcttgttaccctatcgacccaaacctgagcattcgtagtctgattgactttcctccaccggaaataaaatactgaatctctgaatcatgaactgagtaaaacctcctttcaagtcattcacttccccgacacatagacaagcatcccaccattacacaaacactgtgcaatagcaactcacaaatcgtcataataatcgatgccaaatctcaaaaccgttaggtagtactgatactgatctgaaatgataggacgaccttccgcaaggtgacgataatagaccaatcaaatacacagggagaaacatcctgcaccacatctgtagtaccattacaattcctcaatttccctattataacaagcgctccacatcgcataagattgaataggaaagagacaaaggtataagctttaaaggaatcaaatcgcacaatgaggactcaagacaaggaagtgctcctaacagccctgtagcctctcgaggataagtacagatgtcttcgtaccgatccgcaagactatactagacttgctcatgactcgtgagacctacgtgaacctagtgctctgataccatgttgtaacgacgcaaaacccattaaaggtcgtgatggcacctaacaccgttgtcaggcaagccaaccttgactaattaatttaattactcattttagtatttgtgaatcgaaatttcttcaattaaatagtaaagattgaatccatatagtaagtgataaatattttagcaactaaattactaaacaacccataaccactcccaaaacctggtgtcacaagtgcatgagcattaattacggagtaagataaaatacagcatctgtctggaatacaaattagacaggaaaatataaataactctgaaggagactctgctggctacggatcctgatgtaaaatgcaactcacctaagtccccgcatttaaccacacctctaaggccgctagacatatctgtacctgcacaaaaacgtgcagcaagtgtagcctgagtacgtaaataacgtgtacccagtaagtatcaagcctaacctcgaagaagtagtgatgaaaggccgactttggcactcactaagggtcaataatattcaaatagaaatatttaaatcaacatgatttatagaattaacaataattttctttaactagcagaaataattaaattccttcaaatagacaattcccaatttatttaacttcacaagctgtaattaaattatcaaggaatcgtgtaattattattattagccacgatttctaccgaggtcgtacgacccgatccagagtgtcgtgtacatttgccgagggacgtgcgtcgcgatccatagatgcatctatattacttaggcgttcggcccgctccacaatgaaggaggacattttcttatgcacctctggaatgaggatatatatattataagattaatacaagacgctgtttaatttgttttaacaattaaataatttataaacaaattcaagtatatgagattccaatcttttactatcttccctagcacttcacaatatagttcaaatacattaattaaataaagaatacaattaatacgcgtaattcatgatttgagtcctaaactacccggactttagcataaatagtagctacgcactgactctcatcacctcgtgcgtacgtagcccccacaattagcaacaattattaatttaaatcacttatggggtaaaatcccccttacaaggttagacaatagacttaccttgacttgctcaaatttaatccactaataggccttttcctcgattatccaactctgaatggctcgaatctagccaaaataattcgatacaatcaccaaaaaattataggaatcaatttcataagaaaatactacatttttcaataaagatccgaaattaactcaaaaattatccgtggggcccacgtctcggaatccagcaaaaattatgaaatatgaatgcccattcaaacacgagtctacccataccaaaattactaaattccgataataattcgcccctcaaatcctcaaatttatccaagagggttttcaaacttttccaacttaattaaccaattaaataataaaaacagtgatggattcgactaatttaaccaatattgagttaagaacacttaccccgttgttttctccgaaaatctcccaaaggtcacttcaattcgagctccaaatcggtaaaaatggaaaacgggatgaagtcccattttgagaacttaaactctctgcccagtgatttcttctacgcaatcgcgtagcacaaatgtttattgcacaaaaataaccctacgctatcgcgaaccttctcacacgatcgcgaagcattaagtgcgtggcacagctcctccctctgtgcctctccgagaacgcggccttagccacgcgttcgcatagcacaactcgcccaacctacgcgatcgcggatgatcccacgcgaacgcatagaacaaatttccagcttcccaattaagcctacgcgatcgcgaatcttctcacgtgatcgcgtagaaggaaaccacacaccaaattttagcaaactccaaatccaaaaattgatccgttagccgtttgaaactcacccgagttcatcgggacctcaaccaaatacaccaacaagtcctaaaatatcatacgaacgtagtcgaaacctcaaatcacatcaaacaacactagaaccacgaatcatactccaattcaagcttaatgaaacttaaaatttccaacttctacatttgatgccgaaacctatcaaatcaagtccgattgacctcaaattttgcacacaagtcataaatgacataacagagctatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactagatttcaaccctgatatcaaatgttgcactccttgtcaaaccttttaaaaacctttaaatttctaactttcgccaaatgaccccgaaattacctacggacctccaaattaacatccggacgcgctactaagaccagaatcaccatatggagctattcccagactcagaatcccaaacggacatcggtaacattgaaatgcacttaaacccaaatttatgaaattcttccaaaattccaactttccacaataggcatcgaaacgctcccgggtcatccaaaacccgatacgatcatacacccaagttcaaattcatcatacgaacctattgaaaccgtcaaatcccgattctgaggccgtttactaaaaatgttggccaaggtctaactcgctctttttaaagccaactaaggacctaagtgctctgatttcaacccaaacacttctaaatcccgaaccaattatccccacaagtcataaattagtaaaagcacatacagggagtcttatttaggggaacgggtttctaatagtcagaacgaccggttgggtcgttacagtgagatattgttcattcgcaattgtgaaaacaccgttcattcgcaattgtgattcatttattgaaattacgtaaacactgttcatttgcaatatccgaaagtgattatatttcatgaatctattgttatattcatcgtttaattagagttttaatggaggaaattgggatttttgtaaaacttttcaaaaatgaaaatttaagatttggaggacgatttgttattggaattcgataaaattggtatggttgaacccgtatcggaatgggtgttcgaatttcataaacattatgtcgggttctgagaggcgggcccgnnnnnnnnnnnnnnnnnnnnnnnnnnnnnnnnnnnnnnnnnnnnnnnnnnnnnnnnnnnnnncattgacttttggttgacattttagaataaaattttaagtcgacgttttattaaccaaaattatttccgattaattttaatgaagttatacaattaatttggatagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagttgttcggaggtcaattcaagcaagaaggtgattttggaatatcagcataacttcaaaaaggtaagtatcttgcctaaccttgtgcaacgacccagacagtcgtttagagagtaatagcccagatcccctatttactgcttctcccatatcaatttctactattgtgacttgcgtgagggttccttttagtttttagagtgttttgggacacttagtccctaaaacgagagcttaagtctttggattttgaccgtggttgggaactatatgaagacaacttcgaaatagagttccgtgctccgttaggtgattttggacttaggggcgtgtccggattgtattttggaggttcgtagcttatttagccttgaattggcaaaaatcaaatttttagaattttggaccggtagtgaaatttttgatatcgggatcggaatccaattccggaagttggagtaggtctgaaatgttgaatatgacttgtgtgcaaaatttagggtaaattggatgtggattgatagattacggcatcggttgtggaaatttgaagtttcaagttctttaagtttgaatcggaggatgatttataattttagcattgtttgatgtggtttgagggctcgactaagctcgtatggtgttttaggattggttggtatgtttggtcgaggtcccgggggcctcgagtgagtttcgggtgcttaacagattgagtttgggacttatgcaattgttagagctgttgcacctggtgtaattgcacctgcgcattttgggccacaggtttggcactgcagaagccgccatagagccgtagaagcagttttcaccctgtctagctgggaccgcaggtgcgaccatagatccgcaaaagcggacgtgtagaagcggaaaaaaagcgcagatgcgggctcgcagaagcgacccttgttcgcgaatgcggactcagtcccccttaagtgatttttgcacctgcgatgcaatttccgcaggtgcagtaccgcaggtgcagttgaaggctcgcgggtgcgagatgtctggacagaacacttaaatacaagtgttcgcgattttttctcattttcaaaaattttgagcttgggtttggcaatttcttgagagaatttacaggggtttcttgaggtaagtcccttatgcttatttttgatcgataatcttgcttccccatatattttcccacctagttagtgtgtatttaaggtggaaattgggaatttgaggctaggggtttggaagtttgatttttggatttggaggaccatttggtgtcggattttagtaaatttgatatggttagactcgtgagtgaacgggctttcgtattttatgacttttacccgattccaagacataggacccactggagagttttgagttaatttaggaattttcgttaaagtgttgatttccttaattagatgagcctatattgttgtactaatgatatgtaattgcttttggctagatttgcgtcatttggagccggatattcgtgggaaaggcattgtgaccgattgattgagcttggttcgaggtatgtggcttgcctaactttgtgtgggggtaatccccttaagatttggaactattgtgatttgtaagcgccgtgtacgtgaggtgacgagtacgtacacatgctagttgtggtaaaacccgattttcttcctgagcagcagcatgttatccttttattttgagttataccattttaatgagcattaatctattttcattcttaattgagtgattccaatatgtgtagctatcctttttagtctaatacaacatgtctacgtgtcttaattgtttatgtgaattctgtgcagcatgcttagtgaatttcctacttcttccttgactagtacttagtctaaatcgtaatatttcgtgatgtaattgtatttctattatttgcggtgcatatttactttgggactacggaacggtatttcgggagatccctctgtactgcatatttactttgggactacggaacggtattccgggagatccccctgtactgcatatttactttgggactacagaacgatatttcggaaaatcccccagtactgcatatttactttgggactacagaacggtattctgggagatccccgtgcacttcatatttactttgggactacggaacggtattccgggagatccccctgtactgcatatttactttgggactacagaacgatatttcggaaaatcccccagtactgcatatttactttgggactacagaacggtattctgggagatccccgtgcacttcatatttactttgggactacggaacggtattccgggagatccccctgtactgcatatttactttgggactacagaacgatatttcggaaaatcccccagtactgcatatttactttgggactacagaacggtattctgggagatccccgtgcacttcatatttactttgggactacggaacggtattccgggagatccccctgtactgcatatttactttgggactacagaacggtattctgggagatccccctgcactgcatatttactttgggactacggaacggtatttcgggagatccctctgtactgcatatttactttgggactacggaacggtattccgggagatccccctgtactgcatatttactttgggactacagaacgatatttcggaaaatcccccagtactgcatatttactttgggactacagaacggtattctgggagatccccctgcacttcatatttactttgggactacggaacggtattccgggagatccccctgtcttgcctatttactttgggactacggaacggaattctgagagatcctcctgcacacttacgttgggactacgagacggtatctcgggagatcccttgttgtgtttctatgtactgagttgttaccttatatgatttcattattgttaaatttcagcctttattttattatagtatttcactctatattattttattatatatttaccactagggccctgacctaaacgcgtcactactcgaccgaggttaggcttgacacttattgagtaccaattgtggtgtactcatgctactctctacacatgtttttcgtgtgtagatccaggtgcaccttatcagctgcactatcagtgagccgggacagctttggagacttcaaggtatatctgccgcatccacagacctcagagtccccttccactctttctaatgtccattatcttctgtatatttccttgttagactctaatgtatagagacactagatgtttccttatgtagtttgtgattcacgatgttccgatttttgggattactgtgtatttttgaatagttggtcaaacttatatttttatttcattattttgcaaaaatgttaggcttacctagttgtagagactaggtgccgtcacgacttcacatagagggaaatttgggttgtgacaagttggtatcagagcactacgttcataggttacgtgagtcacaagccggtttattagagtctcgtggatcggtatggagacgtatgtacttatctccgggaggctatggaactgttaggaaaatttcattactttgattccttgtcgtgcgataattgttgacttcaaagattctaaacttctgtattctattctctcacagatggtgaggatacgtacaaacagatccgatgaccaggcacctgcaccccctgctagagccgcgagaggctggggctgaggtaaaggccgatgacgtccatgtggtgcagccagagcacccgcacgagctgctacagaggagcccccagtagctctagttggagggcagacacctgaggtacctgtttctgcaccagccctccaggagactgtagcacagtttcagagcatgttcagcatcttacctcaggctagattgattccacttgctcctgccacatctcaggccgggggaggagcacagactcctatttctggtactctagagcagcgggttcaggtcgaccaggttctagagattgtaccaatgcagctgacagctccagctcagcccgaggttagggcagcaacttctgaggtggagcagctcaggcttgagaggtacaagaagtaccacccacctaccttcaacgtattggccatagatgatgctcagtgttttctagaagagtagtccggctgaggcagcttcacttacattgactcagttctcgggcatgtttttgagagagtatgtccctcagagcctcagggactcatggcgcgcgtagtttgagcagttgtgccagggtgctataactatgtcagagtatgcagtttacttcagtgatttggcccgacatgcaccggccttagttgccacagttcgagagagggttcgacggttctatcccaacatccggagtagtatggccagagaattggagatgtatatttcttatcagcaggttgtgagtattaccaggataattgagggcatatttgtccgggatagagaggagaaggaggccaagaggtctcgagaggttggttattattctggagctcgtgccccaacagatcgccatggtaggggttatgtgagccgacccgttcattcagctcttctagccgcgagcggtgttccagctcctcctagaccccaagagccttattatgcactaccagtatctagtgtgcctcatgcacgagatgttcctagtggccagtccattagacctggcccgagccagtcacagtagccacgccctcccagaacttgttttgagtgtgacgacactctccatgtggtgagggattgccccaggattatgaggggtgcacctccacagacttctcagccacaacgtgctccaccgggtcctcaggctatgattacagcacgagctgccaccccacctactcagccagctcgaggtggaggtcggggaggtagaggtcaccctagagggggaggccagtccagatataatgcatttcctgcttgtacagaggcaattgcttctaattctgtcattacaggtattcttccggtctgtcatagagatgcatcggtattatttgacccgggctctacatattcttatgtgtcctcttattttgccccgtatttgggcgtatcttgggattccttgagttcccctatttatgtgtctactcctgtgggagattctcttgttgtggaccatgtgtatcagtcgtgtttgattgctcttagtggttttgagaccagagctgatttattgttgctcagcatggtggactttgatattattttgggcatagactggttgttgctacattatgctattcttgattgtcacgctaagaccgtgacactggctatgccaagtttaccgtgattagcgtggagaggtagcttagagtatactcccatcagagttatttcttttcttaaagctcaacaaatggttgagaaggggggtgacgcgtatctagcttatgagagatgtcagtgttgatacccctacagttgagtcagtactagtagtgagggactttccagatatgtttccatctgatcttccaggcatgctgcccgatagagatattgattttggcattgatttgttgtcgggcactcagctcatctctattcctccatatcgcatggctcctcctgagttaaaggagttgaaggagcagttacaggaatttcttgataagggttattcggcctagtgtgtcaccttggggtgctcctgccttatttgtgaagaagaaggatggttctacgcggatgtgtattgattaccaccagttgaacaaagtcacagtgaagaacatgtatccattgcctcgtattgttgacttatttgatcagttacagggtgccaacgtgtttttcaagattgacttacattcaggatatcatcagttgaagattcgggagcttgatatcccgaagacggctttcaggaacagatatggtcattatgagtttcttgttatgtcttttgggctgaccaatgcccccacagcgtttatgcacttgatgcatagtatattccggccttatcttgactcattcatcattgtgttcattggcaacattctggtatacttctggagtcgggaagatcatgagcatcacctgaggactacgcttcaggccttaagagaaaagaagttatatgcaaaattttcaaagtgtgagttttggctagacatagtgacattcttgggtcatatagtatcgagtaaggggatccagatgcatccaaagaagattgaatcagtgcaaagttggcccagaccatcctctgctacagagatatagagttttcttggtttagcggggtattaccatcgctttgtagagggattctcatctattgcagcacctatgaccaagctgacccacaagggtgctccgttcaggtggacagaggaatgtgaggagagctttcataagctcaagacagctttgactacagccccagtattggtattacctacaggttcggggtcttatactgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggattgttctcggagcggtgttgatgcaggacaatagggtgattgcctactcatccagataactgaaggtgcacgaaaatgactatcatgtccacggccatgagttagcagcaattgttcatgccttgaagatatggcgacattatttgtacggtgttgcttgtgagatttacaccgatcatcggagtttgcagcatctatttaagtagaaagatcttaacttacgtcagcggaggtggttggagctgcttaaggattatgatatcactattttgtaccaccctgggaaggccaatgtggtggccgatgctttgagtcgccgggcagagagtttggggagtttagcatatctaccaacagcagagaggccattggcgttggatgttcaggccttagccagccagtttgtgagattagatatttctgagccgagtcgagtattggcttgtgtggtctctcggtgtcacatctcttttcccccaaattagctcttattgggaggttgagttagaagaatttttccaattaaagtgacgttttgaaaagggattatttattattcagagtcgccacttggaattgagttttggtgttccaagtcacctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttaattgtttggacccagatgcgatacgcacacaaggtatttctttgaagttagatattaaaccaaaggtacacgaatgtacacatggttaaaacataattatttttaaatttaaaagtatcaagacgcgaaaatgtacacatgatccttttattatttaagcatatcaatccaaggttcgggtatgaacacatggcctatatttaaagtgcggttaaagcttttataacgcatttatgagttatcttaatttttgaattaaatgtaaggccatgagttatggaatatgaagttgttggaagtcaagaaatattttaacttttggagtatgtacgtcattattcaatatgaaagaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctagcttatgtttaatttatttaaggaagtctgcctagcagaatatttttggggccaaattctctttaccttccttttcagttttcaaaagttcagcagcccattgctcaattaaattatgcccaaaacccatgaccaatctgtataccttaactaatgatccactttaacttgcgggataaaacaatagcttacttgctatcatcagtttaggcctaatcgttattttatcactaactattattgataaataatgattgaataaaaatcggactcataacagataaaacatatacaaataaaataagatcaaatattaactaagaagaaatatactgagatggagttaaagcatgacatataggaacaaaagagctaagaacaaacatatagccaaaggaatattccattcaatcttagccttcaagtttacataaagcaccaaatactaatttattaacatatgatgaatcaaattaagaaaaaataaattttaacatcaacagnnnnnnnnnnnnnnnnnnnnnnnnnnnnnnnnnnnnnnnnnnnnnnnnnnnnnnnnnnnnnnnnnnnnnnnnnnnnnnaaaagataaaataaattcattcacataaataataaacaacgacacactaaagaaagaaagagttagcgagggacctttaatgtaataaacttcttcactgtgttaagaaataatctccaaatgttgggttacagagaacgaacggtaaccaagcttgaaagcaaataggattacaaaaccagagacccgaccggcaannnnnnnnnnnnnnnnnnnnnnnnnnnnnnnnnnnnnnnnnnnnnnnnnnnnnnnnnnnnnnnnnnnnnnnnnnnnnnnnnnnnacgtgggtggtcttatacagttgaaacgaagctatgctcttcctcgaatatggtgcgacgacgactattttttggggtggtttggtgctgcgttgcagctactttttggagctggattttgctgattttgagaggtgttcggatggttaaaggctggtgaagtttggtggtttgcatggtgttttatggactgttttaggatgagtttcgtggttctttcatggctgaaaaagggtgagaagctgctgttctttttaggaagaaggagcagctgcgtttttgttcttaaaggaagaaactgatgcacagcttttgggtcctatcgctctaggattttcttcttttttttgttttctaaaaatgttcccccctttttgttcttcttcctcgtcccttttataaagaataacaatggtagttatcaagtcttgtgccaaagagttaaaatgaggacgtgggattgaggttcaaaagggaattgagacgtgaggtgtgtgctggagtagattgacgtgaaggggaagggaaataggaagttagttatcattttttatcttttgtgagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatagaggtgtatatgagagtcatggggtgaatggaatctcttttaagctttttcttctttctctttttatttttgtttccttttagaattaaaattcaattaaaatatttagacaaaaatattaattaactaactcttattaacaacaaaaaagatatatatacctcagcttattcaaattctaattaaaagaaaccatttatttttgtaaattttctttctctttacaaatagaaataaaatttttactatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatataggtgtggtgaaaaattagttgttaacactcggtcttctctttatgatcgtatcacggagcttcctcaaggaaacggtccagcacactgatgttaaggaggtcactattggagatgatggtgcattgaggatgcagggcacactctgtgtgcccaatgtagatggtttgcgtgagttgattctctaggaggctcacagtttgcggtactctattcatccgggtaccgcaaagaagtatcaggacttgaaacatcattacgggtggaggaggatgaagaatgacatagtagagtaagtggctcgatgtctgaattgccagcaggtaaaatataagcatcaacgatcaggtgtattgcttcagaagttagagattccggagtggacatgggagctgattagtatggatttcgttgttggactcccactgactcagcagaggtttgatgcagtatgggtgattgtggataggctgagcaagtagtctcatttcattcctgtgatgactacctattcttccgagcagctagctcgaatctacatccgtgagatcgtcaggcttcatggcgttccagtatctattatctctgaccggggtacgcagtttacatcacggttctggagagctgtacaacattagttggtcactcggattgagttgagcatagcatttcaccctcagacggtcgggcagtccgagcgcactattcagatattagaggatatgctccgtccgtatgatagattttggagatgcttgggaccagttcttgccatttgcggagtttgcttccaacaacacttatcagtccagcattcagatggcaccatatgaggctctgtatggtaagcggtgtcggtccccagtaggttggttcgagcccggcgaggccagattattgggtacagacttggtttaggatgccttggaaaaggtgaatgtgattcagtatagggcgttatgaggtttggaaagaagggcaagctgagcccaaggttcattggtccatttgaggtgttgcgtcaagttggggaggttgcttatgagcttgccttgcctcccagtctagcaggagttcattcggtattccatgtttctatgctccggaagtatcacgacgatccatctcttgtgttggattttagctcagtccagttggacaaagatctatcttatgttgaggagccagtggttattttagacagacaggtcagaaacctaagatcaaagaacatttcttccgtgaaggttcattggaggggacaaccggtcgagaaggcgacttgggagaccgagcatgttatgtgcagccgttaccctcaccttttcaccacttcaggtatgtctttatactcgttcgaggacgaatgattatttttagaggggaaggatgtaacgacccggctgatcgtttagagagtaatagccccgatcccctatttactgcttctctcatatctatttctgctattgtgactttccgggagtgttccttttagtttttagagtgttttgggacacttagtccctaaaacgagagcttaagtcttaggattttgaccgtggttgggaactatgtgaagacaactccggaatagagttatgtcggttctgttagctccattagatgattttggacttaggggcgtgtccggattatgttttggaggttcgtagcttatttagccttgaattggcaaaaatcgaatttttagagttttggaccggtagtgaaatttttgatatcgggattgaaatccaattccggaagttggactaggtccgaaatgttgaatatgacttgtgtgcaaaatttgggctaaattggacgtggattgatagatttcggcatcggttgtgaaaatttaaagtttcaagttctttaagtttgaatcggaggatgatttataattttagcattgtttgatgtggtttgagggctcgactaagctcgtatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacgtacacggaagatttggaactattgtgatatgtgagcgtcgtgtacgtgaggtgacgagtacgtacacgggctagttgtggtaaaatccaattttcttactaagcagcaatatgttatccttttattttgagttataccattttaatgagtattaacctattttcattcttaattgagtgattccaatatgtgtagctttcctgtttagtctaatacaatatgtctacgtatcttaattgtttatgtgaattatgtgcagcatgcttagtgaatttcctgcttcttccttgactggtacttagtctaaatcataatatttcgtgatgtagttgtacttctattgtttgcggtacgtatttactttgggactatggaacggtattccgggagattcccctgtactgcatatttactttgggactatggaaaggtattccgggagatccccctgtactgcatatttactttgggactacggaacggtattctaggagatcccccaatactgcatatttactttgggactacggaatagtattctgggagatccccctgtacttcatatttactttgggactacggaacggtattccgggagatccctctgttttgcatatttactttgggactacggaacgatactccgcgagatccccctgcacatttacgttgggactacgagacggtatctcggaagatcccatgttgtgtttctgggtactgagctgttaccttctatgatttcattgttgttaaatttcagcctttattttattgcggtattttactttatattgttttattatatatttattagtagggccctgacctgacctcgtcactactcgacagaggttaggattggcacttactcggtaccgattgtggtgtactcatgctactttctgtacatattttccgtgtgcagatccaggtgcaccttatcagccgcactatcagtgagccaggacaactttggagacttcaaggtatatctgccacgtccgcagagctcggagtccccttccactctttctcatgtccattatcttctgtatttttccttgttagattctgatgtatagagacactagatttttccttctgtagtttgtgattcacgatgttccgggttttgggatttgttgtgtatttttgaatagtttcttaaacttatatttttatttcattattctgcaaaaatgttaggcttacctagttgtagagactaggtgccttcacgacgtcacacggagggaaaattgggtcgtgacagcttgagtgggggaattacccctagccatcgagtcatatgtgccatttgtgaaatgtaaaaaaaagtcgtgtacgagaggtgacgagtacgtactcgggcttatatgtgcaaatcttattggtttaaagtcttaagcattttatgtagtaaaatggataattgttggntgggggcctcgggtgagtttcaagtgtttaacggattgagtttgggacttatgcaattgttggagctgttgcacctggtgtaatcgcacatgcgctctttgggccgcaggtgcggcaccgcagaagcggccatggagccgaagaaatgattttgaccctgtccagttgggaccgcaggtgcggccaaagatccgcagaagcggaagagaagcacagatgcggtctcgcagaagcggcccttgttcgcagatgcggacttagtcccccttaagtgatacttgcacctgcgatggaattttcgcaggtgcggttgaaggctcgcaggtgcgagatatctggacagaacacttaaatgcatgtgttcgcgatttttgcttattttcaacattttgagctcgggtttggcgatttcttgagagcatttataggggtttcgtaagtaagtcccttgtgcttatttttgatcaataatcttgcttccccatgtattttcccacctagttagtgtgtatttaaggtgaaagttgggaatttaaggctaggggtttggaagtttgatgtttggatttggaggaccatttggtgtcggattttagtaaatttgatatggttagactcttgagtgaataggctttcgtattttggacttttacccgattccgagacataagccccacttgcgattattgagttaatttaggaatttttgttaaagtgttgatttcgttaattagatcagcctatattgttgtatttatgatatgtaattgcttttggctagatttgggccattcggagctggatattcgtgggaaaggcattgtgaccgattaattgagcttggtttgaggtaagtggcttgcctaactttgtgtgggggaaatccccttaagatttggaactattgtgatatgtgagcgtcgtgtacgtgaggtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctatctgtagtgcctcaatccttgttgtcgaatttgtttttatatgatgatttggtgtgattgccaccttgattgttatataaatcccgtgtttttgttgagttgatattttctggagataatttcattatggattattcatttgcaaataatttatttaataattttaaaaggaggaaaagtgttaaatattgaaatattattctgttgagtggttcactcctggatatttttattaagattttgtgcacattatggtcgagccatgggctccttattgtggaaaataatgtgttgttgatttatgtggcaagttgtaatatttaatcacttgtggtgcaatttatgagatgtcgtgatattgttgggacgtttgttcgggagtttgcacgaggcttatgtcgtcctattgttactattgatatatgcacatgcggcgtgacaaggtgggctatatatatatttgtgggtttgcgcatgtggcgagacaaggtgggaatattattatgcgcgtgcggcgagataaggcggaatttactttattattgcgcacatggcgagacaaggtgggctatgttggggatgatttgtaatgacttgtgatggtctgggggcgctgttgttgaaatttatttatgatttgggactaagaggcggtacctcggaagtgcccttttgttgaaatttctctatggctacacttgcctttggttatttaattttatttttccgtaatatgtaaattcttgtgttctccgtaatgtattatttgacttaatattaagtgttttgtatttattgtagtattatgttgactttggctttttcttacgagactctgaggatttgtatttctggtttgtacgtgtccttaatgattgagttattttaaataaaagaattattattatgttttaatttaatgagtttcatattcaaatcagtagcttatctgatgctttattttaactgaaatgtcactttccccactcaaactatttcaaaatttaattcatttctttgttgaatcttacttggtttaaaaattgtaaccttaatttattcaaaataaattgatcgtgcaaattttatgtattgatatatttggcgcgagagttgtccgtctggttgtgatagagatatgggcacgaggtgccgtgagaatatgaaagggggctgagacccgtattttatgatttttacataaagactattcaaaataaattgatcgtgcaaatttgatgtattgatatatttggcacgagagttgtccgtctggttgtgatagagatatgggcatgaggtgccgtgagaatatgaaagggggctgagacccgtattttatgatttttacataaagattatttattcgaagaaatatattcgtagggtatttattcgaaagaattatatgtgaaggatttatatttgaaggacttgtttaattggttgtacttgtgtttcttatcgtctgagtaataattatggtgttgttgctgccttgctgtttatatcactagttggttattgttgctatcactgctatttgttccctattattttgtatgctatattgcacaagttatttgactagtgagtgtcttgactgtacctcgtcactactccaccgaggttagtcttgatacttactgggtaccgactgtggtgcactcatactacacttctgcacatttttgtgcagagccaggtaaattggagtcagctgatcgctagctagctgtacatatcttgttgtggagatcatggtaaacatgttgctgcgctcgcaggcttccgagtcaccttccgatattgttcttgcactattttatttctacttaaaaatagttgtatttataggttttctagtaactcaatagagcttatgacttgtactaccggttttgggattgtaagtattgtatagagatttctacttcgcatttgtcagttgttaattaatattgttattatttcagtaaatgttaggcttacctagtccttaagactatgtgccatcacggcatcttatggagggagatctgggtcgtgacaatcgcatatttatctcgttaaaacttgattgaatgtcttattttgtataattacaatattttatcagatctaatatacttctaaactaaactcaattgatattctatttgtacaacccctcaacagttttaccttatttaaatcctaaattggcttaatgactcatttgatgcttcactgtatttaatttgtaaattgtatttaattttgtttaaattattcattgctcatcctgattgatattgatacagaaactatacacatggtagcacgaggtttttgtcgtgcaaaagtgattcagaaagatgtgggcacaagatgccatatgtgtaagaattggaagtcgtgaatcatgaattgagatttcgaggagttatacctcgggtaatttatgttgaaatacatgcattataaataatttaattgattgatttctcatatgattccttgcttggacctactcatatattatttgatctctgactatgtggttgcttaatcacttgattgttttctcgttgctacccgtattttcattgttttcattgttgatttgagtgagaaattcttctgttattggccttacattgttatccttttcttgttagctttatgtaaaattttgtacaggtttatatgtctggtaggtatcttgacatggcctcgtcactactctaccgaggttaggcttgatacttactgggtaccgtcgtggtatactcatgctacacttttgcacatctttttgtgcagatccaggtacctcaatgttgttgataatcttgctaattgattggacattgttgtggagacttaaggtatacccgttgtcgcgttcgcaggcctcagagtcaccttttgatattttcctgccctgttgattctattctggaacatttgtatttagagattttttctagtaatgtcacgacccaattttccctctgtatgacgtcgtgacgacacctagtctctacgactaggtaagcctaatatttttcggaataatgaaatgaaaacataaatttaacaacaaactatggcaacgacaacataactgggtaccatgccgcttggtatgtacaagaaccgtctattcaaaaatacacagaaatcctaaaacccggaacatcgtgaatcaaaaactacagatgaaaaatatagtgtctctatacatcaaagtctatcaaatgaaaatacagaagataatggacatggcgaagagtagaaggggactccgaggtctgcggacgtggaagatataccctgaagtctccaaagctttcccggctcactaataatgtggctgataaggagcacctggatctgcacacgaaaaacatgtgcagagagtagcatgagtacaccacaatcggtacccagtaagtgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaacctcgatcgagtactgacgtggtcaggtcggtccctactggtatatatatataatgacacaagatagaatgaaataccgcagtaaaataaatactaaacttaataagaatgaaatcatagaagacaacaactcagtacacagagataataataggggttttcccgagataccgtctcgtagtcccaaacgtaaatgtttagtacaggggatctcgtggaataccgttctgtagtcccaaagtaaatatgcagtacatggggatctcccaaaataccgttctgtagtcccaaagtaaatatgcagtacagggggatcttccggaataccgttccatagtcccaaagtaaatatgcagctcaaccaacggaaataacagttatagcaagaaaccctacaattgagactaagttcaagttaaggaacaacaggaaacttcactaaaacatgctgcacggagttcagataaacagttaaggcaagtaggcatgctattttagtctaacaagatactacacatgttgataagactgaaacaacatgttgattttttagtagaaatcaggttttataggaattagcccgtgtacgtactcgtcacctcacgtacccggcgctcacatatcaaaacagtaccaaatcttaaggggagtttcccaaatactcatcacgctcagatttcgctatacagctcgaatagaaccgcaccatctgtgcacataaccaatgaatcacaactcctcgtagaataaatgagtaactcacagatcatttcagaacacgaaaaagatcaacatcaaccgaatggtacatccctcaataatagtagtatggagccaatcattccggctcagtgtagaatacagatcttgattgggcctaccaatggacccccaaattaactctggtcaaccacaataaataaataacccttcgaaattcacgatgacagagtcataatatataccattatctggctagcttcagccatgatttcacagtccgcaaccatgaaagaatctgttccaaatccatagaacacacgaatcaacatttctgattccatctccatcacccgaatgtctaacacatctctcatacacaatcatcccaccaggaatatttctcccattctttcttgccacatagcaacatcttaaaatgagcagtcgatcaaccaggaaaatgccgcaatacctaaaagaaatatccataattcaaagcatagtgcgccttctgaaatgtataaactactcacgcaataccaaatagtgatagcattcatctaaacattgaagactgttcatcccctcaaagaatttacgacctccctttcaaagcaaaactgtgaccttgcacacgccatccttaatcccgcacaacacaccgcatttatcatgccatcatttgaaaaatacgagaacctcataatcattctgagtcacaagtaaaatatatatctgatcagccagaagccttccatttgatcccacccgataaaaaaataacaatactcaacatgctccttaggccggtaggaaaatacccatcccaaaccgtggtagaaaacctcgagaatgctttggaatccacttgcacataatcacgccatcatagttgaatctatctaaatcaaccaagctacgcaagtccccaaacccaagaatattgccaccaaaacatctgtaaagtcttaccacatcgtaattatccaaaggaccaatcctaccattaccatactggtccagtctactacctagttgtcctatttctccgagtcccttacgaatttgtcttcaaattgatacttctccttgctaaaacaccacgatccttaaccacaactcaccccacgaaccctagcatagaaccacaacaccctacggcccttaagaaactatattcttcttaagcacttccataaataccacaattgtaacactcactctgaaaataccttatgtgaatttaaaattcttcttcttatcttccttatacaaaaatatagaatccatagtcatgcaaaatttctgaaagtccatgcaccatcaaataaaaatctcagattttatccatacgcaagtccggaaacattctcaattgctatatataattcccaaacacactagaattttctcgggagtcacccactttgctcaaatcaaaattacaccgcccaaatgggccaaaagacatgtgccccattagcacaacaacactcaaagaagtaactctactttaacaccacctatcaaattcatactccgtgcaaactacatcattcacaaataacaactcactcatcccacgatttttcatatactcatccgtgcaatataatctgtaaccaggatattttcttattcgagtcattttcgaactccacctctgtaagtcatcattgattcccaagtatacttcagacgcaaacaaaatttgacacatatccatgaattgatttgtctatagcaggctccaccacttggctcaaagccgtagattaaaacaattcataacttaccatactcatactctattattgtcatgatgctacagtcagttcaacaaaacctcttcacaaactcatgcaacgccaaccatagaaataccccaaatcatccgctaaactcgcaaccattctcttgacactcaagtcaactttcttagccagattcatattcaaatctccacccatacgccccatcggtagaaaagaaactctctactcacatcataaggaatgcacctacgtagattactccgcaggggatagcccacctgcttagccttaaactggtatcttgttataccctttcgcagtaataattactatgaaatcacttagtctatctgagtccaaacttattaaccagaaatgagagtttaatttgtcccaaaatttaacaatgtgaaagatccttcgaaatattcatactcgagactatacgtcacatcaaatcgaaaatcaagcacccaatggacttcctttaaatttcaaggaaacacttctcgtcatattccaatcgtcttaacatatctcgcggtcacatcatacccatcataccgccattctaccgctcatcgagccataaattccactatagggtcattaccagacatataagtctaattgcatgagttacaactgaagctaccgagcttaagctgcgatctaaacctggcctcaagtcctccagactggcccatcaccaaaacacataatacacatctcaaacctcattcatagaatcacaagccggcgatgcacaactgatactgagtgctcatgtgcgcatacaaataagtggaaggaatgcaacgagttatgtctcaagctgaatcaatctcgcatgataaagaaagaaagatgggaagtatatatcctaaatgccctgtagcctctcgaagataagtatggacgtcatcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataccaccttatcacgacccaaaatccaactaatcgtaatagcacctaacccaacccgttaggtaagtcaattaccaactatccaattccaaaaataattattaaagcaatttaagtgaataaaggtcttaatcttatacaatccccaagaaccggtagtgcaaatcatgagcttctaagaatagagtttacaaagcgaaaatgaaataaatacatagtctgtttgaataatatataaatagagcttttataaaatctaaggctaccatgaacaagaggcagctataacaggaacgcaggtacatcttcaaatacggcaaccatcgagcacagtaacaacaacagccaatatctgcatgtaatgtgcagaagtgtagtatcagtacaaccgaccccatgtactgagtaagtaacaaacctagccttaggttgaaagtagtgacgagcttcaccaaggtcgggtccaaaaccaatagtccacaacagtccataacaacataaagcaaataataccataagtaactcaagatatagatgctcggcaaaatcatgatttcaaaataatagttcttcctttcaagtacatctgtgaaaacccaaatcgtttaccaaagttgccgaaaatatgaataagtttgaaaacaaaaaaattttcaaaaatcctttcaacaataaatgagatgtttcattttccttctagataacccgtgtaaaaacaaatgcatcactatgcccatctgtcaaaaatgtgtgaaaatcatgaatgatgtgatggagtacaccatgaggaaaatacatctctatgcttgtatgtcatgtgtgcatgccaatgcgatgcaactaaatggtaaaatcataaacagcccctcgggcagacctcacaatcactcgtatacaacccctcaggcttacctcataatcactcgtaaacaacctctcgggcatacctcactatcactagtaaatagcccctcgggcatacctcaccatctctcatgcctcacagtcactcagcactcggcactcggcattcgcactcagtaggtacctgcgctcaccgggggtgtgcacagactccggagaggctcctacagcccaagcgctataatctgcatggacaactcatgtgctgcacagacaactcacgtgctataatatcatatcagaattcgcattgacaactcacatgccataataacccaataaggcctactgcaggctggcagccccgatccatataatagtgataatatatataaagccaatatggcctgctgcagcgtgcagcccgatcccaaaaatatccttacaatcaggccctcgcccttcctcagtcatcaatctctccagtctctctctcatgggctcacaatgtcatgagaatagcccaaaaattatgatatgatgtattaataaataacagagactaagatatgatatgtaatgaaatgaatatgactgagtatgaattttcaatttaaaacaaataattcacagtaatataacctttgtaggtcccaaaaatactggcacatagcctcaacatgatttttaatatgattcttagctcaatttctttaacacataaaactgcatggaaaatgccaagattatttgactataaaattccacgaaacaattacgtcacaatttctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacccacacgcccgtcacctagcatgtgcgccacctctaaacaattcacataatacgtatatttagggttcataccctcagcttcaagattagaagaattacttactttgaacaagccaaatccaatgccgagcaagctaaacaatgctctagaaatcccattatgcgcgtatcaacttccgaacggctcgaatctagtcacatttaatttgattcagtccacacaacttataggaattaattcaatatcaaaatattaatattttccacaaaaattagaaattacgccccaaacatcacccgtggggtccatgtctcgaaatacatgaaactcaaaaaatacaacaacccatcccattacaagttcaaccatactaatttcactcaattccgacttcaaatcgatgttcaaaactcaaaagaaaatatattatgaacatttagtccaacaccccaaattttctctttaaatttatcaactaatttctaaaaatgaagatagattcatggaatattatcacaaggaagttaagaacacttaccctaaattgtgtggaaaaattcctctccaaagtcgcccaaacagagctccaaaatgagaaacaatctcggaaccatcgtttttaacactgcccaggcatttccgcacctgcgatgcctgggctcgcacctatgcatctgcttttgcggacaaaaatgcacgcctgcgaaaacagccggcgttcaaaaatctcgcatctgtggcacccttctcgcatctgcggacacgcagatgcgcattaaccttcgcagatgcggcctcgcagatgcgggcaaattctcgcacctgcgagcactgcccagttccactcttagtcgcttctgtgactgatctcgcgcacgtgcggcttcgcacctacaatcaaaagctttgcatgtgcgatcacaccagtaggcagcagttccagcatttccttaagtccaaatttgatccgttaaccatccgaaaatcactcgaggcctccgggacctcaaccaaatacaccaccaagtcctaaaacacaccacggacctacttgaggcctcaaatcacatcaaacaacctcaaaaatacgaaatacacatggattcaagcctaataaattttgaaatttccaaattctacaaacgatgccgaaacctatcaaatcacgtccgattgacctcaaattttgcaaacaagtcgcatttcacattacggacctattcaaatttccagaatcggattctgaccccgatatcaaaaagtcaaccccccggtcattcccaaaatttaactttcgacaattgaagcctagttccactaagtacctccaaataagtttccgaccaaaatcaccatacggagctattggaatcatcaaaactctatttctgggttgtttacacataagtcgacatccggtcactattttaaacttaagctttaaaccttggaactaagtgttctaattcattccaaaacctcaccagacccgaaccatttactccggcaattcacacaacaactgtaaaagtacaatttgaatagtaaatggggaaacggggttgtaatactcaaaatgaccaaccgggtcgttacacggagctggtttgatgtgattcacatgtccagttgttaaaatagaagttctaaagttttattgaaaatttcatttgatttggagtttgattcgtagttctaggcattatttcggtgttttgatcgctcacacaagttcgtatgatgtttttggacttgtgtgcatatttggtttggagccccgatgtcacgacccaaaatccgaacctgtcgtgatatgcctatctcaatactaggcaagccgattacctcaataaacaacaatttcttctaagtttgaaaatataatatttaaacacaatctaaaaatcttgcaaataatgatacaaacactcacaaaacctggtgtcactgagtacatgagcatctatacattacaattctggaaaacacggtatataataacatgagaccaaatacaataaacaaaaggatagggaaggagagacaaggtttgcgaaacatgatagctatctctaaatctccgaaaaatcgactgtgtccgagatcacctgtatctgcacacgaagtgcatggtgtagtatgagtacaaccaactcagtaagtaacaataatatataaggaactgaaagtagtgacgagtttctcagctaagtctaaatacaatactttccaacataaaaaggtaggcatgctttcaagttcaacatttaaaactccacagtaattttataacaacttcgaatgaaacagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgataaatgacagctgaaatgcagcaataatgaaatcattgcatcctctcatagtaacattcactcagttctcccattcactccagccttacagtcaatctttcctcacagtcactcatgcaggagcggagctgggctggcctgggcagggtgcaggtgtgagggagttaaccgcatctgcgagcctgcaggtgcgagcgaggctctgcagatgcggagttgaggaagaggcatgttctgcaagtgcgagtgatggagcgcaaaagcggttccgtaggtgcggttagggggtcgcaggtgcaaaaatcctagacagaatgctaaaaatcgaggagtccgagattttgtcatttttgatatttccaaaagcgggtgaggcgagttttgagcgataaatcacgagaaattttgaggtaagtcacttgtgatcattgttagtcaataatatagaattatcatcgaataatctgactacgtttcatgtttttgaggtgtaaatcagagatttgaacttagggatttgaaaataatatttgaagatttggaggtcgagttgaggtcggattttggtaaaattggtatgattagactcgtggttgaatgggctttcgaattttgtaccttttgatgggttctgagacatgggccccacgggtgatttttgagataaatttcggattttgatggaaaattaatattttgttatggaattaattccaataatattttttgactgattcgaggcgtttaaggtaagtaacagttctaaatttggtcctgagggtatgaaaccctggattatgtgttttgtgattggttttaaggtgacgcacatgctaggtgatgggcgtgtggacgtgcaccgtaggaattgtgacttggtcaaattccatggaactgtatagttgaataatcagttgatatccatacatttttccccgtattagagaaactgatctatgaatcatgtttaaataatatgtttacactgttgggacccacagaggtcatgtacttgtggaattatcagctaaattattgtttttcactaagtcacagttctatttgcacattattacatcagtctctcttattcatgatttctgagagcccgagagactggagaggttgatgactgagtgaggccgagggcctaattgtgaggatatttataggatcgggctgcacgctgcaacatgtttattttttatatgccatgattggcttgatatagtgcttgggctgaaggaacccttccggagtctgtacacacccccagtgagcgcaggtacctacttagtgcgagtgccgagtgctgagtgattgggaggattgagtgattgtgaagaaagagtggctgtaaggctggagtgaatgggatgacttagtgactgttactctgagaggatgcattactttcattattgctgcatttcagctgtcatatatcactgttttagaaaatttctaaaagacatcattttctgtttcattcgaagttgttataaagttattatggagaagctcgtcactacttccagttccttatatattattgttacttactgcgttggttgtactcatactacaccttgcacttcgcgtgcaaatccaggtgatcccagacacagagggtgttaattctgtcacacagtcgatttttaggagattcagaggtagctgccatgtttcgcagaccttgtctctccttccctatccttttgtttattgtatttggtcttagattattatggaccatgttttccagacttgtaatgtatagatgctcatgtacttagtgacaccaggttttgggagtgtttgtattgatttttgcgagatgtttggattgtgtttaaacattatattttcaaacttagaagatattgtggtttattgaggttgttggcttgcatagtattgagataggcgccatcacgacaggttaggattttgggtcgtgacacccgagggctcgggtgaattttggataggctacgggtggtttggaacatagaaaatctagtttttccttagcttcagttgtcatcgggtttccttctttgcgttcgcgaaggtactctcgctagcgcggagagtgaactgggctgggtgggatattaccctacgcgaacgcgaagggctgtacgcgaacgcgaagtgaaggggggctgcccttcatgaacgcggacagtgtatcgcgaaagcgtatgtttgtggacctggaggagaggaaatcaatcaatgctcttcgcgaacgcgaagggtatctcacaaacgcataggctatttgagccactgcatcgcgaacgtgacaagccttcgggaacacgaagaaggcctgacgcccagtgtcaagacccgaaattcccatattctggatcgtgatagcgcctaacatttcactttctaggcaagccaacattagaatataattagccattttaacacaattgtaaattaatcaataacatagaaacaaatgcggaaataaagtctgaaataaagtgaataatttgtaatgaacgcgatatctaaataccatcccagaactagagtcacaagttcacgagcttctagagtaatatttacaagggtatgaaataaatacaaagttgtctgaatgaaaatacacagctaaataaaaataaagacggggacttcaggagctgcgagtgctgagcagttgtacctcaagtctccgcaggctgtccaatccgagctttctagtagtcgccgctgggaccgtctccaaaatctgcacagtgtgcagagtgtagtatcagtacaaccgaccccatgtactggtaagtgtcgagcctaacctcgacgaaagagtgatgaggctaaggcgagtcacctactctacaaccttaactcagtatataatcatgacagaaaattggaatactgaacagaattaaacagccaactgaaaataataaccgcagccttaagaataagccaatgtcgtccagaatcaccaatctttaataattcagatacaaataacataagaaaaccaacacagctcaagaagtggaaacatataggttattgcggtgcgcaacccgatcccaccagacaacacaaattcctcccttatttcaccgtaacgatatcaacaacagtacataatatatacatgttgcggcacacaacccgatcccaccatatgtcaatatcagtatcataattcaccattatttcaccatgtcaatccacccttattccacctgttgcggcatgcaacccgatcccaccgtatagtacaaattcacccttattccacctcaacatatcatccttatttcacttattgcggcgtgcaacccatatcccaccatatcaatatgaagtactcaataagcatagtaaaactcacaattcaaatcatagaaaaaccctattacaattccaagacaccaaactgaacaaataggaaaccttgtacaatatgataatccaaataagtaatactacacatcgagaccaatccagaatttacaactacaacgtaaagataaaccaacttgagcaaatagtaggagattatgaaaccacggaaagaactaatattatgaataggaggaaacaaagacaacaaataggaatttggcatgtaaacacatttagagcatataacaaataagacagggaaagagataatataagaagaacggggaaacagggaaaaacagataattcagcggcgcataagcacccgtcacctcacatatatgccgctcacatgaaattcacatagcaaatagtctgagggttcctaattccctcaagtcaaggttagacatgacacttatctcgctccaaaggccactcaatgctcaattaccgcttttcctctagaatccacttccaagccactcgtatctattcacaaatgactcaataatatcaaatattgctaaagaaatcaattacaatgtataaatttagattcccaaactttccctcaaaaagtcaaaaattgaccccgatcttgcttggtcaaaacccgaggttcggaccaaaatccatttatctgttcaccctcgagcccgattatataattagtttcggaatgcgacccaaaattgaggtctaaatccccaatttgcaaaaacccccaattcttcctaaatcactagttttctaccatgaaagaacaaagattaaggctagctatttaatgagtgatgttataaatggaagaaaatgagttaaatagtacaaacctatgaattggtgttgagttttctcttcaacatcgcatctaggccgagttctaatggagagtttatgaaacatggataaaatcctgttttggttctattttaaggtctgggcgtcaggccttcttcgcgttcgcaaagggcctgccgcgttcgcgatgtgcagccacccgagtggattttgcgttcgcgagtcctccttcgcgttcgtgaaggttgttcccccctggcctttgcgtttgcgagccaatgctcgcgttcgcgtagaagaatgaatgatcgctcccccaagtccctaaatcttcacattcgcgagaaactggtcgtgttagtgaatggtaagggccccattgattcgcgttcgcaacccagctaccgcgttcgcgattaagaaaatcaccctgccctagtttactcttcgcgttcgcgagagtacctccgcgaacgcgatgaaagaaacaccagaaaacagttgaagccaaaaaccagattttttctaagtttcaaaacacccgtagcctatccgaaactcacccgagccctcggggctccaaaaccaaacatccacacaagtcccaaaaacatcatacgaactcactcgcgcgaccaaaacatcaaaataatgcctagaactacgaatcagacaccaaatcaaatgaaattatcaagaaaactttaaaacttctattttcacaacctaacgtccgaatcacgtcaaataaactccgtttctcacaaaatttgacagacaagtcataaatattatagtggacctataccgggctccgaatacaaaatacggacccagtatcaacaagaccaaacatcagtcaattctaaaaatcattatacattcaaacttttaatatttcatctaaaatccatgtctcgagctagggaccttggaattcgattctgggcatatgcccaggtcccaaattacgatacggacctaccaggagcgtcaaaacacatatccgagtccgtttactcaaaatgttgaccgaagtcaactcaaattaatttttaacgcaaaaattcttatttttatcagttttttaacataaaagcttttcagaaagatgcccggactatccacgcatatcgaggaaggctaaaacatgatttttaaggcttcagatcatagaattaggtttcaaaacatgagataacctatcgagtcatcacacccagtgattaaaacatatcaaaaatgggatttttcccatggaatcaattcctacaatttgtattgagtatatttaattgtttatgactagatttgaagatttcggatacgaatccgcgaggcaaaggtttattgaaatcttgaatttggttgcaaagcgagataagtgtcatggttaaccttgacttgaggtaatagaacccttgaattatttgttacatgaatttcatgtgtaacgatgtatagtgttatgacccaattcaatgtcaggtcgtgatggcgtccaacaccgttgctagacaagccaacagtgaacaacttagtgatttcccttatttttattaagcaattccaacatttagcttatttacatttaaagcatttgataaacaacggatttttaaggcaaaccaacggaaacatctaaaagcagttataactattgaactacaacccaaaatcaaagtctactaatacgtgccaagatctagtgttacaagtgtgtggacgactagtagaatatacaaaagatgactatcctactgtctgaaacagaatagatagataaaacaaaagagaaactccggcatgctgctgaacgactcagaagggggcagctcaccgtgaaatctcggtccaagatcaggtatgcacgccaggcgggtaactagaatcaccagcctcagatcctgtacaattaagtacagaagtgtagtatgagtacataaacaatatgtacccagtaagtatcccgcctaacctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagggccaatataatgtaattaaagtgttatgttaggtatagatattatgaataattctgacaattcaataacgggaagagataagtacttctttcaaaaatacaaatttcaatttcggtcatatcatttaaccacttacatttcaaggcatttaaactacctaaatcacggagagttccaaatacttaacatacgcaattatgcctaggtcgtacggcccgatccaacataatattaaattgtgcactgccggagggtcgaacggcgtgaaccatagatgcacctattttctaccgatgcgctcggcccgatcaacaaatagcaattatttttaaggaaacacgaattctcattttacaatcaagtattctaataaactctttaaataggtgaacttagccctttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagtaactgaattagcaagtaagggcataaacatttcgaataaggtatgatacggttcctaaactacccaaacaatagcacaatagtagctacatacagactcttgtcacctcgtatgtatgtagcccccacaaataggtacacacatttatttaattcacttagggggttaattccctcttacaaggttagaaaggagacttacctcgactcaaagcctacttcccaattgaagaacgcgctcaaacctccaaatttgatgccaaatgactcgaagctagtcaaacatgacataaactaatcaatctatgctcaaaagttcataattccactatttaagtgattacccaccctaaattgcaagcttcctaaaatttaccctcgggcccacatgctcggatttcggaaatttttaaagaatgttgttacccataaccttaggaacataaatatatgatttttactaaattccataacaaatttcgtggttaaatctagtttttatcaaaaacctaggtcttccaaaagctacgtgaaagcccctctcaagaagctccaagaatcgcccacgaagtgagtgaaatgagtaaaaattggtctaagtaccgtattaaatgaatcttactgcctccagcttttcggcacctgcggtcaagggaccgcatctgtgccatcgcttctgcggacgagagtccgcttttgcggaagttcctgggccggttgggccgcttctgtggccgttttaccgcttctgcggtcccgattctacgatgaaggggctgcttctgcagaatttggggctaccctcattggccacatctgagagccttggcccgcatctgtgagctctcacctgcagctaactaaccgcaagtgcagttatgacagatctggtgcactcagctgtagttccaaattctcaacttagtccgagcctcatccgattggcactcggggcctcgcccgaacataccagatctgtcaacttagtccgagccttgtctgtggcacccaagcctcgtccgattggaatcacaaaatagactcgctcgaactcaaggaatgctcgaaacaacatataaactaagaatcacaccctaaaaccaattgaatcaaacttaagagcttcaagttctttaatttacttccaatgcgccaaaacgtacttatactacttggaatgacaccaaattttgcgtgcaagtctaaaatgacactacagaactattcactacctcgaaattccatttggacctcgatatcaccaaaacctactccaaaccaaatttttaaagaacttttaaaatcttcaagaaccaactttcactattaggcaccaaaacactcccgagtcatccaaaacccgatccgagtatatgcccaaatctgaaatcctcatacaaacctattggaaccgtcagatcctgattccgaggtcgtttactaaaaatgttgaccaatgtcaaacttggcctttcaagcgaaccttaaggaaccaagtgttcggatatcaacccaaactcttctaaatcccgaacaaaacatccctggaagtcataaataaataaaagcaagtacgagaagtattatttaggggaataaggtcctataaagtaaaacgaccagtcggttcgttacattctccacctcttaaacaaacgttcgtcctcgaacgagtttagatccatacctgaagtgctgaataagtgtggatatttgctctgcatgtcctcctcggactcccaggtcgcctcctcgactggttggcccctccactgaacctttaccgtagaaatcctcttagatctcaattggcggttctgtctagcaacaattgcaactggctcctcttcataacccaagctctcatctaactaaatagtgctgaaatataacacatgtgacaagtcagcatgatatctctggagcatagacacataaagcaacctcaaataggccaccttataggctgggaggtaaagcaagctcataagcaacctccccaactcgcctcaaaacataaaatgggcctataaaccttgggctcaacttgttcttctttccgaatctcataatacccttcatcggcgagacatttaagagaaccttctcaccgaccataaatgatacatcgtgcgccttctgatcagcacaacttttttgtctggactgtgctgtgccaaattgctcctgaatcaactttacctttaccaaggcatcctttaccaaatcagtaccatataatctagcctcgccgagctcaaaccacccgatgggagaacgacatcgccgacaatataaagcctcaaatggagccatctcgatgctggactgataactgttgttgtaagcaaactcggccaaaggcaagaacagatgccactgtcccccaaagtcaatcacacatgctctcagcgtgtcctccaatatctgaactgtccgctctgactggccgtcggtctgtggatgaaatattgtgctgagctctacacgggtcactaactcactccatacggctctccaaaaatgtgaagtgaattgagggcctctttctgatatgatggaaataggcacaccgtgcaaccgaactatctccctaatacaaatctgggccaacttctctgaagtatatgtagtcacaaccggaataaagtgtgccgacttggtcaacctgtcgacaatgacccaaactgcatcaaacttccgcaaggtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtaacccaaccacgaagttcatggcaatgcgctcccatttcctttcaggtatagtcatttgctgaagtaggccacctagcctctggtgttcatacttgacctgctggaaatttagacacctagccacatactcaactatgtctttcttcatccgccgtcaccaatagtgctgtctcaggtcatgatacatcttcatagcacctggatgaatagaatacagagaactgtgtgccttctctagaatcctctccctcaagccatcgacattaggaacacacagacgaccatggagtcgcagaaccccatcatcgctaatagaaacctccttggtattaccctgtagtaccatctctctaagaactgccaaatgtggaacatcaaactgccgagcctttatctaccccaatagtgaagactgggcaacaacacatgtaagaaccaggttgggctctgaaatatccaacctcataagtctgttagccaaggactgaatgtccaaagctagtggtctctcccctgccgaaataaatgtcaagctacccatactctctgcctttctgcttaaggcatccgcgaccacatttgccttgcccggatgataaagattggtgatgtcataatgcttcagtaactcgagccatctacgatgcctcaaattgagatccctttgcttgaacaaatattgtaagctgtgatgataagtataaacctcacatgacacctcatacagataatgcctctatatcttaagagcatgaacaatcacggctaactctagatcatgcacagggtaattcttctcatgaatcttcagctgacacgaaacatatgcaataactcccccctcctgcatcaatacacaacccaagacaatgcgtgaagcatcacaatataccgtatatatccccgagccagaaggcaacactagaaccggtaatgtagtcaaagctgtcttgagcttctggaagctcgcctcacaatcatcggaccaacggaacggagcacccttttgggtcaatctagtcagaggtgttgcaatggatgagaaaccctacacaaatcggcgataataacctgctaaccccaggaaacacctgatctcggtcaccgaagtgggacgaggccaactctgaactgccttaatcttcttgggatccaccttaccttctcctgataaaatatgccccaagaatgccgcataatctagccaaaacacacacttggataacttagcatatagcttctgttctcgcaaggtctgaagtaccactctcaaatgttgctggtgctcccccaggctatgtgagtaaatcaagatgtcatcaatgaagacaataacaaaggaatcaatataaggcctaaacacccgattcatcagatccataaaagtcgctggggcattagtcaagacgaaggacatcactagaaactcataatggccatatctagtacggaaggccatcttcggaacatctaagtcccgaatcttcaactgatggtaccctgtcctcaagtcaattttagagaacaacctagcaccctgcaactggtcaaacaaatcatctttacgtgataacgggtacttgttcttgatgttaaccttgttcaactggcggtaatcaatgcacatccgtatagtcccatctttcttcttcacaaataacactggtacaccccaaggtgatacacttggtctcacaaacccctttactaacaactcctcaagctgttccttcaactccttctatattttcggagccatatggtacggttggatagatataggctgggtgcctagagccagatcaatacaaaaatcaatatcacgatctggcggtatgactggaaggttaaaaggaaacacatcagcgaactaccggactactggcactgaatcaattgtcggagaatctatggtggtgtcccaaacataaactagatacgccaaacacggcatcaatacatatgcaataactccccccttcaactccttctatatttttggagccatatggtatggttggatagatataggctgggtgcctagagccagatcaatacaaaaatctggcggtatgactggaaggttaaaaggaaacacatcggcgaactaccagactactggcactgaatcaatcgtcggagaatctatggtggtgtcccgaacataagctagatacaccaaacacggcatctgaggctaatgcatttggtctggacaaaaaagcatagaatcttgctggagcgccagcgggctggcctctgcctgactgaatagtagctgactagccttccccgacctggcctccacctctaggatggcccctgccagcctgccctccgcctctaggcggccggatagccggtgctgaaatcataggctgctgaccctgcaacactgccttgcctcaaagcctgggccagaatctcctcatctgacggaggtctctgcactcgaaacaacccctcggtgtgatgatcttctgtcctgatgtctgatcttgatggcttgtaggagcctgaatagccgatgggcggtattaactctcatgcatggtactaagataggagctggaagaaccctggagggctggtgggcggtaagaactctctggcgcggtgcggaaataggggcgcgctggagcaccttgaggaggtggtggtgatgaatatgggggcctgctaggctgacccctcccaaactaacctctgcccctagccggggaacctcttaactctctagagaaatgggccctcttgtcctgctgcatctgctctctccctttctaacggtagccctcaatcctccgagcaatctccactactagttgataaaaagtcaccatctcaacctctcggtgcatattggccataatactggagtgcatccctgcagctaaccttcgtactctctctgcgcccgtaggaagtatcataagtgcatggcgagacaactcagaaaacctcgccttagagtcggtcactaacatctgtccctgctcaagctgctcaaactgataccgcaactctcccctctacgagggtggaatatacctaaccaggaaaagctgtgtgaactggctccaagtcatgggaggagaaaccgctggtctgtcaaaaagataagactgccaccatctacgggccctgccctccagctggaaagtagtgaagtcaaccccatgagactccagtatcctcatattgtgcagtctgtccctgcacctatcaatgaaatcatgggcatcctcatggcgctcgcctccaaagacaggagggtgtagcctagttcatctgtccaataacttctgtggatcgtcgtccgcaacagatttaggctcaggtgccactgctgtaattggctgatacactgcagctgcatgtccaggagcctgagcagtaggggtctgtgttccccctcccgcctgagatgtggttgggtctacttgaaataaaccagcatgggtcatagaatccatgaaccacagcatacggcccatgatctcctgaaagcccagagctgccatgacatctaccggggctggctctgttgcgggcacctcaccctgctcctccactggttccgctggtggttctactaggaagctttgggacgccctcgtcccctacctcgagccaataccctccccggcctctagcaacgaagggagcagcccttcctgggtctggaacgtccgccacacacgtcctcactatctgtgagagaatagaagaaggaaatttagtataccatcaattgcagaggttaggcttggcagttactgggtaccgttgtggtttacttatactacgctcctgcacatcatttagtgcagatctaggtacttcctagcagcccagatatcagtgagctacctatgtacggagacttcgaggtatatctgccagtgtccgcaaactctagagtccacttctatccttattatgttgcttctttattttctttagactctgatatatagagaaattgaggaaaacgtcttagaagcttgtgacttattcctaccgggttttgggagttgtgataatgcgaatttgcagatttatataatttaaacttctattgttattccgcattgataggcttacctaatcttagagactaggtgccatcacgacatcccacaaagggaatttgggatcgcgacaagttggtatcagagctctagattcataggtgttatgagtcacaagcaggtttagtagagtctcgtggatcggtacggaggagcactgactccgcctctcgtaccccagagccacgggcccaagttgaccattcccaagaggttatacaagtgcagccagttgtcccagtttggcccgaggttagggcagcagtttcagagggggagcagctcaggctcgagaggtacaagaagtaccaccctcccacattcagcggtttagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaggatgctcagggttttcttgaggaatgtcattgtatcctctatactatgggtattgtggattccagtggggtttctttcacagcattccagcttagaggagtgcccaactagtggtggcggacatatgagttagatagtccgcatgagacaacttcactcacttggactcaattttaagatatgttattgagggaatatattcctctgagtcttagagatgcatggcgcacaaaagttgagcagctgcgccagagttctatgaccgtgtcagaatatgctgtttgattcagtgatttggctagatatgcagtagccttagttgctacttttcgagatcgggttcatcaatttattgaggggctccaccttagtaccagattcagtatggcctgagaaccggagatggacatcacataccaacatgtggcattgattacaaggagattggagggtatgcgaactcaggagagagaatagagggaagctaagagacctcgggattctggcacatataacagttctcgtgccctagctacagcccgtcatggtagaggctatatgagtcatcctattaattcagcacttccagcggtattccggctactcctagacctcaggttccatattatgcaccacaagtgtctactgtacctcttgtgcggggtgctttcagtcgacagtccagtcgatcaggcccgcgccagtcctagcagccacgtacttcgagggcttattttgagtgtggtgacactcgtcatatcatgaggtattgccccgaacttaggaggggtgcacctctacaaatttctcaagtcccacctattccatagggccctcaggcttcttaggccatgatcactgcagaagtttctactccacctgcacagccatctagaggtggtggtcagacaggtagaggtcgccgtagagggggaggccaggccagatattatgccctttctactaggacggaggcagttgcatccgattctgttatcataggtattattccggtcagtcatagagatgcatcagtcttatttgatccaggttccacttattcttatgtgtcatcttattttacctcgtatttgggagtatcccgtgactctttaagttcttctgtttatgtatctacacccgtgggtgaatctattattgttgatcgtgtgtatcgatcgtgtttgattgttatctaaggttttgagaccagagctgatttattattgctcagtatagtggatttcgatattattttaggcatgaactagttgtcgccctatcacgctatccttgattatcacaccaagacggtgacgttggctatgccaggtctaccatggctagagtggagaggtaccttggatcatgttcctagcagggttatttcatttcataaggctcgacgaatggttgataaagggtgtgatacgtatttggcctatgtgatagatgttagttttgatactcttaccgtggagtcagttcctgtagtaagagaattttctgatgtatttccagcgaatcttctgggtatgctacccgatagggatattgactttggcattgatttgttatcggggactcagcccatttctattccaccataccgtatggccctatcagaattaaaggaattaaaggagcagttacaggagatgcttgataagagttttgttcagcccagtgtatcgcctttgggagctcctgtcttatttgtgaagaagaaggatggttgtatgcggatgtatattgattaccgccagttgaacaaggttacagtgatgaatatgtatccattgccttgtattgatgacctattagatcagcctcagggtgctagagtgttctctaaggtcgactgcgttcaggctatcatcaattgaagattcgggagccagatatccctaagactgctttcaggactcggtatggtcattatgagttccttataatgtcatttgggctgaccaactccccagcaacatttatgaatttgatgaacagtttattccagtcctatcttgacttcttcttcattgtatttattgacgacattatggtgtactctcgaaccctggaggatcatgaacaatacctgaggactgtgcttcagactttgagagaaaagaagttgtatgtaaaattttcaaagtgtgaattctggcttgattcgataggaattttgggtcatgtggtaatgaacaaggggatccaagtagatccgaagaaaattgaagcagtacagagttggcccagaccgttatcagctactgagatccggagtttacttggcttggcgaggtattatcgtcgatttgtagagggtttctcttctattgctgcacctatgaacaaattgacccagaagggtgctccattcagatggaccgaggaatatgagaagatctttcaaaagctcaagagaactttgactacaacctcattattggtattacctacaggtttagggccttatactgtgtattatgatacgtcgcacattagtctcagcgtagtgttgatgcaagatggtagggtgattacctatgcatccagacagtttaaggtacatgagaagaattatctggtccatgaccttcagttagcagctattgttcatgccttgaagatttggcggcattatttgtacgaagtccattgtgatgtttacaccgatcaccatagtctacaacatctgtttaaacaaaaatatcttaacttacggtagaggaggtgattggagatgcttaaggattatgatatcaccattctctgtcatcctgggaaggccaatatagttaccgatgccttgagtcgtaaggcggagagtttgggtagcttagcatatttatcgacaatagagaagcctttagccttggatgttcaggctttggccaaacagtttgttagattggatgtttccgagccgtgccgagttttggcttgtatggtttcttagtcttctctttatgatcgtatcagacagtgtcagtaatatgtcccccatcttcttttccttaaggacacagttcagcacggtgatgccaaggaagtcactattggagatgacggtgtattacggaagtagggcaggctatgtgtgcccaatgtagatgatttgtgtgagttgattctccatgaggctcacagtttgtggtactccattcatccggattctacaaagatgtatcaggacttgagacaacactatcggtggaggcggataaagaaagacatagtggaatatgtaactcggtgcctaaattgccagtaggtgaagtgtgagcatcagcgaccgggtggattgcttcagaagttagagattccataatggaaatgggagcggatcactatggatttcgttgttgggctcccacggactcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagttcgatgcagtttgggtgattgtgaatagattgaccaagtcagcccatttcattcctgtggttactacttattcttcagagcagctggctcaagtttacattcgcgagattgttaggcttcatggagtaccggtatttatcatctctgaccatggtacacaacttacatcacgattctgcagagtcgtatagcgagagttgggtactcgggtagagttgagtacaacatttcaccctcaaacggacgggcagtccgagcactctattcagatattggaggatatgcttcatgcttgtgtgatagattttgggggtgcttgggatcagttcttgccacttgtggagtttgcttacaacaaaagttattagtcgagcattcagatggcggcgtacgaggccttatatggtaggcggtaccagtctgcagtgggttggttcaagataggaaaagctagactattgggtacggacttggttcaagatgctttggaaaaggttaaattgattcaggatcaaattcgtacaacccaatctagacaaaagagttatgtggatcgaaaggttcgtgatgttgcattcatggctggtgagtgggtcttgctccgggtttcgcccataaagggtgttatgagatttgggaaggaggtcaagttgagccctaggtatattaggccttttgagattcttgaaagaattggagaggtggcttatagacatgcactaccacctaatatctctacagttcatccagtgttccatgtttcaatgctccaaaaatatcacggtgatccatctcatgtgttagacttcagctcagtccagttggataaggatctatcttatgttgaagagccagtggccattttggacaaacatgttagagagctaagattgaagagcattgcttaagtaaaagtacagtggagaggtcatccggttgaggaggcgacttgggagaccgagcatgatatgcatagttgttatccttatcttttcaaaatccaggtataattctaaactcattcgaagatgagtgtttgtataagagggttaaatgtaacgactcggccagtcgttttgagtattacaacaccgttcccctattcattgctcaatttatgctttacaatttttatgtgacttgccggggtgattagttcgggtccgatgaggttttggaatgaattggaacatttgttccaaggtttaaagtttaagttgaaatagtgaccggatgtcgacttatgtgtaaacgacaccacaatagagttttgatgattccaatagctctgtatggtgattttagtcttaggagcctgtccgaaattttattttgaagtccgtaatggaatttggcttgaaatggcgaaaattgaatttttgtgaagtttgaccggggagttgactttttgatatcggggtcgaaatccagttctgaaattttttatatctccgttatgttatttattacttgtgtgcaaaatttgaggtcaatcagacttgatttgataggtttcggcatcgaatgtagaagttggaaattcttaagttacttaagcttgaatttaggtatgattcgtggttttagtgttgttttatgtgatttgagatttcaactaagtttgtatgatattttatgacttgttggtatatttggttgaggtcccgagggccttgggtgagtttcagatggttaacagatcacttttggactttgcattccagctaaagaatgctggttttttgtcactgatttccttccacgcgatcgcatactaagttggagcagtgaaattttgtgctatgcaatcacgttaaggcatccgcgattgcgtaggtttggccaggttgtgctacaaacgcgtgggaaatgtcgtgttcgcgaagaggaatgaggcagaaggctgggtcacacgtttgctctatgtgatcgcatgtggttgtccgcgatcacgtagggatgaagatcctgtgcttcacgatcgcgtgaaggacaccgcgatcgcgtatgatcttttctgggcagcttgcaattgcacttcgcgatcgcgggaccttttctgtgatcgcatataagaaatgactgggcagaatgtttaagttctgaaaaccatttttaccgatttggagctcggggaaaggcgatttttgggagtgtttcaaggaaaacatcggggtaagtgttcttaactcaattttggttaaagtacccaaatctatggtagtttttaacatttaattggtggattaatttggaaaaattgtgaaaatccctaagtttagatggaagatttgagggtcgagttgatgtcggaatttaatgattttggtatggttggactcgtggttaaatgggcgttcatattttgtaacttttgtcaggttccgagatgtgggccccacgggcaatttttgggttaaatttctgattttgttagaaaatttgtattttcatatggaatttattcctataatttatatttattgaatcgaattaattatgactagattcgacccgatcggagtcggaaaatcgagaaaaaggcatactacttgactgattgagcgtggcttgagataagtgacttgtctaactttgtgtgggggaaatttcccttaggattggtattgataagaaaatgttgatatgttggaagtcgtacatgaggtgacgagtgtgtacatgcgctaaatctggaagattatgtctttaaattttgtagagaattgttgcatattaattaaattattttattttgttatatttatcatcattaatatattttcgtatttaaaattggcatgatctgttcctggtaagtgttttacctatttagtagaaactcagtttcttttgttctgtgcattatttgaaggatgtgtttattaatttaaatattattaaaaatgaagtagtttacatttaaaaatttgatatttagacaaggtgttaaatttgtgaaaatattatttttgctgaatattttgtgagattttcctactcattgtgattgagccgtgagatccttattatgaaaaatattgttgttgatttatattggcatgagccatgagctctttattgtggaaaatattgttgtggttgatttattttggcaagttgaaatatttatgcacttgaggtacaaattgtgatatattgtgatattgatacgcatgtggtggtgtaaggtctgggtgttgaaatgcatgcggtgagataagggtggcttgatatgcgtggctagtaagggaactactagaagtcatgtggtgtgataagggtgtctaaaacgcgggatgctatttcgggaaaaatattttctttaaaaaaaataaaatgtgaaggctcccgcggtgatataagaaaatgagatattgtgaatttatttatgatttgggactacaatgcggtacctcgggagtgcccttgttgatatttgtttatggctgcatttgccattgattattatttttccttattctgtgaagttaaatggtgacatactacttacttgattcattttgtaatgacccagccggtcgttttgagcatttgcacttcagtcggtagtttacgggcgtgagtagctccatatgatgtattttgacttattcggtatttatttggaagaatgattatcaactagggagctttaaatttgaaagagtttgacttttagcatttgacctcggattagaattttgatggttccattagctccgttgggtgattttggactttggagcgcgtccggattgtgatttggaggtccgtggttgaatttggatcgaaatggcgaaagttgaaattttgaaaagtttaaccgggagtggactttttgatattgaggtcggattccgattccggttgaggtgagattcgtcgcatcgatgttgttatatgtgttttgaggcctcgagtaggtctatgttatgttatgggacttgttggtatgttaggacggggtcccgagggtctcgggcgtgttttggattgatttcggatcattttccttcatgttgcactgctggtttctggtgtcttagtcctttatcgcgctcgcggggcaattgtcgcgaacgcgtagtgtattccgagggcagcagcaaattgttctttgcgatcgcgaagtatgtcccatgttcgcgtagagttagggcaagtcttcttagcgttcacatatggaggatcgcattcacatagtgatgaggttggcagctaggagttggagcattcttctatgcgatcgcggaaggtgagtcgcgttcgcgaagccttggtaacaatagtcatcgcgtttgcgtgggatgtatcgcgaacgcgtagagtgttttatggcagtgtgggttttattcatcacgagcgcgatacatttcccgcgttcgcgaaagtttgggggggtgggcagattataaagtactctatttcgagggtttcgaccatttttacattttgggagctatggagctcggattgaggcgattcttgaagcaattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttatatttcatgaatctatcttcgtttttggtcattggattgtgaattttaaagaggaaattgggggttttggcctaaatcttcataatatgaatttttgagttttgaacatctagttggtgtcggatttgagtgaaactagtatggttggactcataattgaatgagttgttggattttgtaaattttgtcgggttccaaggtgcgggcctgggttgggcttttggccaattttgggcttttcaaatatttgatctttttcgatcgggattggttcctttagcattgtttgatgtacttgagtcatgtttttgttagtttcgagccgttcagaggtaggaacgcgcgtgatggcatctttggagcatcggttggcttgctcgatattggtattggcttgatcgagataagtaactcttctaatcttggagttgagggtatgaaaccttgaaatacgtgttatgtgacttgtgttgaggtgacgcacatgctaggtgacaggcatgtgggcgtgcaccatgtgaattgggactctgttgtttccatggcactgtatagtggtcctactttgttaatgtccgtgttttcaccatgcaataaagtaattgagttgtcactcgtgctagataccatgtttaggctttatgatgatactggtaggacccatagtggtagtttcttgatgttatttcactagtttcattgatattttgtactcagtcatattcatgcattcatatcatatctcagtctcattaatttttgatacatcatatcattgttgtcgagctagtttcatggcattgtgagcccgtgagtgagactggagagtgatgactgagtgaggccgagggcctgagtgagattgataatttgggatcgggctacatgctgcagcatgttatattgatattttgggatcgggatgcacgccgcaacaggttatatggattatattttatgggatcgagctgcacgccgcaacgatatagcgcttgggctgaagggagcccttccggagtttgcaaacctctagtgagcatagtcgactataaatatggatcgggctgcatgccgcagcgggtatggtacaacgctgagtgattgagtgtgctgagcatagtgagagagaatgcaaggcagtgtgattgagtactcggagagtgtgagtacatgagctcatcatcgagatgcatagcatttgacatgcgtacttgagatacatgcatagaggtgcatttcgttctgctacccagttttggggacattcatgattttacctatatcttaacatgaaggcatagagaagtactttcctcatgctatctgaaaatgaaacatcttactatttgttgaaagcagttttgaaaaaaaaatcacagttttcaaacttactcgcactttggctttttctataaaagatttgggttttcactgagatacttgaaaagaaatgcctattatttccgagatacttttttgttattgtactatgctgttatgaacttatatggaatattggtgttgtacccgtccaatttttttattagctcgtcactacttttaacctaaggttaggtttgttacttattgagtacatggggtcgattgtactcatactacacttctacaccttgcgtgcagatattgactgctgatgttgttgtgttcgatgggagctggatttgaagaagtgcctgcgtcctggttgtagctgcctcttattcgtggtagccttaaacctataaaactcggttaatgtacttttcaaacagacgatgtaattacttcatttcagtttgtaaactctattcttagaagctcatgatttgtactaccagttcttggagaatgtatcagattcagataatttctttacttaattgctttattgaatgctattggaattggttaggggttaactggcttacctagcgggttgggttcggtgccatcccgactaattggattttgggtcgtgacaaggtggtatcagagctctaggttcataggttctacaagtaatgagaaagtgtctagtagagtcttgtggaccggtatgatgacgtccatacctatctttgagaggctacaaggcatttaggatatacttcccatatttatttccttatcatgctacattgattcagcttgaagcgtaactctttgaattccttccacacctccgtgtgcgcatgtgagcgttcgatatcggttgtgcaccagcgacttatgattccatggttgaggtgcgagatgtgattttgacgtgctgatgatgggctagtctggaggacttgaggccgggttttgaccgtagctggagcacgaagattttgattgtatgagaatgtgcttttgggacttacagattcattggtgtccctattagaggaatttatgattggatgactatgtggtgagtatgatgagactatgagatgtgtttagattgttcgaatgtgacgagaagagtttacttgagatgtagcaaggattatggggtgtttgatttctgtcttgatttggcgtatggtcccgagttatgcgtgtatttagggatctctcatgttgtttagttgtggagtgaagtagattatcatgtcttgttgatgagttcagaatcgagaaaattaagtgatcgcatagtagtcgtgactgggaaagggtgtagagagatgtcagtttgaggcaaggcaggtgggttattccctacgaggtgtcctgaggttgagtgacccctatgatgttttctagagagttttcttttaccagtgaatgatatatgttgcaatttgagtttggatcgcttgtggaagttggcttaaccatcacgaggatgaacgcgagatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatgatttaaggtactagatagtttgtgttgcacgagcggatgaagggtttagtggaatctcactgtggtattatggtagtaatggctatggctattgtaagtaatcagatattttactccatgggtttgagccaagtgggggagtctgctatcaacgagttgattatacggttatgtgttgtattggattcggtttgaggtatactgatgaatcaattatgactcgcagaagttgatattgaggatgactcgagtaagggaatttctggataaaggttgtattgcactctatgggtatatgggaatcataaaataattgagtggttattcgcgaaggatgtagtgtacatggagtaggaatttgctcgattgcttaggagtgtgagttactcccttgggtgttggtgtgctaatggggcacaggtcatttggtccgtttggttggttaattgagatttgagtagagtggatgactctcgagaatggttctaatggattcaagaattaaatgtagcaattaagaatttcggattggtatatggctaggatctgatatttgcattggatggtgtcaatacttgtgtcatttttatatcattatggattctgcatttcagtatcaagaaggtgaaggaaacagttttaggttcacatagggtctctttacagtgggtgtctcggatgtggtgctttagggtgcttaagagggaagtcagtggcttatgggccttagggaattgtggttttgtactagtgtctcttgtgtggtgaattttggttacgaatcatggtgttccagcaaggagaagtatcaatttgaaggcaacttggaagggacttggagaaatagaacagtgtggtagtaggtttgatcagcatagtgatggatataatcggttctttgggtacttatgatgtggctagcctccacaggtgtttcgtggcaatgctattgggttttggcaatctgcgtggctgggtgagttatagagattcaattctgatatcttggttgtgtgcaaatgggcttcgaagagttctcaatggttttttccatggttcgaggagtatatttcctaccagcgtgaggaatatgttgcgtattgggattttctcctgtatgagatcaaattgaagctttctgactgatcgggtatgtattctgctggtgactcataatgattatgaggttctcgtatttttcatataatggcatgattgatgtggtgtgttgtgtgggactgagatttgcatgtgtagggttacaattcagtagtaaaaggggaggacataaattcgtaggcaacattgacggttttagatgactaggtaaatgatattactaatcgatatggcctgatgagagtatacatttcagaaggggcaatgtgttttgatttatggatactttattggtattgcggtactctcctagttgatcggctgctgatattcaaatttttctatgtcgaacgggagaattttagaagtatttctcatgggattatcgtgtatgagagatgtgttagacattttggcggtggaggttggatcagatatgctgattcgtgtgttctatggatttggagactggagttctcaagagcaggttgtttcatgtttgtggattatgaagtcctggccgaagctagctagacgatgatatatgttatgattcagtcattttgggttttcggagggttatttatctctttgtgggtggtcggagttgatttgggggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcctaattaggatgtgcattatacaccgagccggattggttagctccatacttctactgttgagggatgtgtcattcggttgttgttgagctcattcatgttctaaaatgatctgtgagattcttttctatgctacgaggagttgtgattcattggttataagcacacctggtgcggttctctttgggccttatagcggaatttctacgagatgggtatttgggtgatgcatgagtggttgcacattggttatgttctttcgggtttgtgtggcattgtgtcatttgcttctccatggttatggtaatgcactttaagtacttgatgtcatattgcgcgtggttattgattttgagcatggtggctgaggtgtttcatatgaatcagtgtttggatggggtcacgcgttgcaatagagttatgttaagatccgatcctttgtgttagattcgtgtgtattggttctactaggtatgatgggttcatagcatttcggctgtggtagtacttgttgaacttgcgggatggttctctcgtttgagtcatttttccatgatttgagtatattcggaatattgcttattggtgcacgaattgcacgagctatggctttagattgtattgatgggtcatgtcactagagtggtcgtgttggatgagatgaggtcactggacctagaatggatactatcgaaattgattacagcatggttggaaggataatatcgaaagtcggcttagaaatttgctatagttcttgtcaaaggagagggagttccatgactggtggatctgatgaatggtaacgactttctgtgtgtttcttttatcatcgacagtgtacgaaggttttagaatgaagtcttgtttgatatgaggtttaatacaggcattgggttgttttgagcagctattgtggttagaaatcattgctttgagcttttgagctatgtgttatttgagttttatgagtatttgagttatggttatggcttctggttcaacttgttcagacttatatagtatgtagatgtgaaattctgatcttataagaaattccggatgttggaaattggattcgaaggcttgtgggctaggttgaattgagaaattttagttatgttgtgttattagaactttatgggatagggtgacgtgggatcacccccgggtatatgcatggtaaggttatacggcggtttgatggctttgagaacaactttggacacgtttgaggacgaacgtatgtttaagtgggggaggatgtaacgacccgaccgatcattttgagcatttgcacttcgttcgatagtttacgggcatgagtagctccgtatgatgtcttttgacttgtgtgaatcgccgattttggttttcaggttattcggtactgatttggaagaatgattctcaactagggaacgttaaatttgaaagagttaaccaagtttgacttttagcatttgacctcggattgaaattttgatggttttgttagctccgttaggtgattttggactttggagcgcgtccagattgtgatttggaggtccgtggatgaatttggatcgaaatggcaaaagttaaaattttggaaattttaaccgggagtggactttttgatatcggggtccaattccgattcctgaagttggagcaggtccgtaatatcaaatgtgacttctgtgcaaaaattgatgtcaatcggacatgatttgataggtttcagcattggttgtggaagtttgaagtttcaaagtttattgatttcgagttgaggtatgattcgtcatttcgatgttgttatgtgtattttgaggcctcgagtaggtctgtgttatgttatgggacatgttggtatgttaggacggggtcctgagtggctcgggcgtgtttcagattgatttcagatcattttccttcatgtttttactgttgtgttctgctggtttctggtgtctcagtccttcatcacgttcgcggggcaattgtcgcaaacgcgtagtgtattccgagggaagtaggtaaattgtatcgcgaagtatgtcccgcgttcgcgcaaagttgtggcaagtcttcttcgcagtcgcgtatggatgatcgcgttcgcgtagcgataaggttggcacctgggagttggagcattcttctatgcgatcgtagaatgtgagtcgcatttacgaaaccttggtagaagtggtcattgcgttcgcgcggggtgtatcacgaacgcatagagtcttttgtggcagtgtgagttttattcatcgcgaacgcgatgaatttcccgcgttcgtgaaagagggggcctgggcagattataaagtattctatttcgagggtttcaaccatttttacattttgggagctatggagctcggattgacggatcgaatttggatttggaggaggagctgaagcagctgggctgctggagagatcgcacctgcgcgaaaaattgacgcaggtgcgagctcgcggatgcgaggaattagccgcggaaacggaaaatgcatgggctggccaggcaccgcgggtgcgaaaaatgttgccgcgaatcatcgcgggtgcgaagaccgcaggcgcgaagaaatcaccgcgggtgcgaagaaatcaccgcggatgcgaaaatcctggacagaatgttaaaaacagagggggttctgagttttgctatttttcgaccttcaagcacagtttttgcggcgattttgagagaattcaaggaaaacttgaggtaagtcacttgtgattatttctactctataatattgaattatcatcgaataatccgactagattacatgtttttaaggtgtaaatcggggttttgaacttagggatttaaaaataagatttgaagatttggaggtcgagttgaggtcggattttggtaaaattagtatggttagactcgtggttgaatgggcttccggattttataacttttatcgaattccgagacgtgggccccataagtgattttggggcgtaatttcggatttttagaaaatattagtattttgatatggaattaattcctataatttttgtgggctgaatcaaattaattgtgactagattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggatttttgcttgttcgaggtaagtaactcttctaatcttggagctgatggtatgaaccctgaatatatatgtatttcgtgaattgttgtgaggtgacgcacatactaggtgacgggcgtgtcggcatgcactatagaaattatgacataattgtttctgtgaaattgtgtagtaaataatcttggcattttccatgtggtttatgtgttaatgaaattgagctgaaaagtatattaaaaatcatgttgaggctatgtgccagtattattgggacctacggaggtcatattgctgtgaattatttgttttaaattgaaaattcatactcagacatattcatttcattacatataatatataagtctctgttgttatttattgattcatcatatcattattttcgggctatttttgtgacattgtgtccgagagactggagagattgatgactgagtgaggccgaggccctgattgtaaggataattatgggatcgggttgcacgctgcagcatgccatattggcttttttatggcacgtgagttgtccgtgcggattctgatatgatattatagcacgtgagttgtccgtgcagcacatgagttatctgtacagattatagcacttgggttgtaggagcccctccggatctgtacaaacccccagtgagcgcaggtacttactgagtgcgagtgccgagttctgagtgactgtgaggcatgagtgattgtgaggtatctccgagtggcaagagtgattgtgaggtatgcccgagtggaatgagtgtttgtgaggtttgtccgaggggctgtatatgagtgatgttctgcccgaggggctgtttatgattttaccactgagttgcatcgcattggcatgcacacatgacatacatgcatagagatgtatttcctcatgttgtactgcaccacatcattcatgattttgcacacattttttacagatgggcatagtgatgcatttgttttacacgggttatccggaaggaaaatgaaacatcttatttattattgaaaatattttgggagaaatttattgttttcaaactattcatatttttggcaacttcggtaaacgatttgggtttttactgatgtatttgaaaggaagaaaactattatttttgaaattatgatttggttgagcattttatctctgagttacttctggtattattttccttatgttgttatggactgttgtggactattggttgtggaccgaccttggtagaagcttgtcactactttcaaccaaaggctaggtttgttacttactcagtacatggggtcggttgtactgatactatatttctgcacattgcgtgcagatgtcggctgttgttgttgctctgctcgatggttgcgggatttgaagatgtatctgtgttcctgttgtagatgcctcttgttcatggtagccttagatttataaaagctctgtttatgtattattcaaacagactatgtatttatttcatttccgctttgtatactctattcttagaagctcatgatttgtactaccagttcttgggggatgtataagactaagatctttattcacttaaattgctttaataattattattggagttcgataattgaaagttggcttacctagcgggttgggttaggtgccatcacgactagttggattttgggtcgtgacaaggtggtatcagagctctaggttcataagttctacaagtcatgagcaagtgtctagtagagtcttgcggatcggtatgatgacgtccatacttaccttcgagaggctacagggcatttaggacatatacttcccatctttctttcattatcgtgcaagattgattcagctttagacataaactctttgaattccttctatgtattcgtatgcacacatgagcgcttggtatcagttgtgcatcgccggcttgtgatttcatgaatgaaattcgagatgagtattctatgttttggtgaaggtccagtctggaggacttgaggccaggtttagaccgcagcttaagctcggtagctttagttgtaacttgtacaattggactcatatgtccggtgatgaccctacagtggaatttgtggctcgatgagcggtgaaatggcggcatgatgggtatgatgtgaccgcgggatgtgttaagacaatttgaacataacgagaagtgtttaattgaaatgtaaagggaaggccatatggtgcttcatttttgatttgatgtgacgtacaatctcgagtgtgaattttttgaaggatctttcacgattgttaaattttgggacaaattaaactctcaggtctggttaacgagtttggactcagaaagatttagtgattgcatagaaattgtggctgcgaaaagatataacaagatgccagtttcaggctagggaggtgggttatctcctggagagtaatctacgtaggtgtgttccttgtaatgtgaatggaggctttcttttttgccagtggggcgtatgtgtggagatttgcatttgaatctggctgagaaagtcgacttaagtgtcaagggaataattgcgggcttagcggatgatttggggtatttttgtggttggtgttgtatgagcttgagaagaattttgtggcactgactacgatattatgacattaatagggtatgggtattgccaattatggagtggtttaatctatggctttgagccaagtgggggagcctgctattgacaatttgatttcactgttatgtgttaacttgtagttttgggctgaggcatactggtgggatagttatgacttgcagaagttaagatcgaggatgactcgggtaaggaaatttctgaatacggattatgttgcactttatgagtaaacatcatgggacgcatggagtatgaatttgattgggggtattaaagtagagttacttctttgagtgttgttgtgctaatggggcacgtgtcttttggcccatttgggnnnnnnnnnnnnnnnnnnnnnnnnnnnnnnnnnnnnnnnnnnnnnnnnnnnnntggtgcaatttagatttgagcaaagtgggtgacttccgagaaaattctagtgggtttgagaatttgtttatagcaattgagaatatctccggacttgtgtatagataaaacctgagatttgcatttgatggttcctggacttgtggaaattctatatgacaatggattctacattttagtataagtgagtattatagttgtggtatttttgaaagtgcttaagaagaatacagttgcttatgggtcgtagggcgttgtggttctatgctaaggtttgtagggtgagttgcggttaaagatcgtggtattttagcaagaagaagtatcaatctgaagacaaattcgaaagggactcggagaaaataggacaactgggtagtaggttggatcagtatggtaatggatatgatcggttctttgggtgcttatgatgtgggggttttctacaggtgctttgtggcaatacacctggacttggcgacctgcgtggcttggtcgagttagaggaatttagttttaagggcttgattatgtgcaaatggattccaaagtattcttgatggtttctaccggtgtggagaacgtgttgtgtattgtgatttcctcctggaaagaagcaagagaaaggtttctaactaaaatggtatgtaaattattggtgactcaaagttgataataagattcttgtgcttttcacatgatggcaagatagatgttatgtgttgtacgaaagctagattttcatgtacaaggtggcagtacagtcttgaagagaaggtaacgaatgttggacaacatggactgtttcaaataactagatgaatactattactacttggtgttgtatgagaaaggagcggacttcagaaggcgcattgtattttgagttacagatgtataaattagtattgcggtactcacatggttgatagactactgatattcaaatttttgtcaagtggcacggaagatcttttaacgtatttctcgtgggatgattgtgtatgagaggggtgttaggcattcaggcgatggagatggaatcaaatatggtgattcgcgtgttctacggatttggagattaggagttcctaagagcagattatttcatggttgtggactgtgaagttgtggccggagctagccagatgataaaatgtgttatgattcagtcattatggattttctgagggattgttatctatttttgggtaacccgagttgatttgggggtccataggtaggcccaattaagatgtgtattctacaccggccagaatggttggctccatgctgctattattgagggatgtgtcattcagttgatgttgaatttattcgtattctcaaatgatctgtgagttactcctttatgctacaaggagttgtgattcattggttatgtgcatagattgtgcaattctatttgagctttatagcggaatttgagtgtgatgagtatttgggtattgcatgatcgatagcgtaatggttatgtcctttcaggttttgtgtggtatttttgtcattttcctctccgtcgttattaatttggatcaggttagcttggggtatataatatgaacctcgtgttagaatcgggtgatggttctacggtgtatgatgaattttctgcatttcgttgtgctggtacttgttaatctggcggggcagttctctcatttgagtcattttccatgactgggtacatttgaatgttgcgtattggttcacggatggcacgggttgtggctccgagttatattggtgcagtatgtctatggaacagttatgtttagtaatataaggtcattggacctggaatgggtactattaggtttaatttcggtatatttgggagtataatattgaaagtcggctcagaaagtgattatggttctggttggggcgagagatatccatgtcttgttgatctgataaggggttacgagattctgcgtgtttcttttattattaacagtgtacgaaggtgtggggatgaggttttgttcgatatggggtttgatgctagtatttggttggtttgaagtagtaactgtgatcatgaatggtgctacgggcgggcgagttgtctaatattctggataaattatatccgtgattatagttttggatctatgtagcttattcagactcatacatcgtgtaaatgtaagattcgtgtcttgaaaagaaattctgaaagttgggatttgaattccaaggtttttgggctaaggttaaattaaggattttcagttgtattgtgttgttaagctcatatggaaaagggtgtcgtggatttacccccgggtacgtgcgtgataagatggaatagtgatttggtggcttgaaaacaactcatggcacgttcgaggacgaacgtatatttaagtgggggagattgtaacgaccccgacggttgttttgggtatttacgctcctttcaactaattaaagttttgaataactttatacgaggtattatgacttgtgtgaattattgattttggttttaaggtatttcggagttagcttggaaggatgaattttcatgttggaagcttaagttgaaatagttgatcagatattgacttatgagtaaacgacctcggaatttaatttgatgattccaatagctccgtatggtgatttcagacttaggagcatgtccgaaaaattatttggaagtccgtagtggaattaggcttgaaatgccgaaaatttaattttgggaagtttgactggcgggttgactttttgatagtgaggatgaaatctgattctggaaatttgaatagcttcgttatgtcatttatgacttgtgtgcaaaatttgaagtcattccggattgatttgatatgtttcggcacaagatatagaatttgatagttcaaagttcatagattttgatttgaggtacgattcgtcgttttgatgttttttgatatgatttgaggcctcgagtaggtccgtgttatgttatggaacttgttggtatgttcggacgtggtcccgaggacctcgggtgtgtatcggatgcttaaccgatcgaatttggatttggaagaagagctgaagcagctgggctgctggtgtgatcacacctgcgcgaaaaagggccgcaggtacgagctcacagatgtgaggaattagtcgcggaagcggaaaatgcatgggctggccaggcaccgcgggtgcaaaaaattttgccgcgggtgcgaagactgcaggcgcgaagaaatcatcaccggtgcgatgaccgcatgtgcgaagaaatcatcgccggtgcgaagaccgcaggcgcgaagaaatcaccgcgggtgcgaagaccgcaggtgcgaagaaatcactgcggacgcgaaaatcctggacagaatgttaaaaacagagggggttccgagttttgccatttttggaccttcaagcacggtttttggggtgattttgagagagaattcaagggaaagttgaggtaagtcacttgtgatcatgtctactccataatattgaattattatcgaataatccgactagattacatgtttttgaggtgtaaatcgggtgtttgaacttagggttttgaaaataagatttgaagatttggaggtcgagttgaggtcggattttggtaaacttagtatggttagaatcatggttgaatgggcttccggattttataacttttatcggattttggggcgtaatttctgatttttggaaaatattagtattttgatatggaattaattcctataatttttgtgggctgaataaaataaattgtgactagattcgagccgtttggaagttgatacgcgcagaatggaatttctggagcattgcttttcttgctcgacatttgatttttgcttgtttgaggtaagtaactcttctaatcttggagctgagggtatgaaccctgaatatatgtttttcgtgacttgttgagaggtgacgcgcatgctaggtgacgggcctgtgggcgagcaccatgtgaattgggactgtgttgtttctatggcactgtatagtggtcctaatttgttaatgttcgtgttttcactgtgtgataaagtaattaagctgtaaatcatgctatataccatgtttaggctttatgacgatattgctaggacctgacctcatgtcttccagactagcctgacatcaacacacagaaatcacatctcgcacctcatccaggaatcacaagccatcgatgcacaactgatactgagatcccatgtgcacatgcgaatgcgtggaaggaattcaaagtgttacacttcaagctgaatcaataccgcacgataagaattcaagaatgtgaagttttcctaaaggttctgcagcctctcgaagataagtacagacgtctccgtaccgatccgcaagactctactaaacccgctcatgactcatgagacctatgtaacctaggctctgataccaacttgtcacgacccaaaatctaaccatggtcgtgatggcgcctatcgtgttacaaggcaagcctatttcccaaaatattactactaaatcgattataagaatttaataaaacatttccaacatttgaattttttcataaactaaatcaaccctaaatataattatagaaaatacggaaacgagccccaaacattggggtttcactaagtcataagcgtctaaaactataaactaagatatataaactatctaactgtccaaaagaagaaatgacaaaaggagtaacaaggttttgcggacactagcagctaccttgtaatctccacagatagccggtctgaactcaacgatcgccgcgctctaactcacctggatctgcacataaagtgcagggtgtagtatgagtacaaccgacccactagtaacagaaatacctaaggaactgaggagtagtgacgagctaagtaaaacagtccaattatttattttcacaatttaaaaataaacagaaataaacaggtaaattccataactcagtaaatgccacaaagaagtttaacagataaatgcagcaacaacacaaataaatacaacctcacagcagtgccactccatcactcatcactcgcactcagcactcaacactctataggtacctgcactcactgggggtgtgtacagactccggagaggctcccaaagcccaagcactaagcacagacagctcacgtgccataatatcaatacctggatccgcacggtcagctcacgttctacgcggacaactcacgcgctatggtatcaatacctggacccgcacagtcagctcatgtgctatgcggacagctcacacgctatggtattaatatcctcacaaccaggccctcggcctcactcagtcatgtacctctccagcctcacaatacaccacaaataaggggacatagcccacatcaagtatcacaacatatcagcaaaataatagagactgaggtaaacatgtacaataatttctatgannnnnnnnnnnnnnnnnnnnnnnnnnnnnnnnnnnnnnnnnnnnnnnnnnnnnnnnnnnnnnnnnngtgcaaagaatgtgagcatgaataaagcgtaagcatgatctctaacataaaggcaaacaagttcaacaacaaataagcacataaccacaaataataaccattagtcctcacagcctcacgggatggaccaagtctcaatccctcacggtgcacaccacacgcccgttcgtaacctagcatgggtatcgcttccaaacaatcacgagatgtcaaatctctgggtctataccctcacggctagagttaaaattgttacttacctcaacaacgtaaaatcctattccggaatgccctcgtctctggactcagtatccaaaagctccgaatctaaccaaaaatcagaatactactatcaacatgtgctaaagaatcgaattccacaataaaaactacaaaatatgccaaaaatacgaaatcggccaaaatccggcccccgggaccacatttcagaaccagtcaaaaatggtagaattagaactctcatcctctcccgagtctaaccatataaaatttatcaaaatcggactccgtttggtccctcaaatccctacctaaaactctccaaaactcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggattcatgaaatataaccaaagtcgagtagagaacacttaccccaattcctatggtgaaaatcgcctccaaaataacccaaagccgagctccccaactcaaaatatgaccgaataaacaaacccttgttttatatatttgtctgctagctattctgtctcgtttctcatacccaacaatcctgaaactcgctttttatgcctcaaatggattacttgtgaaatgttagtcaagttaggattttgaatcacttaatttgaccttataatgaaggagatatgtatgttttaatatttgcaaatagaacagatttttaaataccaattcagtggcaagttcgtaattaatctgaaaaatctggcaacccaattgttttagtaaaaggactataaattcctcatacgatgcccaaattcgacgaatctttttattatagatccgtaattacgatacggatctaatgctttgatcaaaatagaaatcggagctcatttgcttaatgtggtaccatttatgctggaagaaacgacgtcgaaacataagaaaaacgagcacaacgcactccaaacctatctgaaactcacccgaactcctcgggaccccgtacgaacatactaacaagtcccttaacaaaacacagaccaactcaaggcctcaaatcatgcataacatttaaacaacgaaacgcacctcaaatcaaactaaataaactttcaaactttcgacttccaaaaactcgcgccgaaacatatcaaatcaactcggaattaactcaaattctgcacacacgtcacaaatgacactacgaacctactccaactttcggaattccattccaaccccgatacctaattttccacttccggccaaaatcgtcaaatttctaactttcgccaattcaagcctaattctaccacggactttcaaattacattccggacacactcctaagtctaaagtcacccaatgaagctaaccgaatcataaaaatcccaatccaaattcgtttactcataggtcaacttctggttgactgtttctaacttagctttctaactaagagtctaagtgccttatttcactcctaaactactccgaacccaaactaccaattcaaaacaactcaacacagctgaaaacacacaaataagcagaaatgggggaaacggggttataactctcaaaacgacgggtcgggtcgttacattctccccctcttaaacaagcattcgtcctcgaacgagccaagagtggttctcaaaaccatcaaaccactggataaccttaccttgcatatacccgggggtgatcccatgccacccctatccaatgtaggtccgataacacaacataagtgaagtttctcaactcaaccaaacccacgagccttggatctaaatcctgcaacctacacactgtataagtctaaacaagccgtctccagtcatagccataacccaagatgaattcacatggtccatacgccagtagaaaatacacatctctaaccgtggtagaaagcatcaagaactctctccgaaccccatttgctcaaaaccaatccgtcaggactgaatccttctaactcaaccaagctatgcaggccaccaaaaatccaaggacattgccacaaaacacttgtagaactcattacctcatacacacccaaagaactaatcatatccattaccatgccgatccaacctactaccaagatgtcctatctatccaagtcccttctaaattaccttcaaattgatacttcgccctgccataacaccacaatcctcaacccagactcaccacacgagatccaagcataaaaccacaccgccctaaggctcataagcctctgaatactctcttaaatatccccaaaagtaccacaagcacgcgctaacacaatcaacaccttagtgctcaagctacagtcaaaacccggcctcatgtcctccagactagcccgacatcaacacacagaaatcacatctcgcacctcatctagggaatcacaagccgtcgatgcacaactgataccgagcgcccatgtgcgcatatgaatgcgtggaaggaattcaaagagttacacttcaagttgaatcaataccgcacaataagaattcaagaatgtgaagttttcctaaaggtttggtagcctcgcgaagataagtacagacgtctctgtaccaatccgcaagactctactaaacccgctcatgactcgtgagacctatgtaacctaggctctaataccaacttgtcacgagccaaaatctaaccatggtcgtgatggcgcctatcgtgttacaaggaaagcctatttcccaaaatattactactaaatcgattataagaatttaataaaacatttccaacatttgatttttttcataaactaaatcaaccctaaatataattataaaaaatacgaaaatgagccccaaacatcagggtgtcactaagtcatgagcgtctaaaactataaactaagatatataaactgtctaattgtccaaaagaagaaatgacaaaaagagtaacaaggtcctacggtcgctagcagctaccttgtaatctccacagatagccggcctgaactcaatgatcgtcgcgctctaactcaactggaaatgcacataaagtgcagggtgtagtatgagtacaaccgacctaatagtaacagaaataactaaggaactgagcagtagtgccgagctaagtaaaacagtccaattatttattttcaaaatttaaaaataaacagaaataaacaggtaaattacataactcaataaatgccacaaagaagtttaacagataaatgcagcaacaacacaaataaatacaacctcacagcagtataactccatcactcatcactcgcactctacactcaacactcaaaacactcaaccctctataggtaactgcgcttactgggggtgtgtacagactccggaggggctcccaaatcccaagcgctaagcacggacagctcacgtgcgataatatcaatacctggatccacacggtcagctcatgtgctacgcggacaactcacgcactatggtatcaatacctggactcgcatagtcagctcatatgctacgcggataacatgctatggtattaatatcctcacaaccaggccctcggcctcactcagtcatgtacctcttcggactcacaatgcaccacaaataaggggacacagcccacatcaaatatcacaacatatcagcaattaatagagactgaggtaaatatatataataatttctatgactgagtgcaaataatgtgagcatgaataaagcctaagcatgatctctaacatgaaggcaaacaagttcaacaacaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcacaacctcacgggacgggccaagtctcaatccctcgcggtgcacacccacacgcccgtcgcctagcattggtatcacttccaaacaatcacgtgatgtcaaattttcgggtctataccctcaaggccagagttaaaactgttacttacctcaacagcgtaaattcctactccggaatgccctcgtctctggactcggtctctaaaagctccgaatctaaccaaaaatcagaatactactatcaacatgtgctaaagaattgaattccacaataaaaactacaaaatatgccaaaaatccgaaatcggccaaaacccggcccccgggcccacatctcagaaccagtcaaaaaggaaagaattagaaccctagtcctctcccgagtctaaccatataaaatttatcaaaatcggactccgtttggtccctcaaatccctacctaaaactctccaaaactcaagnnnnnnnnnnnnnnnnnnnnnnnnnnnnnnnnnnnnnnnnnnnnnnnnnnnnnnnnnnnnnnnnnnnnnacctcaatttcactttgaaatcattaatcaaatccccaaaacgatgatggatttatgaaatataatcaaaattgagtagagaatacttaccccaacccctacggtaaaaatcgcctccaaaattgcccaaatccgagctcccaaactcaaaatatgaccgaatgaacaaatccttgttttatatattttctgccaaatattctgtctcgtttctcatgccaaacgatcccaaaacttgctttttatgcctccaatggattccttataaaactttagtcaagttaggcttttgaatcactcaatttgaccttacaataaaggagatatgtatgttttaatatttgtaaatagtgcagatttttaaatacaaattcagtggcaagttcgtaattaatctgaaaaatctggcaacccaattgttttagtaaaaggaccatacattcctcatacgatgcctaaattcgacgaatctttttgctatggctccgtaattacgatacgtatctaatgcttcaatcaaaatagaaattggagctcatttgcttaatgtggtaccatttatgctggaagaaacgacgtcgaaacataagaaaaacaagcacaacgcagcccaaacctatccgaaactcacccgagctcctcgggacctcgaacgaacatactaataagtcccataacataacacagaccaactcaatgcctcaaatcatgcatagcaacatttaaatgacgaaacgcgcctcaaatcaaactaaatgaactttcgaactttcgacttccaaaatctcaagccgaaacatatcaaatcaactcggaattaattcaaattttgcacacacgtcacaaatgatactacgatcctacttcaactttcagaattccattccgaccccgatacctaatttttcactgccgaccaaaatcgccaaatttctaactttcgccaattcaaacctaattctaccacggacctccaaattacattccggacacactcctaagtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaatttgaattcgtttactcataggacaacttccggttgactttttctaacttagctttctaactaagagtctaagtacctcatttcactccaaaactactctgaacccaaactaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaactcaacacagctgaacaacacacaaataagcagaaatgggggaaatgggctataactcttgaaatgacaggccgggtcgttacacattctaagggcctgggaaattttgccttcccgaacacgaggcccttactgcgttcgcgaagaaggattctactgtgttgggcagaatgttttaaaaatggggctcaaccatttttgagccgattttcttctttcttgggcgattttggagcttcttgagagggatattcacctagcaacttggaggtaagtaaattctacctattgtgagttaaatacatagattatagatagattttaacatgtaaattagtgaaaattgtgggtttagatgaaaaacctatgtgttcataaaaaaaaaaatgagattttaaccacgaaaatggttatggaatgggataaaaattgtatacttgagttcttaaggttatgagtaaagatttcctccaaacattttcggaatccgggcacgtgtgccctagatgaattttaggaattcttccaataagggttgattaattaatctaataattaaattatgaatttttgagtatgtattgattaaattatataatatttgactagtttcggattgatcggcaccgagttggagatttagaatgaaattgtgaccggaaagtgggctttgaaaggaggtacgtatcttgtctaaccttgtaagagagaatttacaccataggtgaattaaattaatgttagtttctaattgtggtggctacgtacgtacgaggtgacgagagtccgtgcatagctactaattatgcttacgtccgggtagttttaggacccaaatcatgaactactgtgatgtgttccaccctacttgttaattaaagtgcctaaattatattagaacttgctagacgattttgtggaagatcgctaatgaaatttgtattattttgtgtattaatccttaataacgttcaagccaaatgcttataaagtatccttctcttcttgtggagcaggccgaatgcctcggcggtagatagatgcatctatggttcatgccgctcgacccttggcagtgtacacgttattctggatcgggccgtacgacctcggcataaatcgtgcttaataataataatacacaatgcttcgatattttgttgtggcttggaaggttcactactagaaaaaggcggattacctgaggatatttacttgagtataaaatccccagatttacctgcggattttcttgccgtacttaaaaattcttaaattgtaaaatattatacatgcgaatttgatttaccccgataaatccgcaggtatttttggcaccattaggcgcaaacataataactggggaattacaaagggacataatctctaagtcctctatccgtaggtgaattagtaggtaaaacatatttttatttcgtttatggattggcagaaaatttcccaggtaactgttatgcgaagttagctgcagattagttcatggggatgtacctagggatatagttttcctggggaattatccggggatagttttttatggttttacatgggaaatatttcctagggaattaccaggggatttattactgtgaatattttcatggggatttatgtggggacttatatacttgggggaattacctggggattatctattgcggtgctacttggaaattctttaatagagattcacatgtgatttatttacctagaaaacattcctggggatttacctacatatttatttacccggtaaaattgcctggggaatatctcgaagcggtttcacctaaatttttctgtggagaaatacccgaggatttaatttcttgtgttattagttggggatttgtgtattgcgaatttagctagagcatttgtcttggtgatcattttgctgaggatttctgtcactctggttttttttttttcttgcatcaggatttacttgctccgagcttgagtcatagtactgtctttgaaaataacagatggtgtattgagaatttaattacaaactgaattatttttgcattgatttgaaatttattatctctttgtatttaagtttattgtctctaattcttaaaattattaatttagctatgcatgtataaccgggaataaaaaaaatatataccaagctaataagagggcatgtgggtgcaatctgttggtgcaatctgttggtggaaagaaaaaaggaagggttgcaggccttggctccttgggtcgatatgtaaaacacttaagcattcaacatctactttaccagaagaaattgatgagataattaaatctcaggtgcatgcttccaatgttgacttatatgttcagctgtaagaagagagtcacaaaaataaaaagatgaggaaagaattagacttattgaagaagtatgtcaatttcaatgcatcatctttaaatgagttatcatctcaagaagacaatcaaggatccgagaatgaaagtgacgatgactctgataatgtgaatgaaagtggttctaaccccggtaacgcgaatgaaagtgactataatcatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtttcgcatttgagatatttttcttgttcattaaggattatatgatattaatattaacgttaggaatatttttttttcttttctataattatattagacatttgttgaatgattatgataatatagttgaatcgtaagaatataagctagaataaaataaaaataacatcttgaaaatgcatagatgacttgcgaattttcatgggaaattattttgaaacgtgtcaatttatagggtaatttacctgtaaaaatatttacatggggattttcttaccaatattacatatggattttcctacgaaaacacaacttgtggattttcttggggatttcaaatagttcttttgtttcattggaaatttttacatggtgatttaccaacgaattattacttgggaactttgctggggttttacatgcaacattttcatgggaattttcttgcgaaaatgtgctcctgcagatttcacctcaaaacttcctatggacttaaggattttcatggggaactacttgcggatttcttcctacacaaaatcacaagaaaaatccttttgttacgaatttttaccgaaatattattgcgatatttttgagatttttccctgataaatccgcaagttacacggggatacaaaatgcccaggtaatttccctggggatatgtaaattcccatgtaataattagctacggaggtttttccaacagatttattttgataggaaattccgcagaaaatcaaagtacctgcggatttctttatcttattccttggaaaagccctaggtaatccacctttttctagtagtggttacagcttgcaaagataaaagacttattggaaattattaaattgtgaaagaattatttgctcctgcttgctaaattgtgaaagaattatttacataacccgtgtttatttgtaactatccgaccggtcgttttgagcattttcacttcgctcgattgtttgagggcatgagtagctctgtaggatgtattataacgtatgtgaatcatcggttttggctttcaggttattcagaattgatttggaggaatgattctcagctagaagctttaaatttgaaaggtttgactaggttttgactttttagtatttgacctcggattgcattttttgatgtttccttagccccgttgggtgattttggacttaaaagtgcgtccgaattatggtttggaggttcgtagtagaatttggctcgaaatggcgaaagttggaattttggaaagtttgcccgggactggactttttgatatcggggtcggattccgattccgaaagttggagcaggtctgtaatgtcaaatgtgacttgtgtgcagaatttgaggtcaatcgtacgtgatttgataggtttcggcatcggttgttatttgtgttttgaggcctcgagtaggtccgtgttatgttatgggacttgttagtacatttggacagggtcctgagtagctcgggtgagtttcggacaaggttcggaccattttcattccatgttgcattgctgaagattttctagttctggtagaccgcacctgcagactgtataacgcatgtgcggagccgcaaaagcggcagtgccatcgcaaaagcgagaaagagagctgggcgtcaggatcacaggtttcgggtgctaggacgcacctgcgcaaccacagatgcggttcaagtgcacagaagtgttatcgcagaagctgcttaaggaccgcaggtgcgagattttgctgagtgaggctgtttcgcagaagcgagtaatttccgcagaagcggtggtcgcaggtgcaatgaattgtccgaaaatgcgaaaatagatgggcagaacctataatttgacgtctttggtttctaacttcattttcggattttggagctaaaattgggcgactttggagaggagattttccacacaacttggggtaagtgttctctactcattgttgatcttatatcacaaatctaccctcatttttggtaaatggattgtgaattttgtagaggaaattgggggtttttccctaaagtttcataatattaatttttgaattttgaacttcgaattggagttggatttgagtgaaactagtatggttggactagtaattgaatgggttattgaatttattaaattttgtcgggttccgaggtgcgggcccgggttgggattttggtcaattttgggattttgattcaagatttgatcttttgcgatcgggattgattcctttagcattatttgatgtacttgagttgttttggttagtttcgagccgttcaaatgtcggaacatgcgggatggcattttggagcattgcttggcttgctcggtgttagaattggcttgttcgaggtaagtaactcttctaaacttagtgttgagtgtatgaaaccacgtaatacgtgttatgtgattggtattaaggtgacgcacatgctagtgacgggcgtgtgggcatgcaccatgtgaattgggactccgttgtttccatggcactgtatagtggccctattgttgttgatgtccttgttttctccatgtgataaagtagttgagttgtcaatcatgttagatatcatgtttaggctttatgctgatactgttaggacccatagtggtcgtttcttgctgtcatctcactgatttcattgatatttcgtactcagtcatatttattcattcatatgatatctatatctcagttgttattttttgatacatcatatcattatcgtcgggatagtttcatgacattgtgagcccgtgagtgagactggagatattgatgactgagtgaggccgaaagcctgattatgaatgacagttatgggatcgggctgcacaccgcaacatgttatattattatatatgatagtgcttaggctataggagcccctccggagtcagtaacacacccctagtgagcgcggatgatactattgaaggatggatttccctgggcatggatttgtccgaagtacttactacctggagatggatttctccacagggtttgattgccctttttccttgatactgggtgacttatagtcagtgttgtatatgttctaggatggatttccctttatgggccatatacaatatcgaggggttgagcatgatgagtggaaagtgtgagacagtgagattgagtattctgagaggatgagtacatgattcatctccgagatacatggcattggcatgcacacatgacatacaggcatagagatgcattttttctcatgttgtacggtaccatgtcattcatgaatttttacacacattgatatgtgggcatagagaggtatttcacatttgctatctggaaagaaaacgaaatatctaacttattgtggaaaggatttttggtaaaatttacggttttcaaattatcccatattttacgacgattttggtaaaggatttaagttttcactaatatttttgaaaagtggaactattttcggaaaactgtgaaaatgctgagcatttgtatcgctgagttactttcttatttatattctctacgttgttatgaactgctattgattattagggttggacccgacctatgttccagctcgtcactgctttcaacctaagtttaggtttgttacttactcagtacatggggtcggttgtgctgatactacacttctgcacatttcgtgcagatgttggctgatgttgttgctgtgctcgatagttgccggatttgaagatgtacctgtgttcctattaaagctgcctcttcttcatggtagccttagatttatgaaaaaacaaactatgtttatgtacctttcaaacagaagatgtatttacttcacatcagctttgtaaattctattcttagaagctcatgattgtactaccagttcttgggaaaatgtattagttttatataatttcttttgaataattgtattattaatattattggaattggatagttgttaattggcttacctagcgggttgggttaggtgccatcacgactagttagattttgggtcgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagattggtatcaaagccttaggttcgtaggttctacaagtcatgagcaagtgtctagtagagtcttgcggatcggtatgatgacgtccatacctatcttcgataggctacaggacatttaggatatatttcccatctttctttcattatcgtacggtactaattcagcttgaggcgtaatacttcgaattccttccatgcattcgtatgcgcacgtgagtgctcggtatcagctgtgcatcgacggttggtgatttcctggatgagggcaagatgtgatttctgtgtgttaatgatggaccagtctgggggacttgaggctgatttttgactgtagctggaacactgaggtgttgacggcgcgagcacgtacttttggatttatatgtccggtagtgtcccaattagtagaattggtggttggatggctatgtgatgagtatgatgtgactggcaagatgtgttcatatgatttgaatgtgacgagaagggtttgcttgaggtgtagaaagaactatttagtgcttgatttccatcttgatttgacatatagtctcgagttatgggtatgttgaaggatccttttcatgttgttcagttgaggagtggagtagattttcatgtcatgatatgagttcagactcaggaagattaagtggttgcgtaatagttatgattgtggaagtgtacagaaagatgtcagtttgaggctaagcatgtgggttatctcctgcgggatgtcctgaggttatgtgatccctatgttattttgttgagagttcccttttaccagtaaattatatgtagtgcaatttgagtttggatcgcttgtggaagttggcttgactgttacgaggatgaatgcaaaatttgcaaaatgatttaatgtattatgtggtatgtgttacatgagcttaggaaggatttagttgaatcctattgcggtgttatgccagtatggggtggctatcgtaagttatcatatgctttattccttggccttgagccaagtgggggagtctactatcgacaggttgattcggttatgcgttatattggtttcagtttgaggtatactggtgaatcaattatgacttacaaaggttgagatcgagggtgacttgagtaaaggaagttttggataagggttgtgttattctttatgggtatatgagaaacattggatgatttagttgttatttgtaaaggatgtagcatgcatggggtagggattcactcggttgctttggattacttccttgggtgttgttttgctaacggggcacgagtcgttcggtttgtttgatcaatttcattgagagctgagtagagtggaagactctcaaggatggttctaatggattaaagatttaaatatggcagttaagaattttgcggatttgtgcatggctaaaatcagagagttacactggatggtgtcgagaatcgaagtatttctacatcattgtggattctacattttagtatcaggaaggcaagatgaacagcttgaaattcacataaggtctcttcgaagttggtatcttgattgtggtacttttgtggcgtttaagagagcattcagcggcttatgagccttagggcagtgtggttttatgctagggtatcttgtggtgagtcttgggttgaggatttaagtattatggcaaggaagagtatcaatctaaaggtaattcagaaggaactcggagaattaggacaatttagtaacgggttggatcagcatggtaaccgatgcaattggctcttttgctgcttatgatgtagtgagtttctacaggtattttgtggagatactcttgggatttgacggcatgcgtagcgtggttgagttagaggggttcagtcctgacggtttggttttgtgcaaatggggttcagagagttcttgatggtttcaaccacggttagagatgtatatttcctattggcgtgaggagcatgtgatgtatagtgattttctcctagaggtgatcaaatggaaagttcttggctaattaagtatgcagttgcttgtgactcggagtggattatgaagatcttgtattttttttgtatgatggcatggtatgtgcggtgtgatgtgtatgattgagtattgcatgtgtaaggtcatgactaaattttaaagggaaggtcatgagtccttaggcaacatagacagtttcggatgactaggtaaatgataatactatctggtatggcttgataagggtatacatttcagaaggggcaatgtgttttgatttatggatacttcattggtattgcggcactctcttgtttgatcgactgctgatgttcaaattttgctttgtggcatagaagaattatagaagtattcctcatgggatgatcgtgtattggagtagtgctagacacttaggtggtggagttgtgatcagatatggtgattcatgtgttctatggatttggagactgggagttctcatgagtagattgtttcatggttgtggactgtgaaaatgtagacaaggttagttagaagatagtatgtgtttgtgatttagttattgtgaactttcggagggttatttatctattgtgggtgacgagagttgatttggggttcattggcaggcccaatatggaggtgggttctgcaccgagtcagattggttggctccatactgccattattgagggatgtgccattcggttgttgttgagcttattcgtgttctgaaatgacttgtgaattactcttctatgccacgagaagttgtgattcgttggttatatgcacatatggtgcagttctatttcagctttatagcaaaatttgagagagatgagtatttgggtattgcataattgattgtgcattggctatgttctttccggattgtggtattgtgttatttgctctccgtggttatggtaatgcactttgggtacttgatatcgaatttcacgtggttattgattttgggcaaggtggctcgaggtatataatatggaccagcgtttggatggggtcacacattgcagcgaagttatgttgggatatgatcctttatgttggattcatgtgttttggttctacagtgtgtgctaggctcttagcatggtgttgtgatggtacttgttaagctggcgggacagtcctctcattttaggcattttcaggattgagtacatttagaatgttcctatttggtgcacgggttgtggatttaagctgtgttgatgtgtcatgtcactagagttattattttagatgggatgaggtcatcgtactagaatgggtgctatcagatatgattgcagtatatttggaaggatattgatgctgatcggcttataaatttgctataattcctatcgaaggagaggtagttccacaacttgttgatctggtgaatggttatgagtttctgcgtgtttctttcatcgttggcagtatatgaaggtgttagaacgaggctttgtttgataaaaggtttattaccggtattgagttattttgagcagctactgtgattagaaattatagctatgagtgtttgagttatgtggtatatcatgtgatttcatcttgagttatggctatgactggattcaacttgttcagacttatacaggttgtagatgcgaggttctgatcttatcaaaaatttcggatgtggaaattggaatctaaagcttatgggctaggttggattaagaaatttcaatcatgttgtgttatcagacctatatgggatagggtgacgtgggatcacccccaggtatgtgcatggtaaggttacacgacgatttgatggcttttggaacaactctgggcacgttcgaggacgaacgtatgtttaagtgagggaggatgtaacgacccgaccatttgttttgagcatttgcaatttgctcggttgtttgagggcaagaaaagctccgtaggatgtattatgacttatgtgaatcgtcggttttggctttcaggttattcagaattgatttggaggaatgattctcagctagaagctttaaatttgaaaggtttgaccaagttttgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatggtttcgttagctccgttgggtgattttggacttaggagcgtgtccggattgtggtttggaggtccatagtagaatttggctcgaaatggcaaaagttggacttttggaaagtttgaccgggagtggactttttgatatcggggtcggattctgattccagaagttggagcaagcccgtaatgtcaaatgtgacttgtgtgcaaaatttgaggtcaatcgaacgtgatttgataggtttcggcatcggttttagaggtggaagtttcaaagttcaatgatttcgaattaaggtgtgattcatcatttcgatgttgttatgtatgttttaaggcctcgagtaggtcagtgttatgttatgggacttgatagtacatttggacggggtcccgagtggctcgggtaagtttcggatgaggttcggaccattttcattccatgttgcattgctgaagattttctggttctagtatgaccgcacctacggagtgtatagcacaggtgcgaagccgcaaaagcggcactgccatcgcagaagcgagaaagggagctaggcgtgagaatcgcatgtacgggtgcttggacgcacctgcgcaaccgcagatgcggttcaagtgcgcagaagcgcgatcgcagaagcggcttaaggaccgcaggtgcgaggttttgctgagtggggctgtttcgcagaagcgaggaatttccgcagaagcggtggtcgcaagtgaggatcgctggggcagaacctataattcgaggtctttggtttctatctttattttcagattttggagctcggattgggagactttggagaggagatttcccacacaacttggggtaagtgttctctactcattgttgatcttatatcatgaatctaccttcgtttttggtaattggattgtgaattttatagaggaaattggggagtttggcctaaagtttcataatattaatttttgagttttgaacatcgaattggagtcggatttgagtgaagctagtatagttggactcctaattgaatgggttgttggattttataaattttttcgtgttccgaggtacgggctcgggttgggcttttgattcaagatttgatttttttcgatcgggattgattcctttagcattgtttgatgtacttgagttgtttttgttagtttcgagttgttcggaggtcggaacacgcgagatgtcattttggagcatcgcttggcttgctcagtattggaattggcttgttcgaggtatgtaactcttctaaacttagtgttgaaggtatgaaaccccgtaatacatgttatgtgattggtattgaggtgacgcacatgctaggtgataggtgtgtgggcgtgcaccatgtgaattgggactccgttgtttccatggcactgtatagtggccctatttttgttgatgtccgtgttttcaccatgtgataaagtaattgagctgtcaatcatgttagatatcatgtttaggctttatgccgatattgttgggacccatagtggacgtttcttgctgtcatctctctgatttcattgatatttcgtactcagtcatattcatgcattcataccatatctgagtctcaatttttatttattgatacatcatatcattgtcgtcgggctaattttatgacattatgagcccatgagtgagaccggagagattgatgactgagtgaggccgagagcctgattatgagtgacagttatgggatcaggctgcacgccgcagcatgctatattgatttatgcctggatctggcgctagggttgtaggagcccctccggagtctgtaacacaaccccagtaagcgcggatgatactattgagggatgggtcttcttggacatggatttgtccgaagtacttactacctggagatggatttctccacagtgttggattgccctttttcctcggtactgggtgacttatagtcagtgttgtatatattttgggatggatttctctgggccatatacagtaccgagtggtttagcatgatgagtggaaagtgtgagacagtgagattgagtattctgagagggtgagtacatgatgcatctctgagatatatggcattggcatgcacacatgacatacaggcatagagatgcatttttcctcgtgttgtacggtaccaagtcattcatgaatttttacacacattgatatgtgggcatagagaggtatttcacacttgctatctagaaagaaaacgaaacatctaacttattgtggaaaagatttttggaaaaatttacagttttcaaattatcccatactttacaatgattttggtaaaggatttaagttttcactgatattcttgaaaagtggaactattttcggaaaactgtgaaaaagctgagcatttttatcgctaagttactttcttatttatatactctacgttattatgaactgctattggttattggtgttggacccgacctatgttccaactcatcactgatttcaacctaagggtaggtttgttacttactcagtacatggggtcggttgttttgatactacacttctgcatatttcttgcagatgttggtgattgttgttattgttgtgctcgatggttgccggatttgaagatgtacctgcgttcctattgtagctgcctcttgttcatgatagccctaaatttataaaaaaaaaaactctatttatgtacctttcaaacagaagatgtatttacttcacatcatctttgtaaattctattcttagaagctcatgattgtactaccagttcttggaaaaatatattagtttcatataatttcttttgaataaatatattattaatattattggaattggatagttgctaattgaattacctagcgggttgggttaggtgccatcacgattagttggattttgggtcgtgacattatttaggatttctatcttaataacattgacccatagtatgtgtcgaagtcgacccctcgtcgctacttctttgaggttatacttgatacttactgggtgcgcgtttatttacgtactcatgctacatttgctgcacttttgtgcaggatctgaggcaggtgcatcaggtggtcctaccggcgcgcatcgcagatatcccaaggcatagtgatgagctacttcctgagccgttctgcaacccctagaatctctcttttgtatttgtattctgtctattttatgttcagacaataactagaattttgtataatctactagatgctcatgcacttgtaacaccaggtcttggcacacacactagtagaattgtggtttgggactattacttttgttatgaatgcactcaactattttgttttatttatttaaacttatttattttcttaaatcttgcaaataagaaatcttaaattactcgaaaacttattaaaagaggaataatttgtctaatccactatttggcttgcctagcggtaacgttgggcgccatcacgatctacatgggaaattgggccgtgacatgtgaactctatgttaaaagggtaaaaaaggcgaacgacatttcgctaaggactttctatttgcgcatgtaccccatctcgacgagtgattatttttaaaaaaaaatagatattccattaaaactgtttaagattataaataaaaaattcagctcaagggttgataaattttgatcatatatatatatatctaactcaataaaggaagaaattttgcttcataaaattcatcgatcatcattccatatatttaacttaaacttagttttatttttatagttttatcatctcaactttacaaattatcatgcctccatttcagtttatacaagaatatgtagcatttgaaaatttaagagtgtgtacccttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattaatattcaaaataggtgtttgaaaaaattattaagctcctgaaaataataaatatcacaggtaattacaaaacctgtgtttataatttaccaccaattgagaatttacccacattaccttttggattccactaaaataaaattcgtgaagtggttgatttatcaaaactaaaagcggaaaaaatcttaattaattagttgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatggtatggtttctctctcatttttcttttattatcctatatattttcttagtaaaccaatctcattattgaaaaaccagtgaaaaataaatcattgtttaagtaggaaaggggtccaattttaatatgaaatatgttgttacatgttttgttttttgataacatgatgaaaattaagcttttttgacactatcattgtatgaaaattaaactcttaatatacataaaagatgaaacttacttgaaatttgtgatatcatggtagaatagcctataaaagttttgtgacagtggtgaacagtaggcagcaagcataattaatttttacttaaaaaaaaatacaagagtacaagaccgtactccatttgaaccaaaaagaaaaaagaagaaaagaagaagataaaacgaaaggacgttaatgatgaatttaccttccaactgtagatgatgggagacaaaacttgttttgtgcttttatagattatattttgaatccattcgatacaattcacataattcagtgatcaagagttttcaaacctttgtgagattattgattcataatttcttttaattttcttttttgaaactcattattaaaaattctgcctctgccaccagatgttagcatatcaaagcactacggctttcattctttttaattccaagcgtgcatgtctcttgttaaaaactgttgcttaactttgtatgagaatttcataagataaaagaagtgcttaactttctattagaattttttctattatatagaagagagaagagaggtcgaccaagggtataatggtcattttaaaaatatattagtgcattgtttgtttgttgtcacgacccaaaatcccactacatgtatcgtgatgtgacttagtctctaagactaagtaagccgaatataattacaattcaagccaatttttttaaaaatataaaccaaccgcggaaataattacaaacaacctcccaagactggtaatactaagttacgaactctaactgaatacatgaaatgatctcaaggatcgaatactcaatattgtttgattaataattaacagtacaataaaatggaaggctccaagggactgcgacgaccaagcagctctaccttgaatccttacgatcacactctaactcagtacaagtctgatatctctaatacctggctctgcacaaaaatgtgcagaagtgtagtatgagtacaccacagtcggtacccaataagtatccagactaagctcagtggagtagtggcgagatacagtaaagacactcactagtctaataacctgtgcaatatagtatacaaaaataataaaaaaataaataacaataatgacaacactaatcaaccagtgatatacacaccagggcaacacaaacaccattaatattgctcaacaaataataagtacaagtacacccaattaatcaagtccttcaaatataaatccttcgcctatatgcttctcaaataataatcttcacgatacaatgctttccaataaatatatttaggatatactcccttcaaataaatatctttcaaatataatcctttcaaataaatctctttcaaatataattccttcaaataaatattttcaaataaatctctttcaaatataattaattcaaataaatacctttcaaacataattgcttcaaataaatatctttcgaataaaagtcaccatgtgacctctcatttcaaaatcataaaatacggatctcagctcacgttcatatttccacgacacttcgtgcaaatttttctatcacaaccgcacgaacaactcacgtgtcaatatcatcatcatttaaccacgacacctcgtgcccacatttcatttcataaaccgtctggcaataaccacaggctcccaatttcaacatagatcagactattatcaagtttaccgaaacaacaagataaattccacaagatataaaaataaacataaggaaaataacaacaccacataaaaattaccaacacaataactccatatcatcacatatcatccctgacaacagccacccttatcgctcctatagccacccttatcactcttataatagcctcatttatccctatgccctgacaatatcaatagccacccgtatcgctcctatagccaccagtatcgcttcgtataatagccacccttatcactccgcccggacaatatcccaacacacataaccacagtgaaattctacccttatacccacataatatcaacagtgaaataccacccttatattctcataataataactcaaatcacacaataatttacatggaatattatcacgacaacacaacacaattaatttctaacacaatttacccaacaaccacaaccaattccaatgatatagtaaaatcaataaatttctcaaaaatagcccaaggctccacacaacatatataaaacctcaaaataatcaacaaagatagaaaatactcagtatagggcaattccttcattaatccaaattcctgataattatattaacacctcagtttaaacttatttcattaattatttgcagatgaaaaatccataatataattattttcaggaaatattaaatcaacaaactcacagaattcacataaatattcaattaataatcacatcaaattgtcatataaaaataaattcaacaaatgagaattgaggcatggaaaatagatgatttaataaatgccaataataatccaatttactacacaataatgcctaaaactttaacccaataaaatttgcacatataagcccgagtacgtactcttcacctcgcgtacacggcttttcacctttcacaaatggcacataagactcgatgcctaaggagtaatttcccttactcaaggttaggcaagatacttactttttatttttaaagttaggccgatatttcaaaattgtcttcttgcttgaatggacctccgaacagctcaaatctatccaaattaattcaattcagtcaatacaaattatagggattaattccatatgaaaatactatttttccaacaaaatccaaaatttaactcaaaaattgcctttgggtcccatgtctcggaatcagacgaaactcacaatatccgacaacccattccgatacgagttcaaccataccaattttatcaaatttcgataacaactcgacctccaaatattaaatattcgttcttgaaaagttttccaaaattcttgtttttcttccatttacatccgaattaaacgatgaatatcatcatggatttatgaaatataatcactttcggatatagcacacttacccgagtcatagtcatgaataactcatccaaaatcgcccaaaaaccgagctccaaaatctcaatcgaaaatggcaaagtgactgatttttggtccttatgtttctgcccagtttcgcaccttcgggcagatttgtcgcacgcacctgcgagcttgcttctgcgagcattgttcacgcttctgtgctgtcacaacccagaattcccaccttcgggatcgtgatggcgtctaacattttacttgctaggcaagccaacaagagaaccgttaagtcaattattattcaattcaatagacactgtcaattaaaccaaaatgaaataaagcctataatatttgatacaattcggatctggagtcacaactcacgagcttctaggattttctacaaacagagtctgaaagaaatacaaccgttctgaatgaaacgatacagtaaaaataggggagatagaaggggactccaaggtttgcggacgccagcagatctaccttgagtctccaattagcaagtccaagctactaagcctcacgatcagctagggcaggtaccaaaatctgcacaaaagtgcagagtgtagtatgagtacaaccgaccccatgtactcgtaagtgttgagcctaacctcgacgaagtagttacgaggctatgacaagacacttacataataaacatgtgcagataacagtatatgtacaagaaacaacaataatagctaaacatgtactattgggagggggacatgctaaagggacacaagatataggagatacaatgtaaatgataaacagaacagtcaacatgcttttagccagtgaaaacaactatatagaatgaagaaaattgctcggcatcacccttcgtacttttactctcaacctcacaatataaatcattagatacggcacggcatcaccctttcgtgcatcaactctcataacatggcacgacatcacccttcgtgcattaacactcacaatatggcacggcatcacccttcgtccattaacactcacaacatggcacgacatcacccttcgtgcgttaacactcacaacatcacccttcgtgcattaacactctcccttaccacataataatgaacaagtaatagcagggaggtagaatcaacaagaacaagccttacttcaacaatggttccacaataccaatatcaactttggaatctatactcaattatcacaaaagattgtaaacacgataagaacgatcaatttagtgtaacgacccggctatccgttccgagagttatagccccgtttcccccatttctgcttctttatgtgttgctcagctgtgttgtgttgtatcgggttggtaggttcgtgtacggagtagtttcggagtggaatgagacaccccgtctcttatttagaaggttaagttggaaaagtcaacacgatgttgacttatgagtaaacgatctctgattggaaattttatggttcagataaatacgttaggtgattttggacttaggagcatgtacgaaatgtaatttagaggtccatggtaaagtcaggcttgcattggcgaaattggaaatttggtaatttccggtcggcaatagaaaatttgacatcggagttggaatggaattccgggagttggattagattcgcagtgtcatttgtgacctgtgttcaaaatttgaggttattcggacaaagtttgataggtttctgcatcagttgtggaagtttgaggtttcaagtccattaagcttaaattgttgtgcgattcatgtttttgttattgtttgatgtggttcgagagctcgattgagtttgtatgatactttaggacttgatggtatctttggttgaggttccggaggcctcgggtgtgtttccgggtaagttttgagtgagttcgggcatttccgaaactcaggtatggttctggtgctttgaatttcgcggacctaagcagaatttcgcaaaccgcataattctgccgcggccgcactccggggggaaaagttctacagattcgctggtccgacttcagaagcctatatcttttgatctacaaggaattttgagatgattcaaaaacgacaattgtaccccttactgtctagtttccagaaaagtaaaaacatcattatttagacatatgtagagaaagttagggccaaaatactaaagcctggcaatgtagccaccaaaaaatacggccgcaccggtttttcgcgaccgcaggacctgggaggcgcggtcaagcttggaattttgtggaccgcatagtgggagttcagagggtgcactatataaatgggatttagggcattatttcatatgttagacctagggagctcggtttgtggcgatgttttatgggtttttcatgaaattcatcggggtaagtgattctaactcgaatttggttaatatacatgaatatatcaatgatttcatcatctgattagtactttgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaattgtagaaacttcataaagtaaatttttgggatttgaatgtcgattcgaagtcggatttgagtgaaactagtgtggttggactcgtgagtgaatgggtgttcataatttatgacttttaacaaattccgagtcgtgggctcggggggcgggtttgagccaatttcgggttttggtctaagtaggtagtttttcttgtggaatttattccattagcgtatattgatagtattgtactgattgtgaatggattcagagcatttggaggctgagtcgagaggcaagagcatcgcgaggtagagatttgaccggttagaggtaagtaacgattgtaaatctagtcctgagggtatgaaaccccaaaattttgtgtcatgtgattattttggaggtgacgcagatgctaggtcacaggcatgtgggcgtacaccgaggggattgtgactcggtcagtcccatgaaactgtaaagctgaataacttgttgatagttatgtgctctatatgtgttgtggaaacttgagtataagtcatgctagaaaccatgtttaggctttatgttggtattgttgggacccacagaggtcgtgtacatgtgaattatctgcttaaattattattttgtagtcagtcacaacttacttgattattttatctcagtctctattattcattattgatgtatcatatcattgttatttgggttgatcttatgattgtggagagccagggagactggagagctttataactgagtgaggccgagggcctgattgtgagttattatactatagcacgtgagttggccgtgcatcacgtgagttgttcgtgtagatcctaatattatactatagcacgtgagttggccgtgcagcatgtgagttggccgtgcggatctttatattatactatagcacatgagttggccgtgcggatccagatatttatattatggcatatgagttgtccgtggagcacgtgagttgtccatgcagattatagcgcttgggctgtaggatcccctccggagtctgtacagacccccaatgagcgcaggtacctactgaatgcgagtgccgagcactgagtgactgggaggcatgagtgaggtgaggtatgctcgagggactgtttacgagttattgtgaggtatgcctgaggggctgtatacgagtgactgtgaggtttgcccgaggggttgtatatgagtgatgttttgcccgaggggctctttatgatttcatcatttttgcttaccttgcattgagccttcgtttgaaaactgttgaaaaatatctttaaataattttactggaactgggtttaaacgagatgttttgattcaaaccctgattttaaaagcatgtggtattttactgagatttcatgatatgaannnnnnnnnnnnnnnnnnnnnnnnnnnnnnnnnnnnnnnnnnnnnnnnnnnnnnnnnnnnnnnnnnnnnnnnnncctttatttattgttgttacttagtgagttggcgtactcacattacttcctacaccttgtgtgtagatcaggtgtagctagacacggtagaggttgatgactattccggttgcagattttctcggtgatagcaaggtcgctgcatggcgatcgcagcgctactcttcttccttttatattcctttagttgtatttagctatttttagactatgttagtctcgatattgtcagataaattatagtagatgctcatgactagtgacaccccgatgtcgggctttttcgttttcgtacttttgttttgatttgaactcttttacaaaggtttttatgttagatagccttgaaattatctttgaaatgaaaatatcattttaatttggaaatgagtcggcttgcctagttccacgataggcgccatcacgatagggttagtttgggtcgtgacaagttggtatcagagcctaggtnnnnnnnnnnnnnnnnnnnnnnnnnnnnnnnnnnnnnnnnnnnnnnnnnnnnnnnnnnnnnnnnnnnnnnnnnnnnnnnnnnnntgacaaggtttagtagagttttgcggatcggtacggagacatctatacttatattcgagaggctgcagaacgcttagaaaaatttcactttcttgtattctgttgtgcgaagtttttgattccggagactaaatttctgttattctattctctcacagatggtgagaacacgtactaccggatcggacagtcagccaccagtgccaccagttagggcctcgagaggtcgaggccatggtagaggtcggggctgaggtaaagttcaaggtgtagctcagaccacagttggaccaacacctgtagtaccactagttgctccagctcagaagtggattccagatatagctgagccgacaggatcagctcagggacaagctgtgcccattgagattccaggccttcaggaaactttggcctagatattggcagcttgcactggtctggctcaggtggtttcgactcaggccgcacctgccacttctcaggccgggggaggtactcatacccctattgcccgtactccagaccaggtagtacatggacttcagataccgcgggcactaccagcccaaccgattgtagctgtgcaagccccggtagttcctgttatggcagatgatgagcagaggagacttgagagatttgagaggcttctacctctaccattactgagtcggaagatgctcagggttttctggataggtgtcaacggatgcttcggacaatgggtattctggagaccaatgggatctcattcactacttttcagttttctaggcctgcactccgatagtgggagactaacgagaggcgtagacctattggcgcaacacctcttacttggcagcagttctccgtggtctttttggagaagttcgtgcctcagtcccggagagaagagctgcgcagacagtttgagcagctttgccagggtgatatgtctgtaacgcagtacgagatgagattttctgagttggatcgtcaagcagtatggttggttcccactgctatggagaggattaggaggttcattgattgcctcacatatcagttgtagttacctatgactagggagagagtatctggtgctacttttgatgaggtagtggacattgctcaacagatagagatggttcgtagccaggaacgtggagagagagagacgcttagaggccctgtggtccaggtgattacagtggtgttccttcagggggtcagttttaccgcggtaggggtcgttcttacagacacgctcaaacagatcctccagttcatcgtggtgcatcagttagccacgggttttacaatgcacactcaggacagtctttattcagtgcactaccagcacagagctctcatcatgcttcgtccgctcaaacatcttcaggtaattcctcgggttatcaggagcagtagttctgttagaggagggtttgtttcgagtgcagaacatttggtcatttcaagagtgagtatcctaggttgttgagttgggctccagaatagattcctcgactgacggcaccagcaccagcagttcaaccacccgcccagccagcatggggtgggggtcaggcagctaggggtcgcccaagagagggaggccgatcaggtggcgggcaggctcgattcaatgcttttcctgccaggccagatgttgttgcctcagatacagtgatcacaagtattgtttcagtgtgccacagggaggcttctatattattttaccctagttccacttattcatatgtatcatcatatttttctcattatctggatatgccctgtgagtccttagttttacctgtttgtgtatctacaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcaaaaatcgtgatgttgacgatgctagggttgccacaggtagaatggaggggttctctaaatcttgttcctagcagggtaatttcttattggaatgcccaacatatggttggaaagggatgcttgtcatatttgtcctttgtgagagatactgatgcagatactcttactattgattcagtaccggtcgtgcgagacttttcagatgtatttcctgcagacctgttaggtatgccacccgatagggatattgatttcggtattgacttggtgtagggcactcaacccatttctattcctttgtatcacatggcaccagctgagttaaaagaattgaaagagcaacttcaggaactccttaaaaaggggtttattaggcctagtgtgtcaccttggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttctatttgtgaagaagaaggatggttccatgagaatgtgtattgactacaagcagttgaacaaggtcacagtcaaaaataagtatctcttgcctcgtattgatgatttattttaccagcttcagggagctagggtgttctccaagattgatttgaggtccggttatcaccagctgaagattcgggattcggatattcttaagacagctttcgggacccgttatggccattatgagttcttagtgatatcttttgggctgaccaatgccccaacaatattcatgcatttgatgaacagtgtgttccagccatatttggactccttcgtcattgtgttcattgatgacatcctcgtgtactctcgtagctaggaggagcacgctcagcatttgaggattgtattatagagattgagggaggaaaagctttatgcaaagttctccaagtgtgagttttggctcagttcagtagtattcttgtgacacgtggtgtccagtgagggtattcaggtggatccgaagaagatagaggcgttgcagagttggcctagaccatccttagccacaaagattaggagctttcttggtttggcggattattattgtcgctttgtggagggattctcatatattgcttcacccttgaccaaattgacccagaagggtgctccattcaagtggtcgaatgagtgtgaggagagctttcagaagctcaagactgcatggaccatagctccagtgttagttctgccatcagattcaggttcttataccgtgtattgtgatgcctcgagggtaggcattggttgtgttttggtgcaggagggtagggtgattgcctatgcctcgcgtcagttgaagacccatgagaagaattatctagtacatgatcttgagttaacagccattgttcacgccttaaagatttggcgtcattatttgtatggggttcattgtgagatttatactgatcaccaaagtctgcaacatctgtttaagtagaaggatcttaatttacatcagcggagatggttagagctacttaaagactatgatatcactattctgtaccatccagggaaggccaatgtggtggccaatgctttgagtcgcctggcagagtgtttggggagtttatcatatctcccagcagtagagagacctttggcattggatgttcaggccttagcgggccagcttgtgataatggatattttggagcctagtcgggtattggcttgcgtggtctccaagtcttctctttatgaccgtatcagggagcgtcagtatgatgacccccacttactcgttcttcaggacagggttcggagatgtgatgttagggatgtgactattagtgatgacggcgtgttgaggatgcatggccggatatgtgtgcctaatgtagatgggctttgggagctgattcttgtggaggcccacagcttgtagtattccatccatccgggtgccacaaagatgcaccaggatttgagacaacactattggtggaggtggatgaagaaggatatagttgggtttgtggctcggtgtctcaactgtcagtaggttaagtatgaacatcagagaccgggtggcttgtttcagagattagagatcccagagtggaagtgggagcggattaccatgtactttgtagttgggctcccatggacttcgaggaagttcgatgctatttgggttattatggatcggctaaccaagttcgcgcacttcattccagttggcactacttactcttcagagcggttggctgagatttacatccgagagattgtttgcctgcatggtgtcccagtttccattatttcagatagaggtactcaatttacatcgctgttttggagggccgtgcagtgagagttgggtactcaggttgagttgagcataacttttcaccctcaaatagacgggcagtacgaacgcactattcagatattagaggacatgttgcgcgcttgtgtcattgactttgggggttcatgggaccagtttctaccactcgcagagtttgcatataacaacagttaccagtcgagtattcagatggctccgtacgaggctttatatgggatgagatgtagaactctggttggatggtttgagccgggtgagtaggctcttgggtacagacttggtccaggatgcattagataaggtgaaattgattcaggagcggcttcgcacggctcagtctaggcagaagagctatgcggacaggaaggtctgtgatgtatctttcatggttggggagaaggttttgctgaaggtatcacccatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttttgaggtgccttataggatagaggagatggcttagaagcttgccttgccacccagcttgtcgagtgtgcacccagtgtttcatgtttccatgctctagaagtatattggagatatgtcccatgttttggattttatcacggttcaattggaggctgatatgacttatgatgtggagccggtggccagttagatcggcaggtccgaaagttgatgtcaaaggacatagcttcagtgaaggtgcagtggagaggccagcccgtggaggaggccacctgggagactgagcgggagatacggagtagatatccacacctattcgagactccaggtatgtttctagactcattcgaggacgaacgtttgtttaagagggggaggatgtgatgacccagccggtcgttccgagagttatagccctgtttcccccattactgcttctttatgtgttgttcagctgtgttgtgttgtatcgggttggtaggttcgggtctggagtagtttcggagtggaatgagacactcagcctcttatttagaaagttaagttagaaaagtcaaccagatgttgacttatgagaaaatgatctcggattgggatttttgtggtatggatagctccgttaagtgattttggacttaggagcgtgttcgaaatgtaatttcgaggtccgtggtagaattaggcttgaattggcgaaattagaaatttggtgatttccggtcggcaatggaaaatttgacatcggagtcgaaatagaatttcgagagttggattagattcgtagtgtcatttgtgatgtgtgtgcaatatttgaggttattcagactaggtttgataggtttcggcatcggttgtggaagtttgaggtttcaactccattaagcttgaattggtgtgtgattcatgtttttgttattgtttgatgtgattcgagagctcgattgagtttgtatggaattttaggacttgatggtacctttggttgaggttccagaggcctagggtgtgtttcggggtgaggtttgagcgagtccgggcatttcaggaactcaggtatggttctagtgcattgaatttcgcgaacctcagcagaatttcgcggacctcataattctgccgcgggtgcactctagggaaaagttctgcagattcattggtccgacttcggacgcctatatcttttgatctacaagaaattttgagatgattcaaaaatgacagttgtagcccttcgtgtctagtttccagaaaagtaaagaagtcatcatttagacatttgtagaaaaggttatatccaaaatactaaagcctggtagtgcagccaccaaaaaatgctgccgcaggacctgagaggcgcggctgcgcttggaatttcacggaccgcatagtggaagttcagagggtgcactatataaatggggtttagggcattatttcacattttggacctagggagctcggtttgtggcgatatttcatgggtttttcaagaaattcatcgaggtaagtgattctaactcgaatttggttaatatacatgaatatatcaatgatttcatcatctaattagtactttgaggtggaaatttggggaaaattgtagaaacttcataaaataaatttttgggatttgaatgtcgattcgaagtcggatttgagtaaacctagtatggttggactcgtgagtgaatgggtgttcgtaatttttgacttttacccgattccgagtcgtgggccaggggggcgggtttgagccatttttggatttttggtctaaattggtagtttttcttgtggaatttattccattagcatatattgatggtattgtactcattgtgaatagattcagagcatttggaggctgagtcgagacgcaagagcatcgtggggtagagatttgaccggatctaggtaagtagcgattgtaaatctagtcctgagggtatgaaaccccgaaattttgtgtcatgtgattattttggaggtgactcacatgctaggtgataggtgtgtgggcgtgcaccgaggggattgtgacttggtccgtcccgtgaaaaatgtaaagctaagtaacttgttgatagttatgtgctctatatgtgttgtgaaacttgactataagtcatgctagaaaccatgtttaggctatatgttggtattgttgggaaccacagaggtcgtgtacatatgaattatcttcttaaattgttgttttgtacttagtcacaacttacttgattattttatctcagtctctattattcattattgatatatcatatcattgttatttgggatgatcttatgaatgtggagagcccggtagactggagagctttatgactaagtgaggctgagtgcctgattgtgagtcattatactatagcaggtgaattggccgtgcatcatgtgagttgttcgtgcggatccttatattatactatagcacgtgagttggctgtgcagcacgtgagttggccgtacagatccttatattatactatagcacatgtgttggccgtgctaatcgagatatttatattatggcacgtgagttgtccgtgcagcacgtgagttgtccgtgcagattatagcgcttaggttgtaggagcccctccgtagtctgtacacacccccaatgagcacaggtacctactgagtgcgagtaccgagttccgagtgccgagtgctgagtgactggaaggcataagtggtggtaaggttaggggctttttacgagggattgtgaggtatgcccgaggggctatgtacgaatgactgtgaggtttgcccgaggggttgtatatgagtgatgttttgcccgaggggctgtttatgatttcatcatttttgcttaccttgcgttgagcctttttttgaaaactgttgaaaaatatctttaaatgattttactggaactgagtttaaatgagatgttttgattcaaatcctgattttaaaagcatgtggaattttactgagatttcgtgatatgaactttatatgcttattgctcgccactactgctcagtctttatttattgttgttacttactgagttggcgtactcatgttactccctgcaccttgtgtgcagatccaagtgtagctggacacgatagcggttgttgactattccgattgcagattttctcggggatagcaaggtagctgcctggcgatcgcagcctttttcttctccctcttatcttcctttagttgtatttatctattttccagactatgttagtctcgatattgtcagataaattgtagtagattctcatgataagtgacaccccgatgtcgggctttttcttttccgcacttttgttttgatttgaactcctttacgaaggtttttatgttagatagccttgaaattatctttgaaatgaaaatatcggtttgttttggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttgcctagttccacgataggcgtcatcacgacagggttagtttgggtcgtgacatttagtaagtaagtagtctaagcatggaaaacaagatcaaagtatgcaataaactacaagaaacaagtcccacccgcatgctttaacccgacaacaacgcataagtactcgtcacctcacatatacgttgtacccaacatctaaacatgtagcaaataggcaaacaagtcctaatccctcgagtcaaggttaaccacaacacttacctcgctccaaaggtccactcaaagctcaatcacaactttgcctttcaaacgagcctcagaaccaatagaatctagcaaattaccaaccaaacgattcaaattaagccttatgaactacacatgattgcaaaggattcaatttaggtcattattgaaaaagttaactcccgggcccgcttggtccaatcccaaagttcggaccaaaccctaattatccattcacccccgagcctgattatgtaatttgttttggaatcccacctcaatttgaggtctaaatccccaatttaccaaatccctaatttctacccaaaaacccccaattccaccatggaaaccttagattttaggttgaaatcttagaaaaagtagtgaaatattgaaaggaaataggttagaatcacttaccaatgatttggggaagaaagagtcttggaaaaatcgcctctaaggttttaggttttgaaaatttgaagaatggaccaaaaatcttgtctaagtcatattttgtttagttgcagatgtcgcatttgcgacgtgggcttcgcaaatgcaaagcccgcaaatgcgagaaatccatcacatttgtgaagactcccatacctctgcaatcatcgcatttgcgatgaaaagttcgcaaatataaacactgacttgaccgcaaatgcgacccaatgatcgcgaatgcgaagaatctccctccccagctcccatcgcaaatgcgaagctttgttcgcaaatgcggacactggactttcacaaatgcaaacccgtgatcgcaaatgcaacctcatgatcgcaaatgcgaacctaggctgacccaggcacacttcgcaaatgcgaagaaatggctcgcaaatgcgagcctgacagaagttggaaatgttcgcaaatgcgagatcagaggccagttccaagaaattggagaccccagcaaatgttctaaatccaaattccactctgttgcctatccgaaactcacccgagccctcggggctctaaaccaatcatgcacagaagtctaaaaatatcatacaaacttgctcgcgcgatcaaaccaccaaaataacacctagaactatgaatcggacactaaaatcaaatgaaattttcaagaacttttgaattgctatattaacaaccggatgtctgaatcaagtcaaaccaactatgtttctcaccaaatttgacaaacatgtcataaatatagtattggacctataccgggtttcgaaaccaaaatacggacccgatatctaaaaattcaaacatcggtcaaacatttcaaaattattaagcctttaactttcaaatttcaacaaagtccgataactcgggctacagactttcgaacttgattccagacatacgcccatgtcctaaatcacgatacagacccaacgggatcgtcaaaatacgaatccgggtccttttgctcaaaacattgaccgaagtcaattcaaatagattttaaggcaaaagaaattcatattttcttagttttttttcttttcacataaaagcttttcggaaaaatactcggactgtgcatgcaaattgaggaaggctaaaatgaagtatttaagacttcagatcatagaattaggttttaaaacctaagatgacctatcaggtcatcacatgtgctgcctctgcttctgcaagcactgttcatgcacctgcagtgtcgcaggtgcgaaagaagtttcgcttatgcgagaaaaccagaaagctaccagcttcgcttctgcgatctcgcaggtgcgcagaaatgtctgttactatgagttcaagccagcctctacccagctcccattctagtcgcttttgcgatgatttcctcgcttctgcgatgaaacttccgcagaagcgaaagcatcagctgctgcctagaaattccaacagcttttcttcaagtccgaattgacccgttaaccttccaacatgtcccaaatataccaacatgtcccaaaatataatacaaacttagtcgaggcttcaaaccacgccaaagaatgccgaaattacgaatcatgtatcgaatcgaattatgagttttcaaatcatccaacttctatattttgcgccgaaacgtatcaaatcaattccgattgacctcaaattttgcacacaagtcataaataacataacggatctataaaaattttcagaattggattacgactccgatatcaaaaagttaactccccggtcaaacttcccaaaaattcaactttcgccatttcaagcaaaatttcactacggacttccaaaaaatttttggacacggtccaaagtccaaaatcaccatatggagctattggaatcatcaaatttccattccggggtcgtttgctctaaagtcaactttccgatcaactctttccatttaagcttcaaaaatgagaattgttctttaaattaaattctgaatcttccgaaaatcaaactcgacaacacacacgggtcataatacatattacgaagcttctcgagaccttaagtcgcttaacgatgcataaattcttaaaaccacaagttgggtcgttatattcttcctcctcttaaaatatacattcgtcctcgaacgtgccaagaattattctgaggacattaaattactgaatgtatccttacacacatactcgtgggtgattctatgtccctacaatttaacttgggttcgacaacaccgtctcagttgagattattccttctaccctcatttataaactttaaatccaattccttacactctaattaatttcaaaaggcctaattttccatattaacacactgtgttagtctgaaccggcgatagaaattttgtgcctacacacacactatacgtatgcccataatcacatctctggtcataatagttgtttataattaattccagcatcctcaattaatctgatattaactaaaatctcatttcaaatttaacactgacagtaacacgcgaggcatgaagacctcataattatttatccaaatcaacgagtcgcatttaacactacatgtgcactcaccttataggataaaacgcaatgtttacaacatgaatatggctaaatatgcacagaaacatataaaagaattatcaaatatgctaacatgcatcattccctattagtactatagtacaaattaaatttcacaaagggagaatttaaacacataaatcgtttttaccacaaggacctcgtccttatataacttccaccgcggcttgtagtccggtttaaatatttcatatcatataaaaatgtgaggatcttgtcctcaactctgaatcacaagtatttttcacattgtgccaactgaaaatttttcattacctttatttcttttttttaataaattccgtaaacaattttcacaacacataatgaatcccccataccaatagggcataaaattcataaaattgagatcgattattccgaaatcacatcaaaacccactatagagagtattagaaagtcaattttggacttatagtcctcaatgatgtaccaataaaaatgatagacatgggctaaccccatcgaatatcccaacagggataatgtataagtgattcacaaaattagctcacccataagcggagcataataggaggagtcgcctcaatatttagaaccaaatcaaattatggaaaaatattcttttataatagatcgggattatacctgtaatgacactatctggtgtagtggcctcagccacaccatagcaaatatatcaacgggctgggcgtcccactctagggtgctctttacccacctgtcctccacctctaaatggttgtgcacgtggggtagtaactgtattggggaccatagtctgagtgttctgataaaatccacccctcccaagtctaggataatctctcatgatgtgcctagtatcaccacactcataataacccctctgagatcgcggctgctcctgctgagcctgtgccgaataactagaatagccactttaagaattttgtgtcggtggtgtactataagaacttaccggagcaccccaagtaatctgatgtgcggactgtgttgatcaacttctcaagcctccgccataatcggtcatagctgaagagtaaaatccactaaaccctccagagcttcgagaccttttgacctctttagactctctttcctcacctagaacaccctcaatcctcattgcaatctccactacttgctcaaatggagtatcagtttgcagctctcgagccatgcatattttaagatcataatcgagcccctctatgaatctgcggactcgttctctaactgtaggaaccaagataggtgcatgacgggctaactcactgaacctgatagcatattctggcaccgtcatagtgccctgacgcaaccgttcaaactttgtgcgccatgcatctcagagagtctgggtaacaaactctttcaaaaacatctgtgaaaactgagcctaagtaggtggtattgcgtcggatggtctactttcttcatagacttgccactactaatacgctgctcctgacagctgaaatatggtaaaggaaactccgctcacttccagaatacccatggtgatgagaatacggtgacacttttctagaaatccctgggcatcctctgtatgtgccactgaaagtaggtggactatgcctcttaaacctctcaagtctcttttgttcttcttctgatgcctttggcctgacctcaggttgaaccggaataacatgttgtaccggtactatacccagaacctaaccaatgtgaactcgctgctctagagtacgagcggtaggagtctgagttactcccccaatctgtgaaatttttggcgcaatagagatcaatcccgactgatgtaatgtaccaaacatattcaagaactctgctaaagtctcccaaagtccgggggtaacaacatgtgcttctggtacctgtcccctaactgaagctactagcagctcctcaactgctgctctgacaggtgctctagtcgcggcacgcgcccttcctttgcctttacctcggctacgacctcttgcggccctggcagtatgtgcgggtgtctgctcagctgacccgatagtacgtgtcctcactctctgtgagagaatagagatacaaaggctcaaattcctcaatcaataaatccgcacgacaggaatgaaagaattggaaatttcctaacagttctgtagcctctcgaagataagtacagacgtctccatactgatccgcaagactctactaaactcgtttgtgacccgtagaagctattaacctggagctctgataccaacttttcacgacccaaaatcccaccacaggtgccgtgataacacttagtctctaagactatgtaagcagattataattacaattcaagccatttgtttttaaatagaaaccaaccacgaaaataattacaaacaacctcccaagactggtaatactgagttatgaactctaactgaatacatgaaatgatctcaaggatcgaaaactcaatactgtttgattaataattaacagtacaataaaatggaaaggctccaatggactatgatgaccaagcagctctaccttgaatccttgcgatcacactctaactctatccgagttcgatatttccaatacctaactctgcacaaaaatgtgcaaaagtatagtatgagtactccacagtcggtacccagtaagtatcaagactaacctcagtggagtagtgacgaggtacagtcaagacactcactagtctaataatctttgcaatacagtatacaaaaataataggaaagcaaataacaataatggcaacgctaatcaaccagtgatatacacaacagggcaacaagaacaccattaatattgcttaacaaataataagtacaagtacacccaattaatcaactccttcaaatataaatctttcgcctatatgtttctcaaataataatctttaggatataatactttccaaaaaatataattcagatttactcccttcaaataaatatctttcaaatataatcctttcaaataaatctctttcaaatataattccttcaaataaatctctttcaaatataattccttcaaataaatatcttttgaataaaagtcaccctgtgacacctcatttcaaaatcataaaatatgggtctcagcccactttcatatttctacgacacctcgtgcctatttctctatcacaaccgcacggataactcgcgtgtcaatatcatcatcatttaaccacgtcacctcgttcccacatttcatttcataatccgcatggcaatagccacaggctcccaatttcaacatagatcacactattatcaagtttacctaaacaacaagacaaattgcacaagatataaaaataaacatagggaaaataacaacatcacataaaaattaccaacgcaataactccacatcatcacatattatccctgacaataggcacccttatctctcctatagccacccttattactcctataatagcctcccttatccctccgcctcacaatatcaatagccacccttatcactcctatagccacccttatcacttcgtataatagccacccttatcactctgcccagacaatatcctaacatacataaccacagtgaaattctacccttatacccacataatatcaacagtgaaatactacccttatatcctcataataataactcaaatcacacaacaatttacacggaatattatcacgacaacacaacacatacaattcctatcacaattttcccaacaacgacaaccaattccaatgatatagtaaaatcaataaatttctcaaaaatagcccaaggctacacacaacatatataacacctcaaaacaatcaacaaagatagaaaatacttagtatagggcaacaccttcattaatccaaattcatggtaattatattagcacctcagtttaaacttatttcattaattatttgcagatgaaaaattcataatataattatttccaggaaatatcaaatcaacaaactcatggaattcacataaatattaaattaataatcacatcaaattgtcatataaaaacaaattcaacaaatgagaattaagacatgaaaaatagatgatttaataaatgccaacaattatccaatttactacacaataatgcctaagactttaacccaataaaatttgcacatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgtacatggcttttcacctttcacaaatggcacataaaactcgatgcctaaggggtaatttcccccactcaaggttaggcaagatacttacttttttctttaaagttaggacgatattcaaaaattgtcttcattcttgaattaacctccgaacagctcaaatctatccaaattaattcaattaattcaatacaaattatagggattaattccatatgaaagtactatttttccaacaaaatccgaaatttaactcaaaaatttcctttagggcccacatcttggaatcagacgaaactcacaaaatccgacaacccattccgataagagttcaaccataccaattttatcaaattccgataacaaatcgatctccaaatattaaatattcgttattgaaacgttttccaaaaatcttgtttttcttccaattacatacgaattaaacgatgaatatcaccatggatttatgaaatataatcactttcggatataggacacttacccgagtcaaagtcatgaataactcatcaaaaattgcccaaaccccaagctccaaaatctcaatcgaaaatggcaaagtgactgatttttggtccctatgtttctgccaagtttcgcacctgtaggcagatttgtcgcacctgcgagctcgcttatgcgagaattgtccacgcttctgctagcactgttcatgcacctgcggtgtcgcacgtgcgaaagaatttttgcttctgcgagaaaaccagcaagctgccatcttcgcttctgcgttcttacttgcgcttctccgattttgcaggtgcgcagaaatgtacgcttttgcgagttcaagccagcctctgcctagctccctttccagttgcttctgcgatgaaagtttcgcaaaggatcagctgctgcccagaaattccagcagcttttgttcaagtccgaattgatccattaaccttatgaaatccactcgaggctctcgggaccttaactaaatataccaacttatcccaaaatacaatataaactttattctgactccgatatcaaaaagtcaactccccggtcaaacttcccaaaagttcaactttcgccatttcaagcaaaatttcactacacacttccaaaataattttcggacacgctcctaagtccaaaatcacaatacggagctactggaatcatcaaaattacattccgggatcgtttactcaaaagtcaactctccggtcaaactctttccatttaaggttcaaaaataagaattgtcctttaaattaaattctgaatcttccgatcaaaaactcgagatttagatcatatatcgcaccttagttgtgattgagttttgtagcatatggcgttgtcggtccttccaaggatggtattatgcacttagcatgcttgtgtccgatgatcggatattttgtaagtaatgagcattctatctcggtaagtattttcttatagattcatttttgtgcggatcgggttgcacgccgcaacagtgtgatgttgagtacagttccctatattatattttgtgtgtttttgtgtcccattttctggggaaggttcatgactttagtttagttgtttaattagtcacatgggttgagtaatccttaccatagtctgtttttcttatgtatcgcaatcgagtccgtagcttattagctcattatggcgtcatatgagactttttgtcatgtctgaggtggcttattgcctgagcatcttatactaagtgagacgaggttattgtatccaggatcagtacgatcagattatatgaagtataataaagagaaaataccattatttggtccataatgaggcaatggttcttgtcagaaggagaaactcaatattttgttgactcggcagctggttatgaatttctacacatttcttccatcgtggaagcagttcaagagtttgaacaggaattataggtatcatgaggtgtgttgtgaacatcagatttgtggaattttggctatcattatcggaggatgttattatagtcatgtgaatgatgtggtgcatggtctaaattcaacaaaggtatgcaatcatgtattggtgtatcgtgtagtgattgatacgacattcataggttgaaaacggacatggtagagaaatctggatgttagaattgggctctaaggctaattagcctaaataaaggggaaaattttcagattggctcaagttaatgtgctcaactgggtgtggtagcatgggtagggcacgaaatgttaaacattaattttggataactctgaaacactccttagcatgttcgaggacgaatgtatgtttaagtgggagagattgtaatgacccaatcagtcgtttcgacttttagaacctcgttcccctatataaaactttccatatgtgctttaatgatttatgacttgcggggatggttggttcgggatttggaagtgtttgggttgaaatcggaacacttggttccttaagttnnnnnnnnnnnnnnnnnnnnnnnnnnnnnnnnnnnnnnnnnnnnnnnnnnnnnnnnnnnnnnnnnaaaaaggccaagtttgactttggtcaatattttgagcaaacggactcggattagtgttttgatagtttcggtaggtccgtatcgtgatttgggacttggacgtatgcccggaatcaaattccgaggtccctagcccgagatatggaattttgatgaaaaattaaaagttcaagttcaaatagtgaccagatgtctaattatgtgcaaatgaccccgaaatagaattttgatgattccaacagctctgtatagtaattttggacttacgagcgtgttcgaaattttatttgaaagtccgtagttaaattaggcttgaaatggctaaaaacaagaatttaagcttggaagtttgaccgaggagttgactttttgaaaccggagtcagaatccagttccgaaaactttcatagctctgttatttcatttatgacttgtgtgtaaaatttgaggtcaatcggagttgatttggtaggttttgacatcgaatgtagaagtttgaaattttaagtttcattaagcttgaatgtgagcataattcatggttttagtgtcgttttatgtgatttgaggttttaaataagttcgtatgatgttttaggacttgtttgaatattttgttgaggtctcgagggcctcgggtgagtttcagatggttaacggatcaaaagttagacttaaaacagctgctgcaattttttctttctgctggaaattctggcccaaaatcgaggcccaaaatcgagctcccaaaatcgagacccatgatcaaagccacgatcaaggacgaggatcgaagccactatcgaggccgaggatcgaggccacgatcgaggcgaggatcgaggccatgatcgaggccgaggatcgaggccatggatcgagggctgcctgggcagaattataaaagaggccattcatctcattcgctatttttagcaaattggagcttgagtagaggcgatttttgatagattttcaaggaaaagacattggggtaagtgattctaacttggatttggtctataaacataaatatatcattgttctcatcatttaattagtgttttgagattgaaatttgggaaatttttaaaaatctcatagaaatgaatttttgggatttcggtatcgattcggagtcggatttgagtgaaaatggtatggttggacccgtaatttaatgggttatcggatttcataacttttgccagatttcgagacgtgggccccacggacgaatttttaattaattttgggattttattgaaaatgtagtattttcttatagaattgattcctataaattttaatgattgtatcgaattattttggctagattcgagccagacatagttggataatcgaggaaagggtctactagtggattaaattggagcaagacgaggtaagtctcttgtctaatcttgtgagggggaaattaccccatagggattaaattgaataattgctgctaattgtgggggctacgtacacacgagataacgagagtccgtgcgtagctactataaatgctaaagcccgggtagtttaagactcaaagcatgagttacttgtgtaaattgtattccgtgattaattaatattaaattgatatatatgaatatattgtgaattgttagataaagatattaaaggatgaaaatcttatatgcttgattttctatttaaatcaattaattgttaaaaaaaattgtccttccttccgaatttatctcataataaatatactctccttccggaggtacataaaacaatgtcctcctttcttgtggagcggaccgaatgcctcggcaggatagatgcatctcaggatcgcgccgcacgtccctcggcagtgtacacgacactctggatcgggctgcacatcctcggcagaaatcgtgcttaataataataattatacgatactttaatagtttatttctgcttgcgaagctaattgataaattggaaaattcttagaatttaatgaattattattcttgcttgttaaagaattaattgttattcctataaatgatatttaattgataaattagaaatttatttgaattgaaggaatttaattaatatctagagaattgttgcatttgaaggaatttgatcatttccaccgattaaataaattgtttaaaattttgtaaattatgctgatttaaataccctagttgtatttcaattattattattgacccatagtgagtgtcaaagtcggccatctcgtctctaccacttcgagattaggcttgatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacatatatgtatagcggccttgtgggcatagaggtgtggttaataattgtgggggcataggtgagctgcattctatattacgatccgcacctaacagagtctccttcggagttattatattttcctgtctaatttgtattctggacagatgctgtattttatttttaattccctagtaaatgctcatgcacttgtgacacccggttttgggaatagttgtgaattgtttagaaatttagctgtaaaaatatttatcatttactctatgagttttatctctacaagtttattaaagaaaatttttatttcaaaaatactaaaatgggtaattaagttaattgattatggttggctttcctgacagtagtgtccggcgccatcacggcctttttggattttgggtcatgacacgccgtatccgggagcacctggatctgcacacgaggtgcagagtgtagtatgagtacatctaactcaataagtaacaagattaacctgtgggttgaaagcaatgacgagctccgcaggtacagtccagtataaataatggtacaaaaatgtaggcatgctttcaagtttaacagttaaactcagtacaagtgaaatagatcaatattgcatgatataaggtatatgccatctcactagaaaaacctcatgtaaatactggtcacaaattatccggtcactcggtactgtttatggccaatccagccgaggggtgttccaacccgtatatataaatacacatcgactaacagtcagtcacccagtaccgtataagaccaatccagccctgggataattttatccccaaatataactgatacagacaagatctatgtctaggtaaaatcattacaatacaaataagtaaggcaagtccatgccctgggagatccatcccgaatatatataatcatctacgctcactggggctgtacagactccggagggctccttcagtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggcagtctcgatccgtataataataaagccaataaggcatggtgcaggcgggcagccccaatctatttaataataaagccaataaggcctgctgcaggcgggcaaccccgatccataaaatagtaatatattaagccattatggcatgctgcgtcgtgcagctcaatcacataaatatcctcacaatggacaaatattactgagtatgaaatgtatatttttgaataattaattcaacaacaacacgaccccatgggtcccaaaatgttgacacgtagcctaaacatgatctttaataggagcctcagctcaatttctctaacacatggagaatgttcagataataacatgattcattaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttattcaagatataatttatatggtgcacgtccacatactcatcacctaacgtgtgtgtcacctccaaacaatttatatcatatcaaattcggtgattcatactcttagaaccaagtttagaagtgttacttacctcaaatcgtgtaacgttttactccgctatgcctttgccttgtgaattggcctccaaacgcctcgaatctagcaataattaattcgattcagtcaataaaatttattgaaattaatttcataagaaaatactaatctttcataaaaatctgaaatttagctcaaaattcgcccgtggggcccatgtctcagaactcgacaaaaattacaaaatcctcaagcccactcaaccacgagtctaaccataccaattttacttaattacgacatcaactcgaccgtcatcaaattaaaccaagagggttttcaaatctttccaacttaattcacccattaaatgttaaaacaaccatggattcaggtaatttgaccaataatgagttaagaacacttttcccaaacacccacgcaagaatctatccaaatatcgccttctaccgagctcccaattttattttgtgttatcaactcaaaactcccattttggaactttttattttgcccaaaaatgccttcatcgcgttcgcgaccatagcttcgcgttcgcgaagaacaaaaatatgctgccaagtccttcttcacgttcacgatgccttacgacctctgcccttcgcgttcgcgagacacgagccgcatccgcgaaggcttaacgccagacaggcccccagctccctttcctcttcgcgttcgcgtcagcccactcgcattcgcgtaggcttcccctatctcttcttcgcgttcgcgtctctttcacgcgtttgcgatgggtaaatcccaacagcccaaaatccttcttcgcgaatgcgtgaaacgtttcgcgttcgcgaagaacaataccagatatcagttccagcagttgcaaaataaggaaaaatgatctgaaaccatcccgtcttgtcacgccgcatgtgcaattatatatagtaacaatagcacgatagaaacctcatgcaaccccataaaaacaaccgcacggtaaaaacctcgtgcatcacaataataacaaccgcacggcagaaacctcgtgcatcacaaagtacaacaacaacaatggcaataatacaaagtacgacaagtaaatcaattcaagaactttaagtcacaaggaacggtagaaccaattcacaaggaataaccatagtaaagaatgctaggcgtaaagagaacagctcaacaagagaaaaactaatatggagcaacggtcccacaatatacatttcaacaacagggaaagctaacatgagtcaaataaatctaaataaaacaagtcgactaagatataggatatctaaacttcttttaaggttgaggaaatttctaaggatattcaacaattcaattaaggataactagcggaaagataatcataacctcaattaagactgaacaaattataggataagacaataataactccaaataaagataagcagttatgaaaagatagcatgacaatagaggaggtaaaatcttcagttaagtcaaataagagtcaaataggcaataagagtgaatcctgaaacaattaattctaattaaagcatgtagaggtgagactagtaaataggaacttaaatcatatcaagaacaacttcatactcggtaaatataaggacctaagaattataaaaggcaaacttttcacaaataagtccgagcacgcactcatcacctcgcgtacatggactacaatcaacatagaagactcaaatcctaagggaaaaatcccccacacaaggttaggcaagatacctacctcgaaccaagctcaaacaatcggtcacaatgcctttcccactaatatccgactccgaatggcccaaatctagcccaaacaattacatatcataaatacaactatattaggctaatcaaattaatgaaatcaagattttagtaaatatttcgaaattcatcctaaaaagccgacccgggcccatatctcagaatcgagtaaaaataaaaaaaatacgaacacccattcactcacgagtccaaccatataagaattactcaaatccgaccacaaatccccttacaaaattcgaaatctttattgaagaagttctttcaatattttccaatttcaaccccaaaaatccaaacttaaatggagaaaacaactatagattaatggaatacaaccaaaaatgagttaggaatcattaccccaaagcttcctctgaaaatccctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccgaattcactcaagtccaaaatgaagaaatgaatcaaaccctcaatttggcccctcttctgccagttaaactgcatctgcggacctgccttcgcacatgcgtcaccgcacctgcggaattcccatcgcaggtgcggattccactcaaaactcagcgtccgcttctgtgatccaagggtcgcacctgcgtgtgcgcacctgcggacccatgtccgcttctgcggtccttcaccgctcctgcgattgctctatcgcatctgcgggcatcggagatgcggaatttacctcgcacctgcgacccctggcactcctccgcttttctgtttcggtgcttgcctctccacacgtgcgatcccgcacctgcggtctctccaccgcaggtgcggaaataccagatgcctgaagacttcagcaacaacacaatccaacttttgatccgttaagcacccgaaactcacccgaggcccccgggacctcaactaaacataccaaccaatcctaaaacgccatacgaacttagacgagccctcaaatcacatcaactaacgctaaaatcatgaatcactctccaattcaaacttaaagaacttgaaacctcaaacctacaaccgatgccgaaacatatcaaaccacatccgaatgacctcaaattttgcacacaagtcatattcaacattccagacctactccaacttttaaaatcagattccgaccccaatatcaaaaagttcactactggtcaaaattttcaaaaattcgactttcgccatttcaagcctaaataagctagggacctcaaattcacagaccagacacgattccaagttcaaaatcacccaacggagctaacggacccgacgaaactccattccggagtcgtctccacacagttccaattacgatcaaaatcctaagactaaagcttccgttttagggactaagtgtcccaaatcactctgaatcattcggtaactgaattcaaccacgcacgcagtcaatacacataatacgaagctgctcaggtccttatgccgccgaacgggatttaaattctcaaaatgacctgtcgggtcgttacatccttcccatcttaaacaaacattcgtcctcgaacgtgccaagaatcgcctcgaagttttcaagtcactgaaagcacatatccaacataaacccgcgggtggccccacgtcaccccaatccacataaacctgacgacaccatctcaactgtaatttatcctttctatcaacaccaataagccttagactcaaaattctcaccttccatttatcttcaaaagacccgattctaaatccataaccagtatcagtctcaaccagctgtaacaactcatgcctacacccacaaggtatgaccacacaacaagacataccacatataggcctataataacatttctgatcacagtagttgcctgtaaacaaacccagcaccgacaattagcctcatatccgttagaaccgtgttcaaacctccacaacactgacaacgatgcaagaaatatgaagacctcttaaatatacacccgaatcaacaagtcaaaactaacaccaccgggcacacgccccacaagctaaaactcaagaagcacataacgaaaatgactgaatacgtaaagagaaacacataagggaaatatcaaacaagcccgacaggtacaactctctaacagtaccatactacgaatcaatttaaataggaaaaatcaaattatatgaacaaatcataaggattttatcttggtataaccttccaccgcggcacgcagcccgaactcaaacatatcaaatcacatggagttgcgagggtctcaccctcaactccgaatcagaagtcgaatacacatcataccgatggaaatcttccactaattcaattctgccaataaaatcacaacacttgctaaactctcaccccggtagagtatcaaatcacaaatcgtaaccaatttactaaggaatcatatcaaacctgccagaatagacaacatgaattcacttctagtctcgtaactttcaataatgaattaaaataatgatagacatggctatcactcatagaatctcccaacaggggtaaacacctaagcataatactaagtcatgaactcacccataagtgggacaacaaataggggactcaccttaataagcagaactaaaacaaaatacgaatggtgcccctctatatcaaatcaaaaacatacttatatggcattatctgtcgcaacagcctcaagcctactataggaaacacatcaacgggtcgggccttcccctcttgggcgccctctactcgcctgaatactatgttgtgacacacccgtccggagtctaggacaatctctcaccctgtggctggtatctccacactcgaagcaaccactctgctgaagtggttgtgggaactgtgtggtacgggcaccctgagacacatgagcacctgaaacactgtgcgaagcctgaagtgcaaactgaactggctgacccacaaaacctcttccatgtcgtaccctgcctccaaaataaggaccaatagatctctcttgtctacgaggcctcctcacttctctgtcctcatgatctcgcttgtactctctctcatggccccgcctatcctctctcctgatcacacatgccctctatacgacgagcgatccctaccacttgctaaaacaaaaaatctgactctaactcccgagccatgttaaactgaatatcatgcctgagtccctcaatgaatctacggacacactctctaactgtggtgaccaaagcaggtgcatgcctggccatatcactgaatctcacggcatactctgacactgacatagtgccctagcgcagctgctcaaactctgtgcgccatgcatctcgaagggactgaggtacaaactctcttaggaacatctctgaaaactgaacccatgtaagtgaagctaagtcggctgggctacccaactcatatgcccgccaccactgataaaccgctcccctaacctggaacgtagtaaaagaaaccccgcttgtctctacaatacccatagtacggagaatgcgatggcactcctccaaaaaaccctgtgcactctctgaagccaaaccactgaatataggagggtcataattcctgaatattgcaagtctaagatgctcttcctcagatattgctgcccagcctatgggctgaactggaaccacaggctgtgttgccatgacacctggaacctaaccaacatgaactcgttgctttggggtgtgggcagcaggagtctgagttcctcccccggtctgtgaaatagttggtgcaaccggaatcaaccccgcctgagccaatgtaacaaacatgttcaggaattgtgctaaggtctcctgaaatccgggggtaacaccaggcacctccggtacctgctccccaactagaactactggcggctcctcaactgctgctctggtaggtgctgtggctgcggcacttactcctcgtcggcctctgcctctagcgatactttctctgggagcagcgccgtctataactgtagctcgtgtcctcactatctgtgagagaatggaatggtaaaagttcaaactccgagatcaataagctcgcacgataggaataaaagtattgagattgtcctaatagttctgtagcctttcgaagataagtacagacgtctccgtaccaatccgcaagactctactaaactcgcttatgactcgtagcacctataaacctaaagctctgataccaacttgtcacaaccaaatttttcctccgttgggtatcgtgatggtacctagtcttagggactaggtaagcctaacaataattgaaacaacaacattatttaaatagaatctcttcaattaccaaaactagtagtacaagtcataagctctacagagtgtttgctagaaagcctctaaatacaaccgtccagaaatagaaatcaacagtgcaaaacgaaaacttgaaggtgactctgaagcctgtgaacgcagcggtaggtttaccttgagtctccgcagcaacagtccacatagctagctaacgaacaatttcctgaatctacgtaaaaatgtgcagaagagtagcatgagcaaaccacagcggtgcccagtaagtatcaaggctaacctcggtagagtagtaacgaggaacagccaagacacccactggtctaaaatctccaaataaaacaagtcgactaagatgtaggatatctaaacttcttttaaggttgaggaaatttagaaggatattcaacaattcaattaaggataagcagcagaaagataatcataacctcaattaagactgaacaaattataggatgagataataataattccaaataaagataagcagttatgaaaagatagcatgacaatagaggaggtaaaatcttcagtcaaataagtcaaataggcaataagagtgaatatgaaaacaattgattctaattaaaacatgtagaggtgaaactagtaaataggaacttaaatcatatcaagaacaacttcatacttggtaaatataaggacttaagaatcctaaaaggccagcttttcacaaataagtctgagtacgcacatgtcacctcgcgtacatggactacaatcaacatagaagactcaaatcctaagggaaaaatcccccacacaaggttaggcaagatacttaccnnnnnnnnnnnnnnnnnnnnnnnnnnnnnnnnnnnnnnnnnnnnnnnnnnnnnnntgaatttcccacgaatatccgactccgaatggcccaaatctagcccaaacaattacatatcataaatacaactatattaggctaatcaattaatgaaatcaagattttagtaaaaattccgaaatccatccaaaaaagtcgactcgggcccacatctcggaatcgggtaaaaataacaaaatatgaacacccattcactcacgagtccaaccatataagaattactcaaatccgatcataaatcccctttcaaaactcgaaatctttattgaagaagttcttccaatttttcccaatttcaacaccaaaaatccgaaattaaatggagaaaacaactacagattaatggaatacaacaaaaaattatttaggaaacattaccccaaagcttcctctgaaactccctcgaagaattgccaaattccgtgctctcaagtccaaaaatgaagaaatgaatcaaaccctcgatttggcccattttccgctagttaaaccgcatatgcggacctgccttcgcacatgcgtcaccgcacctgcggaattcccatcgcaggtacggattccactcaaaactcagcatccgcttctgcgatccaagggtcgcacctgcgtgtgcgatcctgcggacccatgtccgcttctgcggtccttcaccgctcctgcgattgctccatcgcatctgcgggcatcgcagatgctgaatttacctcgcacttgtgacccctggcactcctccacttttccgcttctgcgcttgcctctccgcacgtgtgatcccgcatctgcggtctctccaccgcaggtgcgaaaatatcagatgccggaagacttcagcaggaacacaatccaacttttgattcgttaagcactcgaaactcacccgaggcccccgagacctcaactaaacataccaaccaatcctaaaccaccatacggacttagttgagccctcaaatcacatcaactaacgctaaaatcacgaatcaccctcccattcaaacttaaagaacttgaaacttcaaattcctacaaccggtgccgaaacctatcaaaccacgtctgaatgacctcaaattttgtacacaggtcatatttaacatttcggacctactccaacttccggaatcagattctgatccagatatcaaaaagtccactaccggtcaaaatctccaaaaattcgactttcgccatttcgagcctaaataagctagggacctcaaattcacagtccggacacccttctaagtccaaaatcacccaacggatctaatggaactgacaaaactccattatggcatagtcttcacacagttccgactacggtcaaaatcctaagacttaagcttctgttttagggactaagtgtcccaaatcactccgaatcatccggtaactgaattcaaccatgcacgcagtcaatacacataataggaagctgctcagatccttatgccaccgaacgagacttgaattctcaaaacgaccgaccgggtcgttatatttcccacactagtagaaaatatccagttcaaaccatggtagaaaccatcaagaacactttgaaatccatctacacataaccaagctgttagaactaaattcctctaactcgaccaaaccacataggtcatcaaaacccaagaatattgccaccaaaacatctatagagtctcaccacatcataattacccctataaatatcacaaccgaaacacccactctgaaaataccttatttgagtctaaggccgtttcattcaccttcctgataccgaaatataaaatccataatgatatacaaaaatgccacaagtctcgacaccatccaacttaaatctcagattttagccataaacaaatccgccaaaaattctcaattgttacatattaatctcgaatccattagaactttctcgagagtcaccccatttgttcaaatccacattacaccgccaaaatggaccaaaagacacgttccccatcagcacaacaatactcaaataagtaactctactttaatatcacctatcaaattcatactccgtgcacaatacatcattcacaaataacaactcactcatcccacgatttccatatactcataaagcacaatataacccatatccaaaagtttccttactcgagtcattctcgaactccacctctgcaagtcatctctgattcccaagtatacttcagaccaaataaaatgattttgacacataaccatgaattaaattgtcaatagcaggctcccccacttgtctcaaagctatagattaaaatatttgataactcataatacccatgctttattattgccttaagaccacagtcagttcaacgaaaattcttctcaagctcaagacacaccaaccaaaaaataccccaatcatccactaatctcgcattcattctcttaacactcaagtaaactttctcaaccagattcaaattcaagtctcaacacatacgccccgctggcagaaaagaaactctccattcacatcataaggaacacacctacatagattactccgcaggagataacccacatgcttagtctcaaattggcatcttgttataccctttcgcagccacaattactatgaaattacttaatctttctgagtccaaactcattaaccagacacgagaatttgatgttccccaaaatttaacaacgtgaaagatctttcaaaacattcacactcgagattatacgtcacataaaaatgaaaataaagtacccaatggccttcctttacatttcaaggaaacacttctcgtcacattcaaatcgtcttaacacatcccgcagttatatcatactcatcacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccataaattccactcatagggacattaccggacatatgagcccaattgtataggttacaactaaagctatcgagcctaagctacggtctaaacctggcctcaagtcctctagactggcccattaccaaaacacagaatacacacctcgaacctcgttcattgaatcacaagccagcgatgcacaactgatactgagcgcttacatgcgcacataaatgcatggaaggaattcaaagagttatgtttcaagctgaatcaattccgcacgatagaatacaagaaagtgaaattattcctaagggttcggcaacctctcgaagattagtacagacgtctctgtaccgatctgcaagaccctactaaacctgctcatgactcgtgagacctatgtaacctaaggctctgataccaactttttacgacccaaaatcatacctgtcatgatggcaccaatcgcaatactaggcaagccgaaaatctcaataaaccaccatatcttttaaatttgaaaacataataattaaattcagcggaagaaactcacaatttcaaatataacactcccaaaacccggtatcactgagtacatgagcatctaatatgaatataaagtctgactgataaaatcactgtctgaaaatatcgaacagtacaataattaaataggaagggaatcaagtctgtggacgtcaagcaactaccttgatagtccccaacagaattaacttcaaaatctagcagccttcgtatttgggagaacctggatctgcacacgaggtgcagagtgtagtatgaatacaactaactcaacagtaacaagactaacctctgggctgaaagcaatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttaatagttaaactcagtacatgtgaaaaaattcaatactgcatgatatgaggtatatgacatctcagtagaaaaacctcatgtaaatactggtcacaaattatccagtcactcggtactgtttatggacaatccagccgaggggtgttccaacccatatatatatacacatcgactaacagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggcaaccctgatccataaaatagtaatgtattaagccattatggcctgctgcgtcgcgcagctcaatcctataaatatcctcacaatggacaaacattactgagtgtgaaatgtatatttttgaataattaattcaacataaacacgaccccatgggtcccaaaatgttgacacgtagcctaaacatgatctttaataggagcctcagctcaatttctctaacacgtggagaatgttcagataataacatgattcattaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaggcacaatttatatggtgcacgtccacatgctcatcacctaacgggtgtgttacctccaaacaatttatatcatatcaaattcggtgattcataccctcagaaccaagtttagaagtattacttacctcaaatcgtgtaactctttactccgctatgcctttgccttgtgaattggcctccaaacgcctcgaatctagccacagttaattcgattcagtcactaaaatttattggaattaattccataagaaaatactaagttttcataaaaatctgaaatttagctcaaaaatcgctcgtgggacccacgtctcgaaacccgacaaaagttataaaatccgaaagcccattcaactacgagtctaaccataccaattttacttaattacgacatcaaatcgaccctcatcaaattaaaccaagagggttttcaaatctttccaatttaattcacccattaaatgttaaaaacaaccatggattcaggtaatttgaccaataatgagttaagaacacttaccccaaacacccatgcaagaatctctccaaatatcgccttctaccgagctcccaatttgattttgtgttatgaactcaaaacctctattttggaacttttaattctacctagaaatgctttcatcgcgttcgcgaccatagcttcgcgttcatgaagcttaaaaatgtgctgccaagtcctttttcttgttcgcgagctcttcatcgcgttcgcgatgccttccaacctctgcccttcacgttcgtgtgacacgagccgcatccgcgaaggcttaacgccagacaggccccaactccctttcctcttcgcgttcgcgtaggcttcccctgtctcctcttcgcgttcgcatctccttcacgcgctcgcaatgggtaaatcccagaagcccaaaatccttcttcacgaacacgtgagaccattcgcgttcgcggagaataataccagatatcacttccagcagttgcaaaacaaggaaaaatgatctgaaaccatcccggaactcacccgagcgcccgggacctcaaccaaacataccatcaagcccaaaatatcatacgaacttagtcgaatcctcaaatgacctcaaacaacgctaaaaccacaaatcatacccaattcaagcttaatgaactttgaaattttaaatttctatatcttgtgccgaaacacatcaaatcacgtccgattgacctcaaattttgtacacaagtcataaatgacataacagagttattccaattttcagaatcggatttcgaccctgatatcaaaaagtcaacaccccggtcaaactttcaaaaaattcaactttgggcatttcaagcctaattccactacggacctccaaaaatatttctggacacgctcctaagtccaaaatcaccatacagagctattggaatcatcataattaaattttgaggttgtttacacataagtcaatatccggtcaactttttcaacttaagttttcaattgtgagagtaagtgtctcatttcactccgaaatctttccggacctgaaccaactaacccgataagtcataaatcaattgtaaggtatcaattgagttgtaaattggggaacggggttataatactcaaaacgaccggccgggtcgttataatttttcgtcattgcaatacacaagcatacatgcaattatttctcgacgaattaaagaggttattattcattttttgcggtgaaagttgaattttggggataaacacatgcttgaaagcacatatatccatcattattgctacaaaataagaagattgaaagaaagattaactgcaataaatgaacaataacgccaaaagattaaattaaacatagtaacattcctgtggtgttttgatctttaactcttataattacgttttattgaagctaaacattttcatgtcaaattcttaaaaagaaaaatagttacgactgtgtatagatgattaggccaaaccaaattgtctgattaaaatgagcatgaaggagtcattgactaacttaactttgaagaaattattaggtttaatttttggtaaataatttttagttgaaattataatcttattaaataagaaatataaattttgcacaagaaataaagttataaaacttctacaattctacatgtaaactcacatataattaggacagtgcttgtatatataatatgacaagtcttttacgtgctcgtagaatttttctttgccaactctttttatataagtaattattataattttaatcaattatgaagttgtttcgttgaaggaagattgtatattttttaatggattgagttccaggagaaaaaagttacttagtcctaacccaaaattatatttatacccatcattaaattgctacataaaagaaaaattgactttaaagggcaaacaagtccatcaagtattcggggatattttcgtctcttaacatttagcatcctaacattcgtgcttttataataatatagatagatagatagattgatatatataaatatagatatagatagataaatataaataaatagatagatatagattgatgaataactaattttatgcgaatatttagcctaaagttggtataataaataaactgtccaaattgacgctactgaaattatgtatattcctcgatctaatataatgatgtaattttgtctgaatcacttataaaaatgagatattggcacgcgactactgtttgctgagaaagtgagcaacgaaacgatttgagggtttttctttagtctttattcttcaatttgttaatttgattcgtttatttgtttgattaaagcaacaagggaattttacctatatgtactataatagaaacttatttactctcactgtttaggttttaacttaattacaagttgataacaattacttttcagctctcttgttttaatttgtaaaaattgcacgggacgccctatttggtcactcccatttaatctatacccacattttaaattttttttaacttgtacccattttttaaacaacttcaggcttctttctcctcctccttctcctccttcgttttcttcttctcctcctcctcctcctcctccttcttcttcttcttcttcttcttctttttcttcttcttcgagtgacaatgattttatatggttgctgtgaatatattttaatgtagtttatgatatttttacaaaacaaaaattggttgcaaatgtcaatattttaccttttacaaaaaaaattggtttctcttcttcttttcatagtaaacattgtacatagttgggcagctaggtgaataagtgccggtgcaaacgttccattgaatctagagtgcttaatgtgagagatcaaaagtgatcgttcttttgtgactcataaaaatttgttgttcatttcttgcaaacatgtaagaacagtacagtgccaatttgaaatataatactactttaaggactaaatatctgttgatataatgtaaacatgcatattctatcttgcccgcttctggacatagcaatatcacagaaacagctgaaattagttccagttgctgcaatttaaatttgtaagagctcctaagaatgctgaaattcaacaaatataaacaaaaactccagctcctagaatgctgaaattcagcaaatataaaataaatttcaactcctataatgctgaagttcagcaattacaaaacaaaaagttcagctcctagaatgctgaagttcagcaattacaaaacaaaaactccagccaaaacatgatgtagttttattgaactgaagtttgtcattgcactatgaactgaaatttgcgtgattgcctttgcaagtgaggccaaacttcaggaaaaaatatctaaagttttgctttgacaaggctatacttcaggcaaaatattctgaagttcaaacttcagacataaatttttgctacttcaagcccgtatgtctgatgttatccgaaaaatgggcacgcttgcaatattttttgcaaagtgggtataagttaaaaggtgatccaaaaactgggtatagatgcaaatcccccttttaattttagtgtttgggcctacggttaacccaacccaatcctatgaggttgcaggctgagatggatatactaagagcccatttggattagctgattataaatagccgataagcttgaagtgctgaaaaatattttaagcgcttaaactgattttttaaataagcatttacgtgtttggatagacgtactaaaactgataataaacagttgatgtgtttggtagaaaagtgctgataagttgttcttttattaaaatgactacaatatcctttaaaagcttacaaaagataataaattaaaaagtttctttgtaaagaaaaagatgaacaacgaatatggaatgaaaagaaagttagaaaatttattttgaaaataatattttatgaattagaaaatattattaaggctaaactagtaaaagccttggtcaaactataagtgcttataaactaaaaaatcataagttggggtgaccaacttatgactgattttagcttataagcagtttgagtatttaccaaacgcatagataagccaaaaggtgtttataagtcaatttgacctacttataaacttagccaaacatcctctaaaaaccctcaattttaaataatgcaaatagcatggactaaccagttttcagactcgtaattaaagaatagctaacatttgcaaagtcattgagaagtagtcattatttaatgtgaagataaaatatggaaaaaataccatatctgaaatacagaaattttcaatataatatgttgaataatggagctcatacgtataaacttccagcatattatgttggaactccagcacattatgctggaatcttatgtgtaaaaaattcaaactccaacatattatgctagatttcttttcgtattttaaggatatttttgttcatgttttattttacatgaaaaaaatagttaaattttgattactttgaaactacggctaattttctattagcacatgtaaatcaggctgttttattttcctttttaaatgggctaaaaagccagcccaacccaatgtaattataccatgctaagttcagttggctcgataggtcaagttcattttgacaactttattaataacattaattataaaagtttgataaagtaacccttatctatttcttaaatgagtaactaatgtttatatttgtttatttttgaattagtgagggtggaactgaaaaaaaataaattaacgcaatcatgattttctaaagttattttgagcaaatctttttggcaagagtaacagattgtactgacattttgtttccaaatttaaagtgaaataaaaaaaaatcaatagaagaaggagaaggaaaaggccgtgtggaccagacaaaaggagaaccctgaataattaataattttactgttgattaattggctaatacaaaatcgtaaggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatacagcccattcaacttggtctcattttttattttggtactctatctcaaccttattccattttgatcctcgaactctatttcttatgtttcattttaacacaaaagctgaaactagtgcaaaacaatatagcgcatgtgtatacacaaatctgaagtgtaataaatatccaagaaaaatagaggagctcgaggctcggttggcttctgaacttgccagggtcgaatctgacgccgaaaaggcaaaggccgatgcgaacgtgctcgtggccgtctatcgggccgatgctgaagctgcccaggtccaagcaagagagggagtcgagatcgccgatactcaagtacatcgggtcgctgaacttgctaagtgtggatgtcagagggagaccctcgaggagatccatattcgaggtttcgatctcgctgaagagataaaagggccaaacaactcgaagccgatgccgaaactttggctttcgatgatgataatgatgataataatgatgatggaagtaagagcgggtccgagaacggggggcgggggggagcctggtagagaagagaccgctcccggagataatcaagaatcttagcccttagtttctacattgcgatcaatcatgtaaacaatcttgtatatatataaatatctttttcttttaccgacttgcttctgttttcattcctgccttgtgaagattttattcatgccttatgaatgttttaggcaatttgatcgaatttggacttcgtagcctttataaccgaacgagcgcttacttcgcttactcaaacttggaataaggtagctcataagcttagtagtcgagttgagtgattgctcaaacttgagatgatgtagcccttaggcttattagttgagtgaatattttgaactcgaagaaatgtagcatataggcgtaatagtcgagtgagtgcttgctcgaactcgaaataagagtagcccgtaggcttattagttgagtgaatgattcgaactagaagtaatatagcccgtaggcgtaatggtcgagtgaatgctcgctataagtcaaaaataaaagtagcccgtaggcttattagtcgagtgaatgtttcgaactcgaagtaatataacccgtaggcataatggtcgagtgggtgcttgctcgatctcaaaataaaagtagcccataggattattagtcgagtgaatgattctaactcgaagtaatatagcccgtaggtgtgatggtcgagtgagtgcttgctcaaactcgaaataaaagtagcccgtaggcttattagtcgagtgaatgtttcgaactcgaagtaatatagcccgtaggcataatggtcgagtgagtgcttgctcaaactcaaaataaaagtagcccgtaggcttattagtcgagtgaatgattttaactcaaagtaatatagcccgtatacgtaatggtcgagtgagtgcttgctcaaactccaaataaaagtatcccgtaggcttattagtcgagtgaatgtttcaaactcgaagtaatatagcccataggcgtaatggtcgagagagtgcttgctcgaactcgaaatgaaagtagcccgtaggcttattagtcgagtgaatgtttcgaactcgaagtaatgtagcccgtaggcgtaatggtcgagtgagtgtttgcttgaactcggaataagagtagcccgtaggcttattagtcgagtgaatgtttcgaactcgaagtaatatagcccgtaggcgtaatggtcgagtgagtgcttgctcgaattcggaataagagtagcccataggcttattagtctagtgaatgttccgaactcgaagtaatatagcccgtaggcgtaatggtcgagtgagtgcttgctcgaattcggaataagagtagcccataggcttattagtctagtgaatgttccgaactcgaagtaatatagcccgtaggcgtaatggtcgagtgagtgcttgctcgaattcggaataagagtagcccataggcttattagtctagtgaatgttccgaactcgaagtaatatagcccgtaggcgtaatggtcgagtgagtgcttgctcgaattcggaataagagtagcccataggcttattagtctagtgaatgttccgaactcgaagtaatatagcccgtaggcgtaatggtcgagtgagtgcttgctcgaattcggaataagagtagcccataggcttattagtctagtgaatgttccgaactcgaagtaatatagcccgtaggcgtaatggtcgagtgagtgcttgctcgaattcggaataagagtagcccataggcttattagtctagtgaatgttccgaactcgaagtaatatagcccgtaggcgtaatggtcgagtgagtgcttgctcgaattcggaataagagtagcccataggcttattagtctagtgaatgttccgaactcgaagtaatatagcccgtaggcgtaatggtcgagtgagtgcttgctcgaattcggaataagagtagcccataggcttattagtctagtgaatgttccgaactcgaagtaatatagcccgtaggcgtaatggtcgagtgagtgcttgctcgaactcggaataagagtagcccgtaggcttattagtcgagtgaatgtttcgaactcgaagtaatgtagcccgtaggcgtaatggtcgagtgagtgtttgcttgaactcggaataagagtagcccgtaggcttattagtcgagtaaatgtttctaactcgaagtaatatagctcgtaggcgtaatggtcgagtgagcgcctactcaaactcgaaatgaaagtagcccgtaggcttattcgtcgagtgaatgtttcgaactcgaagtaatgtatctcgtaggcgtaatggtcgagtgagtccttgctcgaactcggaataagagtagcctgtaggcgtaatggtcgagtgagtgcttgctcgaactcggaataagagtagcccgtaggcttgttagtcgagtgaatgtttcgaactcgaagtaatatagcccgtaggcgtaatggtcgagtgagtgcttgctcgaattcggaataagagtagcccataggcttattagtctagtgaatgtttcgaactcgaagtaatatagcccgtaggcgtaatggtcgagtgagtgcttgctcaaactcgaaataaaagtagcttgtaggcttattagttgagtgaatatttcgaactcgaagtaatgcagcccgtaggcgtaatggtcgagtgagttcttgctcgaactcggagatttatctcaatcgtgtttgcttaatagatctcgaaatataggaaaatttcttggatataagatatcgataaagaagaaaactttcattgcaagtcattatacatgtgttcatgttttgcgtcagggctcgggccaactacatgtgcatggttcgttttgaccatttggctcttacaaatttttctattggaaccctgttgttacgaaataactttcttacatcagaacttgatatatttgagggctaatgcccccccagtattcgaggtggattgtaaagagacctcaaatactgtcaaattgtttctaagtttagcacgatcaatggttgcctcattaaaaaccttgccgaaaaacccatttgggataaaactgatctaagggaaaaagagtgcaacgcgtgctttcagatctagggctttgtattgaaggatccatactagctcttgatcggactcctgcggaggttagtttcgaaatgtaaacgaatatgggatggtcataccttagtagtagtatcgttttaggtgcgacacattccaattgcttgatagttgtttgccgtttataataccgagcttgtaagatccttttccgaacgttttcgagaacctgatatggtccttcctagttcggtcctaattttccttcgtttagatttcgggaactgagggtaacttttcttagtactaagtcccctagtttaacatggcgaagcttagttcttcgattatagtatctttcgattcgctgcttttgggcaggtaattggacgagagcagcttcttgtttttcatcctataattcgaggctagtgatcatagcctcgttatttgactcttctgttgtatatcgaaacctggcactgggttccccgacttcgactggaatcaaagcttcggagccatatactaaggagaacggggttgcccccgtactagattttgatgttgttcggtatgcccaaagaacttcaggtaggatttctctccattttcccttagcgtcgttcaacctcttctttaggttttgaatgatagttttgttcgttgattcgttctgcccgttcccactggggtgatatggtgttgataatatcctctttatcttcgaagaatttcgtcactttgctgcggacaaactatttcccattgtcacacactatttcggaagctatcccgaatcgacatacgatatgatcccagataaagtctataacttctttctctctttcttttacgaactcctgtgcttcaacccatttagagaaatagtcagtcataattaaaatgaacttagatttacctggggccgatggcagggggccgtcgatatccattccccatttcatgaatgactatggggataggactgagtgaatctgctctccgggctgatggatcattggtgcaaacctttgacatttctcatattttcgaacaaactcctttgcatctttgtccatatcgatccaataataccctgccgggaagagtttggaaatctctactgcacagtgctgactttggaagcttatatctcacaatctacaatgaattgggagatgatcaaaatatgaaagttatagcccttgatgtctagtttccagaaagtcaaataatttgtaatttggagttttgtacaaaaaggttatgaccattatactagaggctatctcaaaagagtttgaaaatggcttttgagaattttgttcatcgcgaacgtgatgggggacttgcgaatgcgaagaagtgtcgcatgagtagtgtataagtttgcaaaaatgggtttggctcgtttcatctcatttccttcatgggagccggcctaggagcgattttggaactcaatcttcatcatccatgtcaaggtaagtgattcctacctattgcaagttaaatagttggtttatatacgaatttaggtgtgaaaatgcatggaaattagtagaaatttggggttttgaagaaaaaccaagaaattgatatttttggatttttaccacgaaattggacatggaattcagaataaatgatataatcgagttcgtggtgttatgcgtaacgtttatcttcgaacaattttggaatccgggcacgtgggcccgagggtgaattttaccgacttttagagcggagttggaaattatttaaattgattaattatgggtattagaacacatatttattgattttcacattgattgcaatgttttggatcgacaagcatcgatttgaggtattagagtggcgctggagccggctatggagcttcggagcgagataagtctcttgtctaaccttgtaagagggaatttaccccataggtaatttaaattaataattgttgctaattgtggggagctacgtacgcacgaggtgacgagagtctgtgcgtagctactaatattgctaagcccgggtagtttaggactcaaatcatgaattttttgtgataattgtatccttatttaatcaaagcattgggattatattgtaaattacaaaaacaacaacaacaacaacaacaacaacaacaacaacaacaacaacaacaacaacaatccaatataattccactagtggggtctggggagggtagtgtatacgcagaccttacccctaccatgaggtagagaggctgtttccaatagaccctcggcatccttccctccaataactccccaccttgctgttggggtgactcgaactcacaacctcttggttggaagtggattatattgtaaattgttagaggaaaattgaaaattactgaaagtttacatagttgaattttgtggaataatatttaactgtaaatggaaattgtacatccttatgtgttaatcttataatatattctcatttcggaggatcataaaaaaatgaccttctttcttgtggagcgggccgaatgccttggcagtattgatgcatctatggatcgtgccgcatgtccctcggcagtgtacacgacactctggatcgggtcgtacgaccacggcggaaatcgtgcctaacaataataatttacacgataccctgatattttattgcagcttgtgaagctaattgataaatcgggaatcattggaattgaaagaattaattatttctgcttattaagtaaattattgttgttctcataaatcatatttatttaaatatttctattttaatattattgacccatagtgagtgtcaaagtcgacctctcgtcactacttcttcgagattacgcttgatatttactaggtgcgggttgtttacgtactcatgctatacttgctgcacatttttgtgcaggtatatatatgtctagcggccttgcaggcgaagagaagtggttaatgcggagacttaggtgagctgcattctatattatgatccgcacccagtagagtctccttcggagttatttatattttttctgtctaatttgtattccggacagtcgttgtattttattttattttatattcctagtaaatgctcatgcagttgtgacaccggattttgggaggatttcgggttgttctatattgaatttgttaaagtattattattttctatgtaaatcccaattctttactatgtttattaaaggaaaatatgatttcaaaagtaataaaaaatgagaacccaatttagtatttattgttggcttgcctgacagtggtgtccgacgccattatgacgttaatggattttgggtcatgacaaaattattattgcaaaagatattatttaactgctacattttgattagtctacaatttctgtgatgacccaaaatgtcatctttaatttaaacattcattgatgtgttctataacctcaaaagtactattcatctttcatcgacctgcgtgcgcagtccgaataattttccgaaaagtttttatataaaaaatttattaaaatgtgaaatagaactttcaaactcaactgagttgactttggtcaatattttgagcaaacagacccggatcggtgttttgaaaattttagtaggtccgtatcgtgatttgggacttgggcgtatgcctggaatcgaatgcggaggtccttagctcgagttatcgcatgttgtcaaaatttttaagtttaaaggtttaatgacttaagagatttgactaatgtttgactttgttaataccgggtccgtattttggtttcggaacctggaatagttccattactatatttatgacttgtctgccaaatttggtgagaaacggagctggtttgatgtgattcggacgtccggttgttaaaatagaagttctaaagttttattgaaaatttcatttgatttggagtttgattcgtagttctaggcattattttggtgttttgattgcgcaagcaagtttgtatgatatttttggacttaaaaatcgaggagtccgagattttgtcatttttgacatttccaaaagcgggtgaggcaatttttgagcaagaaatcacggaaaatcttgaggtaagtcacttgtgatcattgttaatcaataatattgaattattatcgaataggggatttgaacttagggatttggaaataagatttgaagatttggatatcgagttgaggtcggattttggtaaaattggtatgttagactcgtggtagaatgggctttcagattttgtaccttttgtcgggttccgagacgtgggccccatggataatcttttagctatatttcggattttgatggaaaattaatattttcttatggaattaattccaataattttttttgactgaatcaaattatttgtggctagtttcgaggcgtttgaggtgagtaataattctaaattcggtcttgagggtatgaaacccaggattatgtgttatgtgattgattttgaggtgacgcacatgctaggtgacgggcgtgtgggcgtgcaccgtaggaattgtgacttggtcaaattccatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtatagttgaataatctattgatatccttacattttcctcgtattagagaaattgatctatgaatcatgtttaaatcatatgtttacactgttaggacccacagaggtcgtgtacttgtggaattatctgctaaattactgttttgcactaagtcacagttctatttgcacattattaccttagtctctcttattaattattgatgcatcatgtcattgttgtagggctgcttatcatgatttctgagagcccgagagaatggagaggttgatgactgagtgaggtcgagggcctaattgtgaggatatttatgggatcgggttgcacgccgcagcatgtttctttgttatctgccatgattggcttgatatagcgtttgggctgaaggagaccctccggagtctgtacacacccctagtgagcgcaggtacctactgagtgcgagtgcgagtgtcgagtgctgagagattgggaggaatgagtgattgtgaggaaagagtgactgtagggctggagtgaatgggaggacttagtgattgttactcttagaggatgcattgatttcattattgctgcatttcagctgtcatatatcactgttttagaaaatttctaaaagacatccttttctatttcattcgaagttgttataaaattactatggagttttaaatgttgaacttgaaagcatgcctacctttttatgttggaaagtattgtagttggacttagctgagaagctcgtcactacttttagttccttatatattattgttacttactgagttggttgtactcaaactacaccatgcacttcgtgtgcagatccaggtgatcccggacacaaagggtgttgattctttcacacagtcgatttttcggagattcagaggtagctcccatgtttcgcagaccttgactctccttccctatccttttgtttatagtatttggtcttatattattatggaccgtgttttccatacttgtaatgtatatatgctcatgtactcagtgacaccaggttttgggagtgtttgtatcgatttttgcgagaattttggattgtgtttaaatattatattttcaaacttagaagaaattgtggtttattgaggttgttggcttacctagtactgagataggcaccatcacgacaggttaggattttgggtcgtgacacccgagggctcgggtaaattttggataggctacgagtggtttggaacatagaaaatctagtttttccttagcttcagttgtcatctggtttccttcttcgcgttcgcgaaggcactctcgctaacgcgaagagtgaactgggccgggtgggattttatcctacgcgaatgtgaagggctgtacgcgaatgcgaagtcgagggggggctgcccttcgcgaacgcggacaatgtttcgcgaaagcgtagctttgtggacctgggggaggggaaaccgatcaatgctcttcgcgaacatggcacaaggcttgcgaacgcgtaggctggtggatgtatgccttcgcgaatgcaataggctatttgagccgctgcatcgcgaatgcggcaggccttcgtgaacacgaagaagaccagacgcccagtgtcacaacccaaaattctcacctccaagatcatgatggcgcctaacatttcacttgctaggcaagccaacgttagaatataattagccattttaacaaaattttaaattaatcaataacacagaaacaaatgcagaaataaagtctaaaataaagtgaataattcataataaatgcaatatctaaataacatcccagaactggattcacaagttcacgagcttctagagtgatatttacaaaggtatgaaataaatacaaagttgtcttaatgaaaatacacagctgaataaaaataaagacggggactttaggagctgcggccgctgagcagttgtacctcaagtctccgcaggtggtccaatccgagctctctagtagctgtcgctgggactgtctccaaaatctgtacagtgtgcagagtgtagtatcagtataactgacctcatatactcgtaagtactgagcctaacctcgacgaagtagtgatgaggctaaggcgggtcacctactctacaacctaaacgcagtatataatcatgacagaaaatgggaatactaaacagaattaaataaccaactgaaaataataaccgcaacctcaagaataaaccagtgtcgtccagaatcacaaatctttaataattcagatacaaataccaaaagaaaaccaacacagctcaagaaatggaaacctataggttgttgcggcgagcaaccccatctcaccagacaacacaaattcctcccttatttcaccgtaacgatatcaacaacaatacataatatagggctaggaatttaatgggtgatgttagaaatggaagaaaatgagttaaagagtacaaatctatgaattggtgttgcgttttctcttcacaatcgcacctaggccaacctttaatggagagtttatgaaaaatgggtaaaatcccgttttggttctgttttaaggtctgggcgttaggccttcttcgcgttcgcgaaggacctgccgcattcacgatgtgcagcagcccgagtggctttcgcgttcgcgagtcttccttcacattcgcggaggttgttcccccctgttcttcgtattcgcgagccaatgctcgcgttcgtatagaagaatgactgacccctcccacaggtccctaaagcttagctttcgtgaaaagttggtcgcgttcgcgaagggtaaggcagctttcatgactgacccctcccccaggtccctaaacccaggtaccgtgttcgcgattaagaaaatcaccctgccccagtttactccttgcgttcgcgagagtaccttcgcgagcgcgatgaaggaaacacctaataacaattgaagccaaaaaaccatattttttctatgtttcaaaacactcgtagcctattcgaaactcacctgagccatcggggctccaaaccaaacatgcacacaagtcccaaaatatcatacgaactcgctcgcgtgaccaaaacactaaaataatgcctagaactacgaactagacaccaaatcaaatgaaattttcaagaaaactttaaaacttatattttcacaaccgaatatctgaatcacatcaaatcaactccgtttctcaccaaacttatagttgacctataccgaactccggaaccaaaatgcaaacccggtatcaacaagaccaaacatcagtcaattctaaaaatcattaaactttcaaacttttaatgtttcatcaaaattccatatctcgagctagggacctcggaatttaatttcgagcatacatccaggtcccaaattacgatacggacctactgggaccgtcaaaatatagatccagatccgtttactcaaaacgtaaaccgaagtcaactcaaattaatttttaaggcaaaacttcttattttaatcaatttttaacataaaagctttccggaaaggcccggactgtgtacgcaaatcgaggaaggctaaaaataatttttaaggctttggatcacagaattaggtttcaaaacatgatataacctatgaggtcatcacattctccacctctaaaacaatcgttcgtcctcgaatggatataaaaaactacctgggctggtgaaaagatgtggatatctactccgcatatctgactcgaactcccatgtatctgcctcgacagggtgacctctccactacactcgaactgaaggataactctttgatctcaactggcgaacctgccgggctagaatagccaccatctcctccttgtaaggaaaatctttgtccaactggccagatctaaaatctaacacgtgggacgaatcgtcgtgatacttccagagcatggacatatggattaccggatgaactactgataagaatgggggcaaggcaagcctgtaagccacatctcccactctctccagaatctcgaaaggtcaaatataccgagggctcaacttgcccttcttcccgaacctcatcacacccttcatgggtgatacccggagcaacactatctcttcgaccataaatgcaacatcacaaactctacggtcagcataacatttttgcctggactgagctgtgtgaagtctatcctaattaatcttgaccttatccaaggcatcccgcaccaaatctgtacccaataaccgagcctcccccggctcaaaccacccaactggcgatcgacaccgtctaccatataatgcctcatagggagcaatctgaatgctcgattggtagttgttattgtaggcgaactctgcaaaggggaagaactggtcccacgatcctccgaagtctatgacacatacgcggagcatatcctccaagatctgaatagtgcgcttggactgtccgtccatctgaggatgaaacgttgtgctcaactcaacccgtgtgcccaactcacgctgtagtaccttccagaagtgcgaggtgaactgcgtacctcgatcaaaaatgatagacactagcataccatgaattctatccacattaggcacacaaacatgaccctacatcctcaaaactctgtcatctccaacggtaacctgcttagcaccatcgtgctgcactatgtccctaaagaccaacaaatgagggtcgtcatactgccgatatctgatacgctcaaacaaagaagaccgagcgactgtgtaagctagaacacggctgggctctgaaatatccaacctcacaaactggttggttaaagtctaaacatctgatgcaagcggcctttcacagactggaatgaacgcaaggctacccatacttgctgcctttctactcaatgcgtcggccaccatattggcctttccaggatgatacaagatggtgatatcatagtctttcaatagctccaaccacctcctctgcctcaaattgagatcctttagcttgaacaaatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgctccgatgatccgtgaaaacctcacacgacacgccgtaaagatagtgcctccaaatcttcagcgcatgaacaatggttgccaactctaagtcatggacagggtaattcttctcgtgaaccttcaactgcagcgatgtatacacaattacacttccctcctgcatcaatattgcacagagccctacacgggacgcatcacaatataccgtataagatcctgaaactgtgggcaacaccaacatcgatgttgtagtcaaagcagtcttgagcttctgaaagctcgcctcacactcctctaaccatctgaacggggcacccttctgggtcaacctggtcaatggggctgctatagatgaaaatccctccataaagcgacggtaatagcccgccaaacccaagaaactcctgatctccgtagctgaagtgggtctaggccagttctgaactgccttaatcttcttaggatctacctgcatgccccctactggtacaacgtgccacaataaagcgactgaatccaaccaaaactcgcactttgaaaatttagcatacaactagctggctctcaaagtctgaagtacaatcctgagatgttgctcatgctcctgtcgactgcgggagtagatcaagatatcatcaataaacacgatcacaaagaagtccaaataaggcttgaacactcggttcatcaaattcatgaatgctgatggggcatttgtcaacccaaatgacatcaccagaaactcataatgctcgtatcgagtcagaaaaactatcttagggatatcggatgccctaatcctcaactgatggtagcaagatctcaaatcaatctttgaaaacaccttggcaccctgaagctgatcatataagtcataaatcctcggcaatggatacttgttcttgatggtgactttgttcaactgccgatagtctatgcatattgtcatcgatccatccttcttcttcacaaacaacacaggtgcacccagggcgagcactaggtctaatgaagcccttatcaaggaaatattgaaagtgttccttcaattctttcaactctggcagggccatacggtatggcggaatggaatttgtaggaaacacctctggaaactcacgaacaactggcactgaatccatggaaggaacctctgaactagaatcgtggacataagccaaataagctagacaccccttctcggccatatgttgagccttcacataagagataatcatactggtagaatggccaggaatccctctccactctaaccgaggcaacccggccaaggctaaggtcaccgtcttagcgtgacaatccaatatagcatgataaggtgacagccaatccatacccaatataaaatctaaatcaaacatatcgagaagtagaagatctacactagtcttaagactcccaacggttaccacacacaaaagataaacacgatctacaacaatggcatcccccacaggtatgaacaaatacacacgagcactcaaagaatcatggggcacaaccaaatatgaagcaaaataggatgacacataggagtaagtagatcccagatcaaatagaactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgttatatgactcagcctcaggcctggctggaaaagcataacatcggggctgggcccaccaccctaaactacatccctgggacgacctctagctggatggtctccacctctaatggcctaacctccacctctaacaatctgacctctacctctggctgcctgacatctgcttctcgctggctgaggaggtggtgcagcaactggtgccggaaccatggcacgagaaccctgatgctatggcgtgatgcccaataatctcggacaggtcctcttgatatgcctataaccactacactctaaacatccgtcctactgccgtggtggtagaaattgagattgacccgaatgggccggatgaccacggtagtaactctgaatagtggtgggctgataggagctggtggtgcactataggctgactgtccagaatgaggcacataagcaccacgactccctgaagcattgtgggatgcctgaagcactgaatgaaacaaactaagaggatggcctctacaaaaagtacccctacctccagatgaggcactgctgaacccaccagagtgacgaggtatcttgtcagaaccctgacctccctgagcaagaaccatctcgactcgcctagcgatattggcagccgcttgaaaagaaatctcactcctagtctccttagccatatgtaatctgataggctgagcaagttcgtcaataaacctcctcgccctatctctctcggtaggaagcagaagaagagcttgacgggccgaatccacaaaatgggtctcgtactgagtaacagtcatactgccctgcctgagacgctcgaactgacgactatgctcctctctcaatctaataggaagaaacttctctaggaagagctgagagaactggtcccaagtaagagcggccaatccagctgctctggtcaacaaataatctctccaccatttcttggcggaacctgacatctaaaatgcagcaaaatccaccccattggtctccactatacccattttccttagcacctcacgacagatgtcaagatactcctggggatcctctgaagaagcaccactgaagtgaactaggaagagcttggtaaacctatccaatctccataaagccttgaaagacatagctgacccatcaccggtctatgccgcaacaaccggttgaactactccgactggatgaactgttggagtctgatactggggaggcatctgctccagagtgtgagtagtaggagtctgtgctcctcctccaacctgagagacagccggtgccatggggaatgcgtcaatctgggtcacaatctccatacggcccaccaaacggaccaaaccatcctgaagtattggtgtgccaatgaacccctccgggacgtgagctagaacatcctcatcaaactctacctgaggctccaccgctggtgctgctgctcgagctctaggctaagttgtgcccctgcctcggcctctagcacgacctcggcctcgaactctgcccctcgtaggaggtgccattggggtctctggatgctgcgcagctaaagttccggtactcgttctcgctatctgcgagagaactgaatcgaagggtccaatcagcaatgataggataaatcgcatgacagagaagaatagaagtgaaattgtttctaactccatagcctccggaagataagtacagacgtctccgtaccgatcctccagactctactaagtttgctggtgactcgtgagacttatgcaacctagtattaataccaacttgtcatgacccgaaattcccacctttgggaccgtgatggcgcctatcatttcacttgctaggcaagccaatgttagaatataattagccattttaacacaattttaaattaatcaataacaaataaataaatgcggaaataaagtctgaaataaagtgaataattcataataaacgcgatatctaaataccatcccagaactggagtcacaagttcacgagcttctagagtaatgcataagagggtctggaataaatacaaagttgtctgaatgaaaatacacagctaaataaaaataaatacggggacatcaggagctgcgggtgcagagcagatgtacctcaagtcttcgcaggctgtccattatgagctctctagtagccgccactgggacagtttccaaaatctgcacaatgtgcagagtgtagtatcagtacaactgaccccatgtactggaaagtgccgagcctaaggcgggtcacctactctaccacctgaacccagtatataatcatgacagaaaataggaatactgaacaaaattaaacagccaactgaaaataataactacatcctcaagaataaaacagtgtcgtccaaaatcaccaatctttaataattcagatacaaataccaatagaaaaccaacacaactcaagaaatagaaacatatgggttgttgcggcgagcaacccgatcccactggacaacacaaattcctcccttatttcacagtaacgatatcaacaacagtacataatatatatatatatatatatatatatatatatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaccatatgtcaatatcagtatcaaaattcaccattatttcaccatgtcaatccacccttattcaacctgttttggcgtgtaaccccatcccaccgtatagtgcaaattcacccttattccacctcatcatatcacccttatttcacctattgcggcgtgcaacccgatcccaccatatcaatatcaagtactcaatacgcatagtaaaactcacaattcaaaatattacgattccaagacaccaaactgaacaaataggaaaccttgtacaatatgataatccgaataagtaatactacatatagagaccaatccagaatttacaactacaaggtacagataaaccaacttgagcaaatagtaggagattatgaaaccatggaaagaaataatattatgaacaggaggaaacaaagactacaaatagcaatttggcatgtaaacacatttagagcatataacaaataaaacagggaaagagataatataagaagaacggggaaacagggaaaaatagataattcggcggcgcataagccctcgtcacctgacatatactccgctcacatgaaattcacatagcaaatagtccgagggttcctaattcactcaagtaaagattagacacaatacttacctcgctccaaaggccactcaatgctccattaccacttttcctctagaatccacctccaaaccactcgtatctattcacaaacgactcaataatatcaaatattgctaaaaaatcaattacaatgcataaatttagattccccaaactttccctcaaaaagtcaaaactcgacctcgggcccgcttggtcaaaacccgaggttcggaccaaaatccatttatcaattcaccctcgagcccgattatataattagttttggaatccgatcccaaattgaggtctaaatccccaatttgcaaaaaccctcaattcttcctaaatctctagttttctaccatgaaagaacaaagattagggctaggaatttaataggtgatgttagaaatggaagaaaatgagttaaagagtacaaacctatgaattggtgttgagttttctcttcacaatctcacctaggccgagctctaatggagagtttacgaaaaatgggtaaaatctcgttttggttatgttttaaggtctgggcggcatgccttcttcgcgttcgcgaagggcctgccgcattcgcgatgtgcagcagcccgagtggctttcgcgttcgcgaagggcctgccgcgttcgtgatgtgcagcagcccgagtggctttcgcgttcgcaagtacatcttcgcgttcgtgtagaagaatgactgacccctccccctaggtccctaaagcttcgcgttcgcgaatggtaaggcccccattgcttcgcgttcgtaacccggctaccgcgttcgcgattaagaaaatcaccctgccccagtttactctacgtgtttgcgagagtacctctgcgaacgcgatgaaggaaacaccatataacagttgaagccaaaaaccagttttttttctaagtttcaaaacacctgtagcctatccgaaactcacccgagccctcggggctccaaactaaacatgcacacaagtcccaaaaacatcatacaaactcgcttgcgtgaccaaaacatcaaaataacgtatagaactacgaatcagactccaaatcaaatgaaattttcaagagaacattaaaacttctattttcacaaccgaacgtccgaatcatgtcaaataaactctgtttctcaccaaattcgacagacaagtcatgaatattatagtggacctgtaccgggctccgaaaccaaaatatagacccggtatcaacaagaccaaacatcagtcaattctaaaaatcattaaactttcaatcttttaatatttcatctaaattccatatctcgggatagggacctcggaattctattccgggcatatacccagatcacaaattacgatacggacctatcaggactggcaaaacacagatccgggtctgtttacttaaaatgttgaccaaagtcaattcaaattaattttgtaacgcaaaaattcttatttttatcagtttttaacataaaagctttttggaaaaatgcctggactgtgcacgcatatcgatgaaggctaaaacatgatttttaaggcttcgcatcacagaattaggtttcaaaacatgagatgacctgtggagtcatcacacccagtgattaaaacagatcaaaaacgggatttttcccatttttcacaaactgtccattagaactcggtttaagggcgatttcaaaggagtttttcacaatttagaactggataaatgttctttatcatatagtgattatatttcataaattcatgtctatattcgtcatttatttcggaattagatggaagaaattgggatttttataacatcttccaaaaatgtaaaatgaagatttgaaagccaatctaatgtcggattcgataatttttgtatggttcaactcgtatcagaacgggtgttcggttttcgtgagtttttcgagattcaagatgtgggtcccactgttgatttttaaaataaatttcagattttaattcggaaaattagtaaattcatatggaatcaattcctacgatttgtattgagtatattgaattgtttatgactagatttgagtatttcggatacgaattcgcgaggcaaaggtttattgaaatcttgaatttggttgcaaagcgaggtaagtgtcgtggttaaccttgacttgaggggaatagaacccttgaattatttgttacatgaatttcatgtgtaacgatgtataggaaaggtgacgagtgcctatactttgtcaaattaattgtttgaataattatttaaatattataaattgttttaagacacgaattaattgttataataattgtttctctcatattccctgtcaaatataaattcttggattcatgcaatatttgttacatgcttatttgatctatgtatcttaattgctacttgacatttagcatatttaatattaaattgcctattttctccctgatttttccataattaattctacttgtcattacatgtttcttgaataaataataatcattgtatgctttgttgccaaataaattcttattgaatgtggtatttattggagtatttttattacaattaagagttattaatttatattgttggaacgggttgcacgccacaacggaaatgaaaaggaatatattgggggatcgggttgcacgccgcaacagattacattttaagtttatattattggagtgggttgcatgccgcaatggaaatttattgaagaattatattattggatcgggttgcacgccacaacggaaattgattgaaattataattggttatgactgccaaattggcttcaactgttgaaataagttacatgttttatttctatcattgttgttattactattattgcgtacaggttaatgtaagtgacctgacttagcctcaccactacttcgtcgaggttaggctcggtacttacagagtatatggggtcggttgtactcatactatactctgcaattcttatgcagattttgaagttggtctcagcggcgtaccatagacttgctcggatttcagctatccagaggagacttgaggtataactgcatagcgtccgcagttctaaagtccccttctactttattttagctgtgtgatttctttaagacaactttattttattcaaacctttgtttgtattattctagaagctcgtgcacttgtgacttgagttcagtatatatggattaaataaataagtcttaatacattgggctagcccatttaatttggctaaagtggtgagcccgcttcattaagcccaatatgtcatcttcctagaggccaagtttggtgccacgtgtcaaatgatgtggcacgccaagtcaaacaaaagagccaataggatcgtgccacgtgtcaaaatgacaaggcatgccatgccaaattgaatggccaatgaaatcgcaccacgtgtgcaagtgacatgttctggccaatcaaatgcggccttgtcacacttcaatttgattgataggaaagagtttgttcttaccataactcttccctcccataactataaataggggtcgtcataacctagaaaagagaccaaaagttataacaagaagcaagagggagctcgtggatcaaacgttgcggatttctctaaaagctacaagcattcaagtgttctaaggattaaaagatcaagacgaagattcaagaacaagctacaagcccttggattaaaaatacgtcaagatcaagatcaagcttcaagcacttggattaaaataaaataaaattcaagattaatctcgaaggctcttttatttactattgaaaagaagaatcagaggattcatagagattgtaacacttaattatttgaaataatatactacgattgttgtgatattttcgatcttgattttattttctcaacgcaatttattgtctacaaattctggcacgcccagtgggacaatatctacctctcatcttaacttctcaatcaccaaagttcaagaacattgaaatggcttcaaagaaaatcaactccagttcaacttccaccaaggctgctaattccaggttctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttacttttggaagctttggaccagtaatgaggagcaaagcaagctcgttaggacaacaagcaccctatatgccgtccgtatcaacccctattttggatcttcatcctcaaaaggagcaagatctttcacaagtgcacctgaaggaggaagcgatcttgctaaaaagatcaagaaaattctctttactacttgagcaggatgatgacaccaaacgagctgaattattcgccaattgaaaagttgtgtttggcgctagtcttctcaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcaaatcacatcaagttcgtgatgtcaaaacatgtccttagtgatcgactagcaaggtggtacctccagtttcaacaatttgaaattgtatacatccctcgaaagctataaaaggacaagcgttagcggatgttttgccagatcaccctttacccgatgattgggagctaactgacgaactacctaatgaggacgcaatggtcattgaagtttagcctccatggaatatgtactttgatggtgttgctcattgcggagaagctggtgctggtgtagtatttgtcacttctcaaggtgaagttcttccctactcttttacgttgacgaaactctactctaacaatgttgctaagtatcaagcactaataattgggcttgaaatggctgtcgaaatgaagcggttgcaactgcaagtttttggtaactctcagttagaggtcaatcagcttctaggtagttacgaggtcaagaagcctgaactacgcccatatcatgattatgcgaaaaacttaatggggtggctcggtgatgtgactattcagcatgtgccaaggaaagaaaataagaaggttgatgctttagctgccttagcttcattattaaccctgcctgatcaagcgcaagttactgtctgccaaaagtgggtagtaccaccgccaaatgaggaagaaggtgaagaaaatgaactcaagcatcttgtcactgtttctgaagttgagaaagaagaatggcgacaacccattatcgactacttacgctatgggatacttccagaaaatcagaggagaaggactgaaatccgtcgtcatgcgcctcgcttcttttactacaaagatactctatacagaaggtcattcgagggagtactcttgcgatgcttaggggaataagaagcactccaagctttgcaagaggcacattctggggtatgtgggtcacaccagtctggtccaaagctccacttccataaaaatgggatgggatattattggccaacgatggtaaaagattgcttggactatgttcgaacatgcaaggcttgtcaattccatgcgaattttattcatcaacctcctgaaatgttgcacccgactatggcatcctggccatttgtctcttggggattggatgttattggaccactaccaaagtcctctggtgggcgcacctatacatcttggatacaattgactacttctcaaaatgggctgaagtcgttgctcttaaggaggtaaagaagaaaaatgtttcaagtttcattcgagtaaacataatcaatcgctttggcattcctctttacataataacggataatagaaagccattcgataataggttgatgaacaagatttgtgatctctttggcttcaagcaacttaactcttcgatgtgcaatgatgccgccaatggtctggttgaggcattcaacaaaactctatgtaacttgtttaagaaagtcgtctccaaatccaaacgtgattggaatgaccgtatagaagaagctatgtgggaatataggacaactcaccacacgccaacacaagcaaccctatatgcactcgtttatggagttgaagctgtcttgccactcgagcgtcaaataccttcattacgattagctattcaacaaggcatcactgatgaagaaaatactaaacttcgattagcagagttggaggctcttgatgagaaaaggttggaatctcaacagaatcttgaatgttatcaagctcgattgtctcgcgccttcaataaaatagttcgcccaagatccttttaagtaggagataaagtccttgccataagaagacccattattacttcccataaacctttagggaagttcacttcaaaatgggatgggccatatgtcgtgcaagaagattattcaagtggggcttacaagctggttgatgcagacggcatgagaatcggccatatcaatggcaagtttttgaagaaatattatccttgaaattgtaacgctccttgatgcatgagcctaaactgcacgttcctacactcctggcccgcatgagtctaaactgtgtacgccccaccaaaaaaaagagtctgctaggttgaaaaccttgaaagaggcggcctaggcaaaagttaggacaataaaaaaagatctgctaggttgaaaacctcgaaagaggcggcctagtcaaaatttaggacataaaaataaaatccacccattctgaactacggtatgacttgatcatcttcacagacgtacgtaggtagcttagagtttcattctgagttcagtcgtataagttcaaaagatacataatcccctaatcgttgtccaaatgaagtacgatgtaatgtaatccattcaatcagaacttgaaaatcaagttgagataccattcttctgttaaactttggatcccatttgatttaaagggagcaagcctttgtggtaaattggtatcttcaatggaatgattttagtcttttaggaggctacaaagtatttgcattgaagtctggggatttgctatgttttcatgttcatatgaccttcaagtttgttggtcttcatatccgctctctgccctaagaaaaaagggaagaggagaggcatcaaaagggaacacaagtataagaaggaaggttacttggcacaacgtttcaaattcagtgagacttgaacccaagatatttggtgagaatgtatatcttgaatttctattgatatcaagaaaaacgtcttgtgattctgaggcttccatacgaaaacataaaggttttggctaagtcgcgccaattcgaaactatcggtatatcaaattctgatgttgatttcgaaatattatctgaaactatcactaaggtattaaatcctacattttggatatgttttatattttaaagtcttgttttcaaaaaatcaaacggttcgtgatttcaacatttctacatcaagatataagagttttggtgaagtcgcgcaagtttgaaattgtcagcatgtcggaattttaagttaacttcgaaatattatctgaaactatccttaaagtattaaatcccacgttttggacatgttttatattttgaagtaaagtttccaagaaatcaaacggttcataatttcaacatttctacgccaagatatgaattgtttggtaacactgcgcaaatctgaaattttcaacatggtggaatctaaagttagtttcaaaatattacctgcggcgattcagaaggtgtttgatttcgaattttggatatgtcttagattttaaagtttattttctaaaaaatcaaatggctcatatttttgacgttctcacattgagatatatatctcctaccacaaaaggtacaaagatgatgaacaatattatcctcaaagaaaagggaggatgtacctccaaatacaaagaacttcgagacatgaacgccaacgacgtttaaaagaaagccatgttcaatcatggggacatcaatacatcatgataagcaaagaactattgatattaaaccgcaaagacaaaaaggggacattgatgaaaacgtgtgatataaagtaaaatggatagagttttcatttctaagaatagccactagttaatcaaatgcaaaaaaaaaaggaggcaaataaaatactctatatagactaatctaatcataaattgtaattcaccaagtctttaagggttgcctctaggtgttgtttcttcatctccacgtcggccaagtcatcagcagttgccaaggaaacatcagaacatctacggtactcctcttcaacacatgagactctagattcaatctctttaacctctttcttggcaacaccttgaagagctcttaactgtttcaccttctccttggcctctttgaaagactgactggcagcaaacaatctctcggccttctcccctttctcaatcaagacaagatcaagttgttccttggcgttttaaaatgactctgatttttcaacatccacaaccttgtcagaaagagttgaccgtgcctggtcatatgaagtggcaagctcaaagaaagatggcaataggccttttagaagggaaatatccacaccctttccgtccatctcctcgagagtcacttcaatctcgaattgaagagaagaagcattgtctgcggtaaggtccttgagtttggcatgaattttagcccaggcatttagaatgaaatccttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagagtcaagacaacctttcttccatcaaagatagacatggttggtgttgatcattggtgaaatttaggccccaatttcgctccaagactaggaatggaagtcgcctcttggtctgacttaggtattggaagtgatttcctcgagtctggctccgccacagatttgctactacttggggcttgctttggtgggacgccattgaaatgtgaacaccatttgcatgcatagaaaaggatatacggttagttaaattacttggatattataaaataatttgaatgttctaatcgttacctctttggtggtcgtcaaagtccttgaaacactaccgatgttgtcagtaatctcgactatacccaaattagcatctccttgtttgtttgaatatggcttcacccgcttgaagttttgatctccatgactactatcactctcgttttgggacggacgtttgttggaggtaagaacaatagtacctaatggaaaggaaccctcattggcttgatgagcctgaacatgtcccttaaagtcacatggtacaaccactttggattttaaagtaggaggttggccctccctgttatgctcttgaggcatgatctctaaaggtgtagcagtaactggcccagcggtattcaccaaagattgcaagtggttttcaaggaagcgtccatgcactatttctcaccaagacttataatcagacgagacatacttcttcattttgggcataatagggggaaatgtggcctttgaccaacttttacacaaaacacaaattcataaaagtttcaatcctttatctaaagagcactcatgaaaatcttgatctaagcaaccggggatgtcttgagaaaaaccgaattgacgactgaagcgatcagtgctataaggctccacgatgaaggtcgatccatttttcaaaggaaggtaattcgagagaatactcataaaataatttgacttggactcttccgcattgccatcatcacgataataatacggttgaggattgcttggcattgtggaagtccatacgacactttctcctccatgaatatgttttatcgcgtcatcattcccaaaatatctcgttgttccctcacatgagtataggccattagaggaatagacggcctatttgttatagcaaaatgagtcttgaagtagcaggctaaccaaccatacacataatgaattgggaagtaaactctagaagaatcgagtggtgagctatttgaaattgtgtttaatcccctgtaaatgctagctaaaactggaacggcgaggttaattctttgcccacacgccagaagtcctgcaatctttaaagtctcggatcgaataaagtcgccttattttgtaaggagcacaaagaaacataaccagcatgataaaaaggcagccaagtatacttcatctttcttgtcacttccaacgccaagtttaacaaatagtgcatcttcaacttccgaccaattgaccattttacctatggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttgatttgggacgagctgacttcttttcttttctcgctggaggttattcatactttaaaacatttttgctccaaaactcgatccatcttcttatagggacgttatgatttttagcgtttccctctcggagttggtgatatgcatcaaacaattactgacaggcttgtggaaggaacattttatccttgtcgtaaccacctgtaagttctcgagtatttggaataacttcctcataaggagaccccattaaagatagatccccaatagtgcacaaatcccacaggaatgtggattactctccaactgaggtaagcaacgtgtttgtaagaggacaccaagtctcacaaaagacttgcatgatacttgtagaatgatcataagtaaacaatgaggcatatacaacatcgtaaatattggtggcccttaatgctcgatggttcctactaaagaacatcttcggtccactcccaatagccggggatataatgaaattctccaccgaaagttaaggaatcactccagcatacttctcctttgaggattcgtcgtcctaagtatgggagggaacttgccacatttttaactttgtgattatgggaacgaagagtccatgtcttgaatttacgtttggtgttttcaaaggtccaatctaccaaagaaaatggattttgcaaggatggccacgaagctgcatataagccggttaatggtgtatcaactagtaatctggtctccgttttactatccttgtgctctgaaattactagatacttgggcgtgaaggaagagaatgttgagtctctgaagtaaactatgttcaagttgcataaaaaaaattattagtacctaagtcaaaagggaagagtaacaatcactgtcatgaaagatagcatggataagttaaaaaaaacaatcacctcagacgtaaaaacaaaaaggatgtctatgtcagactttttttaaagatttccgttgagaactattaaaggtttccttctcgaacttataaaggcattcgaatttttagaggttttcgttgcgaacatttaaaggtgttcgtttcaaagttttaaaggcattcggatttttaaggttttcgtttcgaacttttaaatgtgcttgtaaaggtgcacatgacgaactttaaagagtccccactgccgacttttaaagatttctaccataaatttttaagagtcttcattgtgtgcttttaaaggttttcaccgcgaacttttaaaggtcttcaccgtgaacttttagagatcttgaccacgagcttttaatgattattatgcgaacttttaagggtcttcaccacgaatttttaaaggtctccatcgcgaacttttaaaggtgttcgccgcgaacttttaaaggtcttgactacgagcttttaaggatcttcgcgtgaacttttatgagtcttccccgtaaattttaaaagtattcatcgcgcaaacttttatgagtcttccccacaaattttaaaagtattcatcgcgaacttttaaaggtcttcgtctcgaactttgaaagtacttcatggttcgacgaagttactacttctgagaaaaaaaaaagagacaacagaatacaaaaaaaagaaagcacaagagaagaagaagagaagaagaagaaattactttcgcgttaatgttttcaagccatcaaaagtagacgcaaagtgacttgcaaatgctagaattgacgttaagagaatgacgagtattggtatttatagatctcagaagacgctattaaaaaataaagcatcgatgtgggatagctgttttaattagactcctcgagggattcaaattgaaattggacctacgcatagtgtccaatagcgttgccttctgttctccttttccaattttcaatcaaagaaagaattgccattagcgtttgccatatgttctccttttctaatcaaagaaaggaattaggaattgccaaatccatatggattcggtcagcttgtaccgatggtccacaaaattgaggaaaatggcatctacattataataatgataataattattatctctcttggtaattacaatgattgaattcactttaatatttaagtgtggaccaaactaccaacatgctatcaacggacacgtaaccaattatacattgatccattatctgttttggcaaataggatttacatatactattatcaagtttatacttctaagtctagtcttcaaaaatttaaagaccttgacaagtcttgaagtaggggcattcgtagacatataaattttattaaaattaaattcataaaatgatttggactatattttaaattcaagataaattggtccaaatatatattatgggctaatataattgaattaattatataagtccaatatatatagattaaataaataagtcttaatcaattaggctagcccatttaatttggctaatgtgatgagcccacttcattaagcccaatatgtcatcttcctagaggcccagtttggtgtcactgtcaaatgatgtggcacgtcaagtcaaacgaaagagccaataggagcgtgccacttgtcaaaatgacaaggcatgccaagccaaattgaatggccaatgaaatcacgccacgtgtgcaagtgacatgttctggccaatcaaatacggccttgtcacacttcaatttgattgaacggaaagagtttgttcttatcatacctcttccctcccataactataaatatgggtcttcataacccagaaaagagaccagaagttataacaagaagcaagagggagctcgtggatcaaacgttgcggatttctctagaagctacaagcattcaagtgttctaaggattaaaagatcaagacaaagattcaagaacaagctgcaagcccttggattaagaatacatcaagatcaagatcaagcttcaagcacttggattaaaataaaataaaagtcaagattaagctcggaggatcttttatttactattgaaaagaagaatcagaggattcatagagaatgtaacactcaattatttgaaataaaatactacgattgttgcgatattttcggtattgattttattttctcgacgtaatttattgtctacagtatgatttattcaattttgtatttttagtttcttctttagatataatgtctatttgatccaattgtatattttatcttttcagatcaaatttataaaatcattagctagaaaaaatagttttagctaaaataataaagtaccaatggtgtattatttgttattttttagatgcaaataactatctatctaaattatgtatttttatttttgggtcaaattaataaaaatattggctagaactttattattttcttgcttaattaaaaaggtacaaccaacataggagttgtaattattttcagaaatatcacaatatttttgaaatgctacctactatgtttgtaacgacccaaccgatcgttttgacttttagaacctcattcccctaaataagactcttcgtatgtgtttttactaatttatgacttgcggggatggttggttcgggatttgaaagtgtttgggttgaaatcggaacactcagttccttgggttggctttaaaaggggcaagtttgacttcggttaatatttttagaaaatgaccccggaatcgtgatttgacgattccaatagttcgtatgatgattttgggcttgagcgaatattcgaatcggattttggacaaatgttcgaatcggattttggacaactcgggagcgtttcagcgcttaatagtgaaaaataaactatttaaaggtttaaggttctttaaatttggtttgtagtaggttttggagtaattgaagcacgtttggaatttcgagaccggaaatagttccgtaatgtcatttaagacttgcacgcaaaatttggcatattccgagtagttaaaatacgtttcagcgcattgggagtaaattgaagaacttgaagttcataagtttgattcaattggttttggggtgtgagttttagttttaatgttgttttgggaattttgagagtttgtgcaagtccgttttatgatttcaaacttgttggtatgtttgggtggagccccggggccccgagtgttaatcggacgaggctcgaaccaagttggaaatttggagccaaagctaaagctcccagctgctgtaagaatcgcacctgcgcttggccagctgcaagtgcgagctcgtaggtgcgagccacgagccgtaggagagaagaagaggaggggccgttgggcaccgcagatgcgtgcaaaaaaccacatcttcgaaggcgcatgtgcgaaggggtgaaacgcaagtgcggaggaaggcgcatgtgcggcttatagaccgcagaagcggtctcgtagaagcgagccgctgaccgcaggtgtgagcgaagcgggataaaggaaatctgcatttgcgagggaatttccgcagatgcggagacgcagaagcggcttgagaaccgcaagtgcgaaaatgctgctgggtagaatggtttaaagggaacgaggctcagtcatttttagcccatatttgctccattttgcgcgattttggagcttttgacagggaatttcaactagcaacttgaaggtaagttaattctgcaaactttgagttaaatacatagattacgggtagattataacctataatcttgaaaatcaagggtttagtacaaaacctaggttttgatacaaaacctaggttttgataaaaatgagattttaatcacgaaaatggctatggaattggatggaaattgtatatttgagttcttgagattatggataacgatttcctccaaatattttcggaatatgggcacgtgggcccggggtgaaattttaggaatattaatatttcgggttgggtaattaatttaatagcctaattttgaattattgagcatgtattattatttttcataacatttggatagtttcggaattttcggcaatgaattgagactttaacgcgacgttgttatcggaaagtgggctttgagacaaggtactcttgtctaaccttgtaagagggaatttaccccataggtgatttaaattaataatttttgctaattgtgggggactacgtacgcacgaggtgacgagagcctgtgcgtagctactaatattgctaaagtccgagtagtttaggactcaaatcatgaattatttgtgataattatatccctgtttaattaaagcagcagtattatgctgcaaattgttagaggaaatggtaaaagattgaaatctcacatacttgaaattttgttcagaatatttaactgttgtaaatatttgtacatcctcctgcgttaatctcaaaaatgtatatatatatatatatatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcctttcttgcggagcgggccaaatgcctcggcagtatagatgcatctatggatcgtgccgcacgtccctcggcaatgtacacgacactctggatcggttcgtacgaccacggcgaaaattgtgcctaataataataattacacgatatcttgatattttattacagcttgtgaagctaactggtaaattggaaattattggattctaaagggttaattatttctgctggttaaagaaatttattgttatttatataaatcatgttgatttaaatatctctattttaatattattgacccttagtgagtgtcaaagtcgacctctcgtcactacttatttgaggttaggcttgatacttactaggtacacgttgtttacgtactcatgctacacttgctgcacattttgtttgtgcaggtacgtatatgtctagcggccttgtgggcgcaaaggtgtggttaaatgtggggacttaggtgagttgtattctatattacaatacgcagcaatcagagtctccttcagagttatttatatttttcctgtctaatttgtatttcgaataaatgttgtattttattttactccctagtaaatactcatgcacttgtgacaccgggttttgggagtggttgtgggttgtttagtaatttagttgctaaagtatttattacttactctatgagttctatctttactatttaattgaagaaattttgatttcaaaaatactaaaatgggtaattaagttaattaactatgactggcttgcctgacagcggtgttaagcgccatcacgacttttaatggattttggattgtgacaacatggtatcagagcaataggttcacgtaggtctcacgagtcatgagcaagtctagtagagtcttgtggatcggtacagagacgtctgtacttatcttcaaggggctatggggctattatgagcacttccttttcttgatccctcatcgtgcgatttgattcctttgaggcttatgtctttgtttctttcctattcaatattattcgacgtgaaacgcttgttatcaactaggaatcggggaattttaattgtactatagatgtggtgcaggatgtttttccctgcgtatttgattgggctattatcgtcgtcttgcggaaggtcgctctatcgtttcagctcagtattagtattacttaaggttttgagattgggcattgattgttatgacgatttgtgcgttgctatcgcacaatgttgtgtaatggtatgatgcttgtctatgcgtcgaggcagtgaatgacttgaaaggaggttttacttggtgcatgattcaaagatttattattttatttccggtggagaaaaggcaatcagactacgaatgctcaggtttaggtcgatggggtaacgagacgtggtattttcgagcgtggtgtaaattttcatctgtgatgtgatgacatcgtccttgatggaatgtgttaagttcgccggcgttatggtcttcttcaattcgcctttggggcagaatattgtgaatgatgccggggaagcggctgttaggggtcgcagtgtgctgtctaaccttgtaagagaaaatttaccccataggtgatttaaattaacaattgttgctaattgtgggggggggggggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactcaaatcataaattacttgtgataattatatccctatttaattaaagcaatagaattaagacttaggagcgtgtctagaaaagctttttgaagtcagtagtggaatttggcttcaaatggagaaaaataaaattttggtaagtttgactggggagttgactttttgatatcggggtcaaaatccagttctgaaaattttcatatctccgttatgtcatttatgacttatgtacaaaatttgaggtcaatcggacttgatttgataggtttcggcattgaatttagaagttggaaatttttaagttccttaagcttgaattcgggtatgattcatggttttagagttgttttatatgatttgaggtttcaactaagtttgtatgatgttttaggacttgttggtgtatttggttgaggttctaagggcctctggtgagtttcggatggttaataaatcaattttggactttgcattccagctgaagaatgctggttttcagtcactgatttccttctacgcgatcgcatgagaatgtccgcgatcgcgtaggctaagttggagcagtgaaattttatgctatgcgatcgcatgaaggcatccgcgatcgcgtaggtttggccaggctgtgctacgtgaacgtgtggaaaatgccatgttcgcgaagaggaatgaggcagaaggctgggccacgtgtttacactatgcgatcgcgtgtggctgtcctcgatcacgtagcgctgaggatcctgtgcttcgcgatcgcgtagggtcttttctgggcagcttgcaattgcacttcgcgatcgcgggaccttgtctgcgatcgcatataagaaatgactgggcagaatgtttaagttctgatatttactgatttggagctcggggagaggcgattttcgggagtttttctaggaaaacatcagggtaagtattcttaactcaattttggttaaagtacccgaatttatgatagtttttaacatttaattggtggattaagttagaaaaattatgaaaatccttaagtctagatggaagatttgagggtcgatttgatgtcggaatttagtgattttggtatggttggactcgtggttgaatgagcgttttttgggttaaatttcggattttgttagaaaatttatattttcatatggaatttattcctataattagtattgattgaatcgaattaattatgactagattcgagccgatcggagtcagaaaatcgaggaaaaggcatactatttgactgattgagcgtggtttgaggtgagtgacttgtctaactttttgtaggaaaaattccccttaggattggtattgacatgaaaatgttgatgtgttgaaagtcgtataaacgaggtgacgagtctgtacacggactaaatgtggaagattgtatctttaaattttgtagagcactattgcatattaattaaattattttattctgttatatttaccatcattaatatattttcgtatttaaaatttgcctgacctgttcctgctaagtgttttacctatttagttgaaactctgtttcttttattctgtgcattatttgaaggatggatttcttaatttaaatattattaaaaatgaagtattatacatttaaaaattttatatttagacaaggtgttaaatttgtgaaaatattattttttctgaatattttgtgagattttcctactcaatgtgattgagccgtgagatccttattatggaaaatattgttgttgatttattctggcatgagccatgagctctttattgtggaaaatattagtattgttgatttattttggcatgagccgtgagctctttattgtggaaaatattattgttgttgatttattttcgcaagttcaaatatttggacacttgaggtgcaaattgtgatatattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatttatacgcatgcggtggtataaggtctgggtgttgaaacgcatgcggtaagataagggtggcttgatatgcgtggctagtaggggaactactgctatttcgggaaaaatattttctttaaaaaactttaatatgaaggttcccgtggtgatataagaaaatgagatattgtaaatttatttatgatttgggactacgaggcggtacctcgggagtgcccttattgatatttctttatggctacatttgcctttgattattatttgaccttattctgtgaagttaggttacatactacctacttgattcattttcatttttattttattgttattatattgttaaacattttactatgtcttttattatttccagcaggacctgacctgacctcgtcactactctatcgaggttaggcttggcagctactgggtaccgttgtggtgtactcatagtacgcttctgcacattattttgtattgatctaggtacttcctaccagcccagatatcagtgagttacctgtgtacggagacttcgaggtatatctgccagcgtccgcaaactccggagtcctcttctatccttattatgctgcttttttattttctttagactctgatatatagagaatttgaggaaaaattcttagaagcgtgtgacttattcctaccaggttttaggagttgtaataatgcgaatttgcagatttatttatttcaaacttctattgttattccgcattgagaggattacctagtcttggagactaggtgccatcatgacatcctacgaagggaatttgtggtcgtgacaagttggtatcagagctctaggttcattggtgttatgagtcacaagcaggtttagtagagtctcgcagatcggtacagagacgtatgtacttatcttcggaaggctatggaactgttaggaaaattattcccttctttgattccttatcgtgcgtatttgttgacttcaaaattttaaaccattgtctttctattctctcacagatggtgaggacacgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatatccgatgatcagacactcgtgctccctgttggaatcgcaagaggccgaggccggggcagaggccaaggaaggccacgtggtgtagccagagcacctgcatgagctgctgcagaggagccaccagtagctccagtttgaaagcaggcacccgagacgcctgttactacgcctgcacttgaggagactcttgcctaggatttgagcatgttgggcactctagctcaggcagggttgattctacttgcttcagccatatctcaggccgggggaggagcactaactcccgccgctcgtaccccagagctacgggcccaggttgaccacgccccgaaggttatacaagtgtagccagttgtcccagttcggcccgaggttagggcagcagtttcaaagagggagcagctcaggctcgagaggtacaagaagtaacacccacccacattcagaggtttagcttcagaggatgctcagggttttcttgaggaatgtcactgtatcctctgtactatgggtattgtggattccagtggggtttctttcacgatattccagcttagagaagcgtcctaccagtggtggcatgcatacgagttggacagtccgcctgaggcaactttactcacttggaatcaattttcatatatgttcttgagggagtatgttcctcagagtcttagaaatgcatggcgcacaaagtttgagcagctgcgccagggttctatgaccgtgtcaaaatatgctgtctgatttagtgatttggctagatatgcagcagccttagttgctactgttcgagagcgggttcattgatttattgaggggctccacctttgtattagattcagtatggcccgagaaccgaagatggacatcacataccaacaggtagtgtcaattgctaggagattggagggtatgcgaaatcaggagagagaagaaagggaagctaagagacctcgggattctggaacatataacagttctcgtgccccagctacagcctgtcatggtagaggctatgtgagtcgtcctattatttcagcactttcagtggtattccggctactcccagacctcaagttccatattatgcaccgccagtgtctattgtacctcctatacagggtgctttcagtcagcagtccagtcgatcaggcccgtgccagtcccagcagccacgtcctcctagggcttattttaagtatggtgacactcatcatattatgggggattgccccagacttaggaggggtgcacctccacaaatttctcaggccccacctattccacagggccctcaggcttctcaagccatgatcactgcacaagtttctactccacccgcatagccatctaaaggtggaggtcggacaggtagaggttgccctagagggggaggccaggccagatattatgcccttcctactaggacggaggcagttgcatcagattctattatcataggtattattccagtcaggctccacttattcttatgtgtcatgttattttgccctatatttgggcgtatcccgtgactctttaagttctttagtttatgtatctacacccgttggtgaatctattattgttgaccgcgtgtatcgatcgtgtttgattgttatctgaccagagctgatttattattgctcagtatggtggatttcgatattattttgggcatggaatagttgtttccctatcaagctatcattgattgtcacgccaagacggtgacattggctatgctaggtctaccgcagctagagtggagaggtaccttggatcatgttcgtagcagggttctttcatttcttaaggatcaacgaatggttgataaggggtgtgatacgtatttggcctatgtgatagatgttagtgttgatactcttaccgtggagttaattcctgtagtaagagattttcctgatgtagttccagcggatcttccgggtatgccacccgacagggatattgactttggcattgatttgttaccgggcactcaacccatttttatttcaccatatcgtatggtcccaatagaattgaaggaattaaaggtgcagttacatgagctgcttgataagggttttgttcggcccagtgtatcgcatttgggagctcctgtcttatttgtgaagaagaaggatggttctatgcggatgtatattgattaccgccagttgaacaaggttacagtgaagaacatgtatccattgcctcgtattgatgacctatttgatcagcttcagggtgccagagtgttctctaagatcgactgcgttcaggctatcgtcaattgaagattcgggagccagatatcccgaagactgcttttaggactcggtatggtcattatgagctccttgtaatgtcatttgggctgaccaactccccagcagcatttatgcatttgatgtacagtgtattccggtcctgtatttactccttcgtcattgtgtttattgacgacattatggtgtactcccggagcctagaggatcatgaacaacacctgaggactgtgcttcagactttgagagaaaagaagttgtatgcaaaattttcaaagtgtgaattctggcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtaacgaacaaggggatccaggtagatccgaagaaaattgaagcagtacagagttggcccagacgttatcagctaccgagatccggagtttacttgtcttggcgaggtattatcgctgatttgtagagggtttctcttctattgctacacctatgaacagattgacccagaagggtgatccgtttagatggaccgaggattgtgaggagagctttcaaaagctcaagacaactttgactacagccccattattgctattgcctataggttcagggtcttatacttataaaccagtttgatgtcacgactcaaaatcccaccacatgcatcgtgatggcacctagtctcttagactaggtaagccgatttcaattacattttgaagcaatttttttaattaaataagtaaccaaaactaacagcggaataaatatgaatatacaactgcccaacactggtagtactgagtcacgaactctaactgaatacatggaatgatcacgaggaccgaatatgcaatactgtttgattataaattaacagtacaataaaatgaaaagaccccaagggactgcgacgtccaagcagctctaccttgaatccttacgatcccgctttaactctgctcaagtccgatatctccaatacctggctctgcacaaaaatgtgcagaagtgtagtatgagtacaccacggtcggtatccagtaagtatcaagactaacctcaatggagtaaagacgaggtacagtcaagacactcactagtttaataacctgtgcaatataatatacaaaataataggaaacaaataatatcaaggcaacataaaacaaccaatgatatgcacagtaagacaatgaaatcaccatttaatatctctcaacaattaataaatacaattacacccagttaaatcaagttcttcaattaaatatctttcacatataattcttacgaataaaactctttctcaaatataatttcgtcgaataaatatctttcaaatataattctttcatataattattcttgaataaaaatcctttcaaataaatattttgaatatagttctttcgattgaagagtcaccatgtgacacctcatttcaaaatcataaaaatacgggtcttggcccattttcatatttttcgtaaacacgggtctcaacccatttttcatattttcacgacacctcgtgcccataattaaatcatcatatttttcctgcacctcgtgcccttatttcatatcacaacggcacggacaattcacgtgccaaatatcatcattatttactcacggcacctcgtgcccacatttcattttataatccacctggcaataaccacaggctctcaatttcaacataaatcagattgttattaatttaccaacaacaaaacaaattgcacaaggtataaaaataaacacaagaaaatcacaacatcacatgaaaatcatcaacaccacaaccctacatcatcacatatcgtccctgacaatagccatccttatcgctcctattgccacccttatcgctcctatagccacccttattgtgatgaaatgataatgatattggcacgtgaattgtccgtgcagttgtgatatgaaatgagggcacgaggtgccgggaaatatgatgatttaattatgggcacgaggtgccgtggaaatgggcgagacccgtgtttacgaaaaatatgaaaatgggctgagacccgtatttttatgattatgaaatgaggtgtcacatggtgactttttaattgaaagaattatattcaaaatatttatttggaaggatttttattagaaagtattatattgaaagaattatatttgaaaaataattatttgagaaaattatatttgaaagagagttatttggaagaattatatgtgaaagacatttatttgaaggacttgatttaattgggtgtaattgtatttattaattgttgagtgatattaatggtattcttgttgtctgttgtgcatatcactggttgttttatcctgcccttattattatttgtttcctattattttgtatattatattgcacaggttattagactagtgagtgtcttgactgtacctcgtctctactccattgaggttagtcttgatacttactgggtaccgaccgtggtgtactcatactacacttctgcacatttttgtgcagagccaggtattggagatatcggacttgagcagagttaaagcggatcgtaaggattcaaggtagagctgcttggccgtcgcagtcccttggagtcttttcatttcattgtactgttaatttgtaatcaaacagtattgtatattcggtcctcgtgatcattccatgtattcagttagagttcgtgactcagtactaccagtcttgggaggttgtgtattgtaattatttctgtgtttttttatttaaaaaaaaatggcttcaaaatgtaatagaaatcggcttacctagtcttagagactaggtgccatcacgacgcctgtggtgggattttgggtcgtgacaagttggtatcagagctctaggttcataggttctacgagtcacgaacgagtctagtagagtcttgcggatcggtacggagacgtctgtacttatcttcgagaggctacagaactgttaggaaatttccatttctttcattcctgtcgtgcggaatttgttgaatttggaatttgagcctttgtatctctattctctcacagatggtgaggacacgtgctaccgggttagctgagcaggcatccgcatactgctagggctgcaagaggcccgaggtagaggtcgaggaagggcacgtgctgcgactagagcacctgtcagaacaacagttgaggagccaccagtagctccagttgggggacaggtaccagaagcacctgttgttacccccggacttcaggagactttagcacagttcctgagtatgtttggtacattaactcaggcgggattgatctctgttgcaccaaatattccgcagattgggggagtagctcagactcctaccacaactccagagcagcaggttcacgttggtcaggttccgggtgtagtaccggtacaacctgttattccggttcggcctgaggtcaggccagaggcatcagaagaagaacaaaagagacttgaaaggtttaagaggtatagtccacctactttcagtggcacaactacagaggatgcccaaggatttctagaaaattgtcaccgtattctccgcaccatgggtattgtggaagtgagcggagttgcctttactacatttcaactgtcaggcgcagcgtatcggtggtggcaaatctatgaagaaggtagaccagccgatgcaacaccaccaacttgggctcaattttcggaaatgttcttgaaagagtttgttccccagactctccgagatgcgtggcgcacagagtttgaacggttgcgtcagggcactatgacagtgtcagaatatgctatcaggttcagtgagttagcccgtcatgcacctatcttagttcctacaatcagagaacgggtccgcagattcattgaggggctcgattatgatattaaaatatgcatggctcgagagttgcaaactgatgctccatttcaacaagtagtggagattgcaaggaagattgagggtgttttaggcgaggaaagggagtctaaggaggccaaaaggtctcgaagatctggagggttcagtggattttactcttcagctagaacccattatagcggaggctcgagcagtcggtcagctcagtccgcacatcagattactcgggtgctccagtttatagtgcaccaccgacacgagattcttacagtggttattccagttatccggcacagactcagtacgagcagccgacctcagaggggttgttatgagtgtggtgatactaggcatatcatgagagattgtcccagacttgggaggggtggatttcatcagaacactccagctacaagctttattccagttgatactccacgtgcacagtcagctagaggtggaggacaggcgggtagtgggcgcctaagaggtggaggcccgacccgttgatataatcactatgatttggctgaggccaatacaccagatggtgtcgttacaggtacgatcctgatttttattataaaaggatattttccttaatttgattcggttctgaatattgaggtgagtcctcctattatgctccacttatgggtgagcttcgtaaatttgtgacccacttatatgtttatccctgttgggagatttaaagatgtgagcccgtgtctgtcattttatttttgtacaccattgagggctataagtccaaaagtaatttttattattcattacagtgggtttaatgtgtttcggaataattgattccaatttttatgaattatatgccctaccggtatgagggttcattatatgttgtgaaaatttttatgaaatatattgaaaagaagaaagaaaggaaattgaaaatttcagttggcacaatgtgcaacatacttgtgattcggagttgaggatgagatcctcgcatttttacatgatgtgaaatatttaaaccgggctgcaagtggaagttatgtaaggacgaggtccttgtggtgaaatatttatgagtttaaaatttttcctttgtgaaatttaattgtacaatagtattaatagggagtcatgcctgttaggcttatttgataattcttgtatatttttctgtgcatattcagccattttcgtgctgtaaacattgagttttaacctatgagatgagtgcccaggtggcgttaaatgtgactcattaatccgagtaagcaatcatgaggtcttcatgcctcacattctgttgtcagtgttgtgaaaattcgaaatgaggtggtggttaatatgagattaattgatgatgctggaattaattatgaacaacttttaagaccagagatgtggtgatgagcatacatatgatgtgcttcatgtcctgatatcattatgataatgcagtgcttgtaatgctgagattggtgttattgatatataccttgtggtattttgttgggttgtggatgtgttgttaggagttgttttggtgttactctggcaggtggataggcccaattacaggggagactctgccgaaatttctgaaaaatttgggagttagtaaaatttgaaggattgagaattgcaaaggaagagataaattatgttatgtgtttgagggcgaatgatcctaagcggggaagaatgtaaacccagaaaaagttttgaagtacttcaacactatcaagaaagttgatgtgtgcataggcacgagttgctatagccagttgagactaataccgtgcgtcgaagtgaaaatcaggcattttggaaatgattggagagttagggattttgcttaaagcttacaagaatggagaaaagaaataatctcaaatgagatggtgttgtcgggcttatctcaaatgcgtaacgtgggatcaaccgtgagtatatgtgtaaaagtaaaatcatcaatttggtaacctcagaataattcttagcacgttcgaggacgaacgtttgtttaagaggtggagaatgtaacgacccgacttgtcattttaagaatttatgcccgttcagtgacttaaggtctcgagcagcctcgcaatatgtattatgacccgcgtgtgtggtcgagtttgatttacggatgattcggagtgatttgggacacttagtccctaagacggaagcttaagtcttaggattttgaccgtagtcggaactgtgtgaagacgactccggaatggagttccgtcggttccgttagctccgttgggtgattttggacttaggagcgtgtccggactgtgaatctgaggtctgtagccaatttaggcttgaaatggcgaaagtcgaatttttggagaattggaccggaagtggactttttgatatcggggtcggaatccgattccggaagttggagtaggtccataatgtcaattatgacttgtgtgcaaaatttgaagtcattccggattgatttgatgtgtttcggcacaagttatagaatttgaaagttcaaagttcatagattttgatttggggtgcgattcgtcgttttgatgttgtttgaggtgatttgagaattcgactaagttcgtatgatgttttaggacttgttggtgtatttggttgaggtcccgggggcctcgggtgtgtttcggggtggtttcggatcatttcgggctgtttcggaactgctgtatctggtatctgacttccttcttcgcgaacgcgaagagagtcacgcgaacgcgaagaggagttttgaggctgctgggatttggccttcgcgaacgcgaaggagggctcgcgaacgcgaaggtatgcctgaagaacctacgcgaacgcgaggggccagtcgcgaacgcgtagaaggaaggaggggactgggcctggagtcatcagccttcgcgaacgcgaagcttcaatcgcgaacgcgaagcagtaggacctgagtgcatcgcgaacgcgagagcttgaacgcgaacgcgatgatatgcatggcaggccttcgcgaacgcgacgctggtaacgcgaacgcgaagaagaatttgaggcagcgagtttttggccttcgcgaacgcgagacagaggtcgcgaacgcgaagaaggcctatctgggcagaattaaaagtcccaaaaatgggggtttgagttcataactcaaaatctaattgggagctcggtagaaggcgatttttggagagattcttgcgtgggtgtttggggtaagtgattcttatccagttttgattaatttccatgattatgtctttgaatccatcatttaattcggatttaatggaggaaaaatcaagatttttgtaaaatcttccaaaaacgaaaaatttaagatttggaagtcgagttgttattggaattcgataaaattggtatggttgaactcgtatcggaatgggtgttcggatttcatgaaaattatgtcgggttccgaggggtcccgcgttgacttttgttgactttttggaataaatttttaagtcgacgtattattatccggaattatttccgatgaattttaatgaagttatacaattaatttggatagatttgagctgtccggaggtcaattcaagcaagaaggctattttggaatatcggcctaacttcaaaaaggtaagtgtcttgcttaacctcgagtgggggaattaccccttaggcattgagtcttatgtgccatttgtgaaatgtgaaaagccgtgtacgcgaggtgacgagtacgtactcgggcttatacgtgcaaaaattcattgaattaaagtcttaggcattattgtgtagtaaattggaaaattgtggaaaattattaaatcatctgtttgccatgcctaaatccttattgttgaatttgtttttatatgataatttgatgtgattgttacttgaaatatttatgaaatttcgtgagtattgttggtttaatatttcttggaaattaattccaatatgaattttcttatgcaaataattaatttaagcgagcttaagaataagtgttaatataattatctaaatttgcattaatgaaggttttgctttatgctgagtaatttctatctctattgattgtttttgggtgttatatacattgtgtggagccttgggctatttgttgtgaaattaattgattttgttatatctttggaatttggttgtggccattgggcaaattgtgatatgaattgattttattatattgtgtgtaattttccgtgtaaattgttgtgttgtgtgagttattattttggtgctccgtccagacaatatcaatagccacccttatcgctcctattgccacccttattgctcctatagccacccttatcgctcagcccagacaatattccaacaaacacaacaacattgatatgccacccttatacccacataatatcaacggtgaaatgccaccctttatctctccaaaataataactcacaaaacacaacaatttacacggaaaattatcacggtaacataacaaaatcaattcatatcacaattttcccaatggccacaactaaatcccaaagctacaaccaagtcaattaatttcacaaaaaatagccaaaagctctacacaatgtatacaacacccaaaaacaatcaatagagatagaaattactcaacataaaacaaagactatattaaattcaaattttcaataattatataaacacctcttcttaagctcatttaattaattatttgcagaggcaaaatccataatgaaattaaattccaataattatcaaaccaacaaattaacggaattacataaataatcaagtaacgatcacataaaattatcatataacaacatattcaaaaataacaaagatttaggcacaacaaatatatgattaaatatataccaacaattacccaatttaccacacaatatgctcaagactttaactcaatacaatttacacatataagccgagtacgtactcgtcacctcgcgtacacgtcttttcacattttacaaatggcacataagactcgatacctaaggggtaattcccccactcgaggtttagcaagacacttaccttttgaagttatgccgatattccaaaatcaccttcttgcttgaattggcttccagaccgctcaaatctattcaaatcagttgtataacttcattaaaattcatcggaaataatttcggataataaaacgtcgacttaaaacaatattccaaaaagtcaacaaaagtcaatgagaggcttgcccctcggaatccgataaaattttcatgaaatgcgaacacccattccgatacgagttcaaccataccaattttatcgaattccaataaaaactcgacctccaaatcttaaatttgtggtttatgaagtttctacaattgtttccaactttccatctgaaagtactaattaaatgatgaaatcagtgatatattcatgtatattaaccaaatccgagttagaatcacttaccccgatgaatttcttgaaaaacccacgaaataacgtctcaaactgagctcccaaagtccaaaaatgaaataataacctcaacctcggatatatagtacatcctctgaacttccaatgtgcggtccgtacaaaaatggcgtggctgcaatccccagctcctgcggtcacacaaaaatggtgcggccgcactttacagccttttcttctaccaggcttcagtaaattggccataacgtttctctacatatgttctaattatgatttctttatctttctggaacctagatatgaagggctacaactttcgtttttgaatcatctcaaaattccttgtagatcaaaagatatgagcttctgaagtcggaccagcaaatctgagagttcttgagcgcggctgcacacaaaattgtgcggtctgtgaactctactacggactggagcacggttcgcacctgaattgtgcggtccgcgaaattcccctaaggtccgcacttccctttttgcctcagcactcccgaaactcatacggaacctcgtggacacaaaccatatatgaatttcaatcataaaacacgctacggacctgctcgcgcactcaaaacactgaaaagaggtcgtcttgactcgatattgactatggccaaactcccaaatttcttaactttactaatctctcagccaatgatccaaaaatacacccaagcccctcggaacctcaaccaaatataccaacacgtcccaaaatacaatacgaacttagttgacgcttcaaatcttgtcaaacaacataaaaattacgaatcacgcatcgaatcgaatataagtttttcaaatcttccaacttatatattttgcgccgaaacgtatcaaatcaatttggaatgacttcaaattttgcacctaagtcataatttacgtaatggagctattcccatttccggaatcgaaatccgacttcgttatcaaaaatttatccttcggtaggattttccaaaatcttctatttttttcaactttcaccaaaatgcgtcgaattatcctacagacttccaaatccgaatcaggacatatgtcaaagtccgaaatcaccatacgaagctattgacatcatcaaaattctattccaaagtcgtttgctcaaaagtcatctctccggtcaactctttccattttaagcttctaaaaaagaattgttcttttaattaaattccgaatcttctgaaaatcaaacttgaccacacccacgggtcataatacttattacgaagttgctctagaccttaagtcactgaatggggggttaattcttaaaatgacaagtcgggtcgttacattctccacctcttaaacaaatgttcgtcctcaaacgtgctaagaattattctgaggttaccaaattgatgattttacttttacatatatactcacggttgatcccccattaccgcatttgagataagtccgaccacatcatctcatttgagattatttcttttatccatatttgtaaactttaagatcaatttcttacactccaaacattttcaaaaggcctgatnnnnnnnnnnnnnnnnnnnnnnnnnnnnnnnnnnnnnnnnnnnnnnnnnnnnnnnnnnnnnnngcacggtattagtctcaactggctatagcaacttgtgcctactcacacatcaacctttttgatagtgttgaagtacttcaaaaaatttcttgggtatttcattcttccccgcttaggatcattcaccctcaaacacataacataatttgtctcttcttttgcacgccccaatcccccaaatttttactaactcccaaatattttagaattttcgacatagtttcctctgtaattgggccaatccacctgccagagtaacaccaaaacaactcctaacaatacatccataacccaacaaaacaccacaaggtatatatcaataacatcaatctcagcattacaagcgctgcattatcataatgatatcaggacatggagcacatcatatgtatgcccatcaccacatctctagacttaaaagttgttcataattaattccagcatcatcaatttatctcatattaaccaacacctcattttgaattttcacaatagtgacaacagaatgtgaggcatgaagacctcatatctattcacccgacttaacgagtcacatttaacgccacctgagcactcatctcataggttaaaacttaataattacaacacaattatgccacataaatacataaaagaattatcacttaagcctatgaggcatgactccctattagtactatagtacaatttaaacttcacacagggagaattttaaactcataaatatttcaccacaaggacctcgtccttatataacttccaccgcggcttgtagcccagtttaaatatttcacatcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatctcgtcctcaactctaaatcacaggtgttttgcacattgtgccaactgaaatttcaatttcttttctttcttctttttaataaatttcataaacatttttcataacacataacgaaccatcataccggtagggcatataattcataaaaattggaatcaattattccgaaacacattaaacccactttaatgaataataaaattacttttggacttatagccctcaatggtgtacaaaaataaaataacagacacgggctcacatctttaaatcttccaacagggataaacatataagtgggtcacaatttacaaagctcacccataagcggagcatattaggaggacttacctcaatattcagatccgaatcaaattaagggaaaatatcttttttataacaaaccaggatcatacctgtaacgacaccatctggtgtatcggcctcagccaaatcatatcgattatattaacgggtcagacctccacctcttaggcgtcctctacccgtctgtcctccacccctaactgattgtgtacgtggagtagtaactgcattggggcccatagactgagtgttttgataaaatccacccctctcaagtctgggacaatctctcataatgttcctagtgtcaccacactcataacagcccctctgagatcgcgattgctcatactgagtctgtaccggataactggaataaccattataggaatcccatgtcggtgttgcattgtaagaacttactggagcactccgagtaatctgatgtacggactgagctggccgactactcgaccctccgctataatgggtcctagatgaagagtaaaatccactgaaccctctagatcttcgagaccttttggcccccttagactccctttcctcgcctaaaacaccctcaatcttccttgcaatcttcattacttgttgaaatggagtatcagtttgcaactctcgagccatgtatattttaatatcataatcgagcccctcaatgaatcttcagacccgttctctgattgtaggaactatgataggtgcatgacaggctaactcactgaacctgatagcatattttgacactgtcatagtgccctgatgcaaccattcaaactctgtgtgccacagatctcggaaagtttggggaacaaattctttcaagaacatttccaaaaattgagcccaaattggtggtgttgcattggctggtttaccttcttcatagatttgccaccaccgatacgctgcgcctgacagttaaaatgtagtaaaggcaactccgctcacctccacaatacccatggtgcggagaatacggtaacaattttctagaaatccttgggcatcatgtgtagctgtgccactgaaagtaggtggactatacctcttaaacctttcaagtctcttttgttctttttctgatgcctctggtctgaccttaggccgaaccggaataacaggttgtaccggtactacatctggaacctgatcaacgtgaatctgctgctctggagttttggtaggagtctgggctactcccccaatctgcgaaatattacgtgcaacagagatcaatcccgcctgagttaatgtaccaaacatactcaggaactattctaaagtctcctgaagtttggtggtaacaacaggtgcttctggtacctgtcccccaactggagctactagcggctcctcaactgctgttctgacaggtgctctagtcgcgacacgtgcccttcctcggcctctacctcttgtggccctagcattatgcgtgggtgtctgctcagctgacccggtagcacgtgctcaaattacaaattcaacaaattccgcaaaacaggaatgaaagaagtggaaatttcttaacagttctttagcctcttgaagataagtacagacgtctctgtaccgatccacaagactctactagacttgttcgtgactcgtagaacctatgaacctaggactctgataccaacttgtcacgacccaaaatcccaccacaggcgtcgtgatggcacctagtctctaagactaggtaannnnnnnnnnnnnnnnnnnnnnnnnnnnnnnnnnnnnnnnnnnnnnnnnnnnnnnnnnnnnnnnnnnnnnnnnntttctttttgaattaaataagtaaccaaaactaacagcggaataaatatgaatataaaacctcccaagactggtagtactgagtcacgaactctaactgaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggaccgaatatgcaatactgtttgattacaaattaacagtacaatgaaatgaaaagaccccaagggactgcgatgttcaaccatctctaccttgaatccttacaatcccgctttaactctgctcaagtccgatatctccaatacctggctctgcacaaaaatgtgcggaagtgtagtatgagtacaccatggtcggtacctagtaagtatcaagactaacctctatggagtagagacgaggcacagtcaagacactcactagtttaataacctgtgcaatataatatacaaaataataggaaacaaataaaatcaaggcaacataaaataaccaatgatatgcacagtaagacaataaaatcatcgtttaatattgctcaataattaataaatacaattacacccagttaaatcaagtacttcaattaaatatctttcacatttaattcttacgaataaaactctttttcaaatataattctttcatataagtcttcttgaataaaaaacctttcaaataaatattttgaatataattcttttaattaaagagtcaccatgtgacacctcatttcaaaatcataaaaatacggatctcaacccattatcttatttttcgtaaacacgggtctcagcatatttttcatatttccgcggcaactcgtgcccataattaaatcatcatatttccccgacacctcgtgccctcatttcatttcacaatggcacggacaattcacgtgccaaatatcatcattatttactcatggtacctcgtgcccacatttcattttataatccgtctggcaatagccacaggctctcaatttcaacataaatcaaattgttatcaatttaccaacaacaagataaatttcacaaggtataaaaataaacacaagaaaatcacaacatcacatgaaaatcataaaacaccacaaccctatatcatcacatatcgtccctgacaatagccacccttatcgctcctattgtcacccttatcgctcctatagccacccttatcgctcctattgtcacccttatcgctccgatagccacccttatcgctccgcccagacaatatcaatagccacccgtatcgctcctatagccaccgttatcgctccacccagaaaatattccaactaacacaacaacagtgaaatgccactcttatacccacataatatcaacggtgaaatgccacccttatctccccaaaataataactcacaaaacacaataatttacatggaaaattatcacggcaacataacaaaatcaattcatatcacaatttgcccaatgaccacaaccaaatttcaaagctacaaccaagtcaattaatttcataacaaatagccaaaagctccacacaatgtgtacaacacccagaaacaaccaatagagatagaaattattcaacataaagaaaagtcttcattaaattcaaattttcaataattatataaacacctcttcttaagctcatttaattaattatttgcagaggaataattcataatgaaattaaattctaataattatcaaaccaacaaattaacggaattacataaataatcaagtaacaatcacatcaaattgtcatatacacaacagattcaacaacaacaaggatttaggcacgacaaattgattaaatatatgccaacaattacccaatttaccatacaatatgctcaagactttaactcaataaaatttacacatataagtcgagtacgtactcgtcacctcgcgtacacggcttttcacatttcacaaatggcatataagactcgatgcctaaggggtaattcccccactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggttaagtatgacacttacctttttgaagttatgccaatattttaaaatcgccttcttgcttgaattggcttccggaccgctcaaatctattcaaatcagttgtataacttcattaaaattcatcgaaaacagttccagataataaaacgtcgacttaaaaatttattctaaaaagtcaacaaaagtcaatgcggggcccgcccctcagaacgcgacaaaattttcataaaatctgaacacccattccgatacaagttcaaccataccaattttatcgaattccaataacaaatcgacctccaaatcttaaatttgtgatttatgaagtttctataattttcccaaatttccatcttaaagtactaattaaatgatgaaatcagtgatatattcatgtatattaaccaaatctgagttagaatcacttaccccgataaatttcttgaaaaaaccacgaatatcgtctcaaactgagctcccaaagtccaaaaataaaataataacctaaacctcggatatatagtacatccatagaacttccaatgtgcggttcacacaaaaatggcacggctgctcctgcggtcgcacaaaaatggtgcggccgcacttcacagccttctcttctattaggatttagtaaattgaccataactttctctacagatgtcagaattatgatttcttaacgtttttggaagctagacacgaagggctacaactttcattttcgaatcatctcaaaattccttgtagatcaaaagatatgagcttctgaagtcagaccagcgaatctgagagttcttgagcgcggccgcacacaaaattgtgcggtccgcgaactccactgcggattggagcacagtccgcacctaaattgtgcggttcaagaaattcccctgaggtccgcacttccctttttgcctcagcactctcaaaactcatccggaacctcacggacacaaatcatatatgaatttcaatcataaaacacgctacggacttgctcacgcactcaaaatactgaaaagcggtcgtcttgacccgatattgaccatggtcaaactcccaaatttcttaactttactaatctcttaatcaatgatccaaaaatacaccaaagcccctcgggacctcaaccaaatatactaacacgtcccaaaatataatacaaacttagtggaggcttcaaatcttgtcaaactacgtaaaaattatgaatcgtgcatcgaataaaatataaatttttcaaatctttcaacttctatattttgcgccgaaacgtatcaaatcaattcggaatgacttcaaattttgcatccaagtctaattgacgtaatggagctattcccattttcgaaatcaaaatccgacctcgttatcaaaaattcatctttcggtaggatttttcaaaatcttctattttttttaactttcgccaaaatatgtagaattgtcctacggacttccaaatctaaattcggacatacgtcgaaattcaaaattaccatacgaagttattgacatcatcaaaattctattctgaggtagtttgctcaaaagtcaactctcaggtcaactctttccattttaagtttctaaataagaattgttcttttaattaaatttcgaatcttccgaaaatcaaacttgaccacacccgcgggtcataatacttattacgaagtttctcgagagcttaagttactgaactgggcgttaattcttaaaatgacaagtcgggtcgttacatttgaccagcttataagattagccaaacaccctctaaaaagcctcaattttaaataatgcaaatagtatggagataaaatatggaaaaaaataccctatctgaaatacagaaaattttagtataatatgttgaataatggagttactatgtataaacttccagcatattatgttggaactccagtacattatgctggaatcttatgtgtaaaaaatttgagctccaacatattatgctagatttcttttcgtattttaaggatatttttgttcaggttttattttacataaaaaaatagctaaattttgattacctttgaaactacggctaattttctattagctcatgtaaatcaagctgtttgtttttcctttttaaatgggctaaaaagccagcccaaccgaatgtaattataccatgctaagttcagttggctcgataggtcaagttcattttgacaactttattaagatgtttttacatgatgatcttttttaaagagttagtaatataaatggtattacttttgttttattccaaaaatagcaaaatcatttatcattgtggcttattttaaaatctcatacgtttaattgcctacatattttaaaagattcattaattaatgaatcactaattaagggatgaatcattaacttattctcctttatccctctcaaaacctaatctcgttttctcttcccttcatacaaacgactccattcactctctcccttcttatttttcatctgtatgtttttcaacttgaccataatggctccttcattattacataaatatattatgaataatatgttatgtatttttatatattctataaatataccaagaatatgctctagctaaaataaatatgcgcaaacacatatagattatatcattgttgtattatttatataattaaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattagatatgctatatgccagaaattatttcataaatatataatgaatatattatatactatatatatttttagtataattaataatattttttagatctcgtttgttgtataaatcataattatagctcatacatataccacgtatttttttgtgaattataggatttggtattttaaatttatatttatcttggttcacacttacatacacacaccataatcatatcgtgtataactatcagaatatcgcatttgcttgtgatagtataagattattataaaacaaaaattgtaacactaagcaagaggcatatttttggaagaaaaaaaaaagaaaaaaaagaaagaaatgaaagaaaaaatggagctattctcatatgaaaggggatggaccaaatttgaataacatttgcttatttttagtagtatagtatccctaaaaatgtgcaaaataaatggaaaatggtgataattaatgggtaattaattagtattaatgggtgtggatcagttttctgctatagaatctactatccatataattatggatttgctgctataaatttataataatttcttaaatcttgtctagttataaaagttgtccctttattaataacattaattataaaagtttgataaagtaacccttatctatttcttaaatgagtaactaatgtttatattcgtttatttttttattagtgagggtggaattgaaaaaaaaattaacgcattcatgattttctaaagttattttgagcaaatctttttggcaagagtaacagattgtactgacattttgtttccaaatttaaactgagagaaaaacaaaatcaatagaagaagaaggaaaaggccgtgtggaccagacaaaaggagaaccctgaataattaataattttactgttgattaattggctaatacaaaatcgtaaggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttggtcctatttttcattttggcactctatcttaaccttgttccattttggcccttcaactttatttcttatgtttcattttaacacaaaagctgaaactagtgcaaaacaatatagcgcgtgtgtatacacaaatctgaaatgtaataaatatccaattaaatgttgctcatccttgtcaaacgggtcaatactaaaatacccgacccgaatttcttggtttccatgatactttcagttcaacttgaaatccacaagaacaaatatccattccattatgagaaaataattttctttgagacatagattcacttcaaacttcaagcttatatgaaataaaggatgaaaaaaccatgtgtcaatatttaattggatatttattatacctcatatttgtgtatacacacgcgctatacttttttgcactggtttcagcttttgtgttaaaatgaaacataagaaataaagttgaagggtcaaaatggaacaagattggaatagagtgccaaaataaaaaacagagtcaagttgaatgggttgtatatgtatttggccaaatcgtaaagaacaaggtaagaaatatgattatacatagtaaacaccagaacaccctcttactatgtttcagatgctgtgctatcgaagacgccacgtagtccatattcatttacattgttaacaagaagtcaggaatgtcatgcgatataatattcaataagagctaactggtttacttaattaagggatagcactcttatatgctagtaattaataaaagttttcctgaaaaactttatggattataaagtttccttctttagtattttagtcttaagtactgttagttttatggaaaatgtagataaagataatcaagatttcattgatatgccatgcatatgcttatggtgacagattgtgatgatttcattgcctatggttattctcaagcaaccgtgttggcgtaatttcatcgctcctaattaatttcttagttgagaataatttggattattgtttttaagaaaaaggatcaagtttatgtaccatcttcgcctcttgttactggttaccctgttggatttctgccatcgagggagcttcagagaaaggaaatgtcgatattttcattcaactttaaaatcagactttttatagataaagatatttataactaatcaaccaactaattttgttataactatgctaaataactaatgcatacctctaatttctaatatttacaaactgagccctatactaactaagacttatatacaacacttcaacactccccctcaaggtagagggtgcaaaatgtttaacactcccagcttgcctaataagtagtgatgctatcccgagctcaatcctttggtcagtaaatctgcagttgatccttagtaggcactccaatgatccttgtttgaaattttcccgtataaaatgacaatcgatctcgatatgttaggttctctcatggagtatgggatttgctgcaatttgcattgcagctttgctgtcacaagagagggtaactggttttttttaatgtgatccctaactcatgaaacaacccagttagctaaaaaatctcagcaactgcagaagccatgcttctgtattctgcttctgcactgcttctagatattgtatgatgtttctttgatttccatggaaccaaagagttcccaaacttcactacatatccactcgctgacctcctagtaacaagacaggtagcccagtctgaatcataaaatcctagcagtgtgtttgtagattgccagtgtgcataagaactcccatgccaagtgttgccttcagatatccaaccactctaataactgcatccatgtgagatttctttggagcctgcatgaattgactaagattctgtactgcatagcttatatccggtcgagtgactgtcagatataaaagctttcctatgagcttttgatatcctgtaatgtcaaccataggatcatctccttccactccagctcctttatcatactccactaaagttaacttctgattgatctccaatggtgtgactgcatgctttcctccactcagtcctaactctgaaataaactccaaggtgtattttctttgattaagcaaaataccttgttgtgatctcaagacttttatacctaagaagtatctcagttcatcaagatccttgaccttgaactgctaatgtagaacttccttggcctcattaatcgtgatactattgcttccagtaattagcaggctatccatatatatgagaataataactttgtcactcccagatcttttattgaacaaggaataatcaaaagcactctaatgaaaacctgcattgactaattcttctgtgagctttaagttccactgccttgatgcttgcttaagtccatacaaggacttcaaaagcctgcatacctttttctcccctgcttttgaaagccttgtgacaagtccatgtacacttcttcatatagatctccctgaaaaaatgtattaaatacatctatttgataaagtttccaatctttggaggctgcaacagctatgacagatctcacagtcaccattttggcagctggagagaatgtctcatggtagtctaaaccttcatgttgattgtatccctttactacaagtcttgccttaaatcttttcacttctctatttgacttatatttgatcttgtatacccacgtagatccagtagtagacttcccagcacgtagagtcactatatcccaagttttgttatcctctagagccttcacctcttgctgcattgcctcaatctacctcttgttttttttactgcctgcttgaaggaatatggctctttcattactgaaaaacatgcaagtaatctctgtatttctgagttacagtgtcataagatagttagttagagatggagtaggcacactctatggatttctgcttctctgtaacataatcttgcatccatataggtggctattttgttcttgctgattgcatgatttctgcagttggaattccttcagatgctgaagttccttgcaaagttagaattgccaaatgatctgcattttctgcagtaggatctgcaacatgaactgttgtctcctcagctaaaactgcaggtgctgtagattccatgatctcctttagttgtttaaagccttttgtcaagcctccagcttctctttcagtggttgctgaatttccagatgtgacttttgcaggttattccaatggtgtagtcataactggcatttttgttgcttgaccatactcctttgggatttgtatttccacaacatgtgttgtccaactgtagacataggaaatcatcttagttctgcatcattgtgtgtggattaatctgcatttgagtctccttgaaagaaaaaccgatttcctgaaagtaacatatctactgacaaaaatataattagtttctaaatcaagaaatatatatcctttttgtgtagaggagtatcccaaaaagactgctttcttagttctaggtgcaaacttatcctccttcactaggttggtgatggtaggctataatctctattttagtcacttactacactctaattcactgcacttaacttgtgttgagatttaattagtaatttttttgtacttattgtgtgttttatgccttgtagagtgattccaagttatgtagatgttgtggagctaattcgagctatttggagctttaaagtctaagtagaagcccaagaaattaagtcgggatcacgttcgggggatcgaaaaccaagtatgggtgttacaaatttgaaaaaactcatttctcgccacaatttacactatcgccccgcggcatgcctcgtggggcgctagtgcaaaaagtggccagaaatcatattttgaatcgttttggaattttccacaatcgcgtcgcatagggcggcacaacatgcggcgtggtagctcaaaaatattagagtgacttccaattccgctaaaaaaaggtaatttcgtccggggtttattgggggatggaataaagacacgagaaaataccattttcgggacttttgacagattttcgacctaaggaggccaaggaagctaaggaggagttggaaaaacacaagcacaaggattttatcattccttccccactcaagatccgggtttggattgaatttatattttcctatattttagttatatttgtgaagaacttctccaaatctatggagtagtttcttttgggttttgatgaatttggtgtattgatgattgtttgtggattataactctatttttatgtatttgaatcattttataatatttaattgttgcatctatattcactaggtcatgtaatcgagagagacataacttgtgatatctttgaattatgccttctaggagtgatttcgagttatgtagatgttgtggagctaattctagctatttgaagttttgaagtctcagtaaaagcccaagctattaagccacgatcacgttcggggatcgaaaaccaaggctggatgccaaaaatttcaaaaaatcatttctggccataatttgcactaccgccccgcggcatgcctgcgaggtgctagtgcaaaaagtagccaggaatgatactttgaatcgttatggaattttccacaaccgcgtcgcatggggcggcgcggcacgcattgcggtagccaaaccgctaaaaagggtaatttcatctggggtttattgggggatgtcttatatacacgggaaaacatcattttttgggacttttgacacaatttcgacctaaggaggccaaggaggagttggaagaacacaagcacaaggatttaatcattccttcctcactcaaaatccgggtttggattgaatttatgttttcctatactttagttacatttgtgaagaacttctccatgtctatggagtatatcctattgggttttgatggatttgatgtattgatgattgtttgtggattataactctatttttatgtatttgaatcgtttttggaagatttaactattgcatctatattcacttgttcttgtaatcgaaagaggcataacttataatatctttgcattatattattggttgagttcatagattcttctaagtaatcgaaagaggctagttgaattattgattaaatctagttaggatattaatcgaaagaggttttcctaaagactgatctactacgtattcttgcgtatcttcacagtgctttaattggttcatctcgtgaggttaagacttaatcgagagagaagtagtttttgctgaatgtttgaattaataatagagtgaattcgagagactcacttgaacattggaaatgaattatctagagttagatcccgaacaattatcttgcacttattctgtcaaaaccctatcctcttccactgataaccttaattgcttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcgatagtcactagtcaatagctgtagatattaaattcttaattaaattttattattaatcatataaatctcaattgttgatcatcctggatagcaatcatgttagaaactatgagactactatttaaatccaatccctatggacacgatattatactatactatctttgactagcgagcacaatttaagtgtgtgttttgcgcttgtcaaagcaaaatagtagtcttgttcagtctaggaagtaatataggcatttctttgttgagccaaatatatgcttttacctaccaaattaatgtgtatcttagttagccccgttgaacctgtaatcatatttctttggcaaccacactataagcttgacccatttgtttgaattgtctatctgtttgaaccttttacctctcgtgagcacttgattttcttatgagattgtaaaagctaagtgaggtatggttgggttttgagtggaaatacagaaaaaggagaaaggtgcacaatttaaaaatttgtgagagccacatgcagagaattaaaaaaaagagaataattggaaaaaagaatttattccttgctagtggtggctctcaccttgtatgtgcttaaagatatggggagcttgaagctataggaatgaaggttggggtatggttcaacacaagtgcggggtttaaattgctaatgtatatgtattaaagtactcaggggggtgtagtcactatataaaaatatatcctaccatcccgcaacctacattacaaccagttaaagtcttatttgatccttgactgaatgagctcaattagttgagtattacattacgggcaagcttatggtacatcttttgtggcacatgaatattgtttctgagagtgagtgaattcttcctatcttgagttcctaactgttcttaaactttattgtgtgtggaactactctctattgttgtgtcatggcacttgattcatgaaggaaagctaatgtcattgacctctgtgttagagtaagtgagcaggttgtgaaaaatatgtggtgctgttgagtcacctcttgaggcgaggatgttacatattgtgcttaatatgtttgattattattgaagtgatgagttaggagagttgtttaaaaagggcgtgtctatgtgaagtatagtttgattgctcgaggacaagcaatagtttaagtgtggggtgttgatggtaggctataatcctgtattttagtcgcttattacactctaattcactgcactttacttgtgttgagctttaattggtaatgtttttgcacttgtgtattttatgccttgtaggagtgattctcagttatgtagatgtcgtggagctaattcgagctatttggagctatgaagtctgagtagaagcccaagcaactaaggcggatcatgtccgggggtcgaaaatcaagtctggatgtcaaaaatttgaaaaactcatttctggccacaatttgcactacctccccgcggcatgccccgcggcacgctagtgcaaaaaatggccaaaaatcatatcttgaatccttctggaattttccacaaccacgccgcatggggcgcgatagcccaaaaatgttagagtgacttcccaatttcgctaaaaagggtaatttcgtccgggttttattgggggatggcttaaatacacaggaaaacacatttttcgggacttttgacacaatttcaatctaaggaggccaatgaggctaaggaggctaagtaggagttggaagaacacaagtacaaggatttaatcattccttcctcacccaagatccgggtttggattgaatttatgttttcctatactttagttacatttgtgaagaacttctccatgtctatggagtagatccttttgggttttgatggatttggtgtattgatgattgtttgtggattataactctatttttatgtattgaataatttttggaaaatttaattattgcatctatattcacttgttcttgtaatcgaaagaggcataacctgtaatatcttagcattatattgttggttgagttcatagattcttctaagtaatcgaaagaggctagtagaattattaattaaatctagttaggagaataatcaaaagaggttttcctaaagactgatctactacgcattcatgcatatcttcacaatgctttaattggttcatctattcatgatgtaaacagttgtctgcacactctccccaaaacctttttggtagattttcttgaaactttagtgcccttgcagtatccaatatgtgctagtgatttctttctacaactccattttataatggagtgtaggcacaactactctgatgaatcactccttgatcctatagaagagtgttccattgattgttaaagaattcagttccattgtttgatcgaatcaccttaacagaggtatcaaattggttcttaaccatgcacaaaattgcttttaaaaaataatggtctcacccttcaattgcattagaaataaccaagttgctcgtgagtagtcatctacaacagtgagataatagtactttctatcatgacttggcactctatatggctcccaaacatccatatgtacaagttcaaaaggtttattgctcttttgttcactatcaggaaaggcaagcctagactgctttgccatagggcatacagaacatctattatgcaaactgctatctactttattcttcataaatggaatgaattgcaacactggtgttgatgcaacactagtgttgaagcatgtcctagccttatatgtcatatccagcttgactctcctcctctactttcatgcttaattgcagatactaattgtctcactcctcttcctttcagcaagtacaatccttcactttccttaccaatccccctcaccttgccattgtagaggtcctgaaatacaacctactcaggcaaaaaatagcagcacatgatatgtctcttgttaactttgatactgacatcaaattaaacttaaaatctggcacatgaaggacattctttaatatgccatcagttgataattgtgaattaccaatatgagcaatatcagtactagttccattagacaaccttactgaatcccttttatgcttattaatgcactgaatattgcttaacagattcaaagtagaagctatgtggtgtgtagcacctgaatcaacaatccactcatctggatgcatacttgatgaaagtgaacaaattgttgaacaagtagtacctgccatattagcctgtgtctgcacagatgtatcactaggtccttccttgttgaataggttcagaatttgttgatattgggcctcggtgaaaaactaatcacctcctttgctttatgaattcactactacaggtggcccttcaacattattggttgtcataggactcgctcttggttgatgccctctcttcgttttgaagtcgtctggatatccaatgattttgaagcaattttccttagagtgtcctttcattttgcaatgctcgcacagtagcaactacttccttcaacgataaccttggcctcttcctgcttgcatagccaaatgatcgatagcctgtttgtccaagcttctcaagaggcaaaaagtatttttttctcaaaagtaactttttccctaacttgacgtgtttggccaagcttttttgggggaaagaagtgcttttgggaagaagcagaagcagattttgtgaaacagaaaaaaatagcttcttcccaaaagcagaagcagaagtagttttgatttttcttcttaccaaaactattccttaacaaaatatagtatataccaaaataaccgttaaacctaatacttaggatattaatgtataaatatatcttatttttttggatagctttctaatatatagtgactttaggggtgaatgattttatatttgttgaataattttaaatatttttttaacttatattaaaagaattaagtacttttaaattttattttcatattttacttaaataaagggcaaaatacataagtgtaatgatccggatggtcgtttctagagttgtagccccgttcccccattttatgctccttttgtgttctacaactgatatatgacttaccgggttagttggttcgggtctggagagatttcagagtgaattgagacacttagtctcttaattgaaagcttaagttggaaaaactgatcagatgttgacttatgtgtaaacgacctcagatttgaattttgatggtttcgttagttttgttagatattttggactcaggagagcgtccagattgtgatttggaggtccgtagtagaattaagcttgaaatgacgaaagttgaaattttggaaagtttgaccgggagtggactttttgatatcggggtcggattggatttcgggaagttggagtaggttcgtggtgtcatttatgacttgtgtgcaaaatttgagttcaatcggacgtgattgataggtttcgatgttgtttgaggaatttgagaatttcaaagttcattaggcttgaatccatgtggaatttgtgtttttgatgttgtttgaggtaatttgatggtccgactaagtttgtattgggttataagacttgttggtatgtttggttgaggtcccggggggcctcgggttgaattcgggtgcttaacagacttggaagtaagttgcggaagcagtttaagctttgctactgctggtgtaatcgcacctacagagtgggaagcgcaggtgcgatccctgataagtgggaattttgactacttatttgcgccttttgacttttgttttagttcaaaaatgcttaaaggtattcccaaaaactgatgaaatatgcttacttacaggagtattggaaaatgagccaaggtgatgaaattcaactcaaaaggagtgattttgaacaaggacaaaaatcaggcaaaaaggctaaagtgcggaccgcagcattctgtctacggtcgtagaacaagaaacaaatttaacagtgctgcaatgcaaagtgctaaccgcacaataattgcgcggccgcagaagtcaaggttcagagatttgggacttcaagacaatcaagatctgcggaccgcactataattgtgcggccgcagaaatcaaatgtgcggccgcacccagaattgtacggtccgcagaactcaagttgttcagccgcacccagaattgtgcgatccgcagaactcaagaagtgcggccgcagttcataattgtgcggccgcagaaaccactcttgtaaagagctgcagcaaagtgctgaccgcacacagaattgtgcggccgcagaacctctgaaagggtaattttgtccgaaaattttagcagtgtataaatagtttttttggacaatattaggtcaagtttttaatattgaaagtattatagcaaattttccttacctctttaggtaagtttagcttatattggagatttaacattggattttcatcttttaatcttgcaatatgagttttatcatcttttattctttattttcttctttacccaatatgagtagctaaatttctagctagtgttgtgacccaaccctagtgtgtgaacctaatgggtatttgatttagggcatgtttatggttatgtgtttattatttagccttgccttgctattaattgtcgaattaatgtttgcaaatattagttcaagcctatttgacttggtctctacttgagaaagagagacttagtttaggaaatcttggctaacaagaatttagaatgaaatcaagagattgatagtcctaattatagggttgaacctagagatagtaaaacccgacttgagcattttatcaattgttttgtacgatacccatttggacttgagaaagccagattgggcaaaatcactctctcaccgagaggtattgagtgggtaattatgtgttgataactataatacaccccaaccaacaaaacacgctttaaagcttacaacccgttaggaaaatacctaggtgaaggtcataaccctaggtcttttacattatttgaaaacaacaacaaaaacaatattctctaggtttatattttagaattgaaaaccttagcgttatttgagaagtaaaaacaaaaccatatttgtggaagttcaatcaagatacttcacgtgtttattccaaatatataccactaatcccctctcagctctctgtggattcgatcccggctccttgttgggtattattattgcaatcgaccgtttcacaaccccgaatagaggtgtgacttggacgagatcaatttttggcgccgttgccggggagctaaatatggatttagctatatatttgtctttgtgtgtgaattgtcttcttttccttccgtgttactaatccttttggtaaaacaattatacgtgaaacaatggttctcaacaataatgatcctctcggaaacatgccgttgggggatgtggacgtggaagatgaccaagttgaagaggttcctcttgaacctcaagcaaatagacgaggccgaccgctcaagaccacgttcccgttccacccccaaatccacaaagagcagctccacaccaggtgttgccgaatgaagggtacgcaagtgccatagtcccaccccgcattagggcaggcaactttcaaatcacaaatgttatgctcacatggctagagcaacggggattcttcaccagggctccgaatcaaaatgcgtacaaatacttaaaaggatttgtggacacttgatgggggagtaaacagacatacgtctccgaggattctttaaggttgaggctatttcctttctcactatgggggaaagccttggattggttagaaaggttgccaaaccattccatccatacatgggatggattggcggagaaattaattgccaagttcttttctcccaggcatatggctactcttagagacgagattctagcattcaaacaagaacccaatgaacctttgcatgagatatgggagaggtaccgaactatggtgaaagagttcccgaacaatgacatgacggaggctatgattcaacaaacgttttatagggggatcaatactaccaatcaatgtgtggtcaacaaagttgccggtggaaatttcatgacaacaccatatgccgaagcttgtgaaatcttagatgaaatggaagatacttcatcggcattgcaaagtagagcaaatgttcctcaaggtgatccaaatgtgattcacctacataaagaattacatgatcatgggcaagcagttactaagttgaccattacaatgaatcaattagccaaagctcaacttcaacaagttcaaggtcctaagaaagtaaatgcaatggagggtgtcaatatgatagtaaacaagagaaggcaaaagggtcaacatgtgcaaagccgtgcagaacaatatgtgcaagaagataatgggtttgaccaagatgaatcttacaataaacaagaggaagaagtacaatatgtgaacaacttccaagggcaaagaaacaattctcaaggcccgaatcaacaacaatggctatctcaaggtaatcaaaagaaattgaaacaatcaaaacaaccaaggtaatttgaacaataaaaacaatcaaggaaattgaaatggtcaaaacaaccacagcaattggggtggcaatagtcaaggatattggggaggaaacaaccaagaaggacggaataataatcaagggaatctggggtcagaatttcaaaggcccccgatgtttcaacaaccaaacaacccgcctccttatccttcacatggtcctaactcttccaacaatgagatggggtgaattgataacatgtttaaataattgatcgagaagaatgccgactccgatgctcaactagcctctcaccacacttcaattcgcaatttggaagtccaattggggaaaatcttgcaagctttgaacactcgtcctaaaggggcactgccaagtgacatggtggggaaccaaagggtgggaacaacacgggacgtgccatggccgtgacagtggaaaaggtagggatgcaaccacctcaagtcaaagaaaaattatggatgatgaactagtgattcaagaagatgagattccaaacaatttggtgtaagccaatgatgaagtaagaattgatattaatgacattgtggaggatacttaagaggaagtgaacccatctagggatcacatagtagacataccgaaaccagtagtgccaaaggctaaggcaccaataccaaggtctcctcctccataccctcaaggcttgccaagaaaaatggagagaacaaattcaaaatgttcattcacatgatgacaagcctatctattaatgtgccattggttgaggctttgtagaaaatgctcggatatgcaaagttcatgaaggatttggtgacaaagaagaggtcgatgaattgtgagactataaagatgacacatcaagtgagcgcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagatcctagctctttcacaatcccttgcactattggaagtgcctactttgccaaaactctttgtgatataggggcgagtaccaacttgatgccctactcgattttcaaaacattggggattgggaaaccaagactcacttctatgaggctacaaatggtggatcgtactatgaaaagacaattgggtattattgatgatgtgttggttcgtgttgataagttcattctcccggcggactttgtgatttttgattgtgaagtagactatgaggtgcctgttattttgggtagacctttccttgctatggggaaggcatttgttgatgtggaagctggcgatctcactttccgggtgggtgatgaaaaggtggttttccatgtgtgcaaatctatgaggcaaccaaatataaatgtagtttgttcatttgtggacctagtgaccgaggtgattgttgatgattctagtgccatgatgaatgttgacgatactttggaggccgtattgcttaatcatcatgatgatgaaaaggttggatatgtggaatgtgtgtatgcattgtaaggaatgaggtcgtacacttatgaaccccgcaaagtgtccttagatcttgaaaatcagaagactcctccagcaaagccttcaatcgaggagcctcccactttggagttaaagccattgccttcacatatcaggtatgaattccttggcccgtgttctgctttaccggttattctttcctcttgtttgactaacgtgcaggtagactctactttggcggtgctacaaaagaggaagaaagctatcagatggacattggtgaattttcggggtataagcccaccgttttgcatgcataatattattttggattgggattccaaacactccactggacatcaaagaagactaaatgaagcaatataagaggtgttgaagaaggagatcataaagtggttggatgccggggttgtttaccccattttcgaaagctcgtggacctctccagtgcaatgtgtcccaaagaaagggggcttgactgtggtcaccaatgacaaaagcgagttgattcctacaagaatggtgactgggtggagagtgtgtatgaactatcgcaatctcaacaaagtcaccaggaaaaatcattttccacttcccttccttgatcaaatgcttgatcggttggctggccgtagtttctattatttccttgatggatattccagctataatcaaattcttattgttccggaggaccaagataaaactactttcacatgtccctatggtactttcgcattctcgcggatgccatttgggttatgcaattcaccaacgacgtttcaatggtttatgatggctatcttcaccgacatggttgaggattttcttgaggtcttcatggatgatttttctatggttgcgaattcttttgatgactgcttgaaaaacatggataaggtcttggcaagatgcggggagacaaacttgatgctcaattgggagaagtgtcacttgatggtctaggaaggcattgtccttggccaaaaactttcaaagaatggtattaaggtcgacaaggccaaaatagaggtgatttctaaactcccaccccctacatccgtgaagggagtacagagcttcttgggtcatgcgggggttccatcgccgtttcatcaaggattttccaaagtggtgaaccccttgtataagtttttggagaaggatgccaaattccatttcaacaaggattgcatgaaggcattcgaattgatcaagttcaaattgactactactcctattatcaccacaccggattggagcttgaattttgagctcatgtgtgatgcaagtgatgtgacggtcgggacagttttggggcaacgtattagcaaaatattccattcggtctactatgttagtaagaccatgaatgatgcccaagtcaattacacaatgaccgaaaaagagctacttgctattgtttttgatatggagaagtttcgcccgtacttgatgggtacaaaagtgattgtccacaccgattatgcggtgcttcggaaaaagtattcaaaggtgaggttaacgcggtgggtgcttttattgcaagagtttgatctagaaatccaagacggcaaaggcagtgagaaccaagtagcggaccacttgtctcaattggaggaggaggggaggccacatgacggccttgaaatcaatgactccttccctgacaagcaacttctagtcatttcaatgaccaagataccatggttcaccgacttagaaaattatcgtgtgagttgtattgtaccaaatgagttctcttcaaacctaaggaagaaactcaaacgggattgccttgactactattgggatggaccgtacctcttccgaatttgtaccgatgtgattcgaagatgtgtgctggaggtggaacaagtggaaattcttggtgcttgccactcttcaccatatagtggtcaccatggggggagggggagggggcgagaacggcgacaaaagtgttgagttgtggattctattggcctactctctataaggacgctagtgatctagtcaagcgttgtgatgaatgtcaaagggccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatttctaagaaaaatgagatgccacttaccaccatcttggaaattgacatttttgatgtgtgaggcattgatttcatgggaccgttcgtaagctcttatgggaacacctatatttttttagctgtggactgtgtgtcaaagtgggttgaacccgtggctctacccaacaatgaagctcgaagtgtggtggcatttttgaaaaagaacatctttacaagatttggtactccaatggtcattataagtgatggggaatcacacttttgcaacaaatcttttgataccttactcaccaagtagctcacaaagtcacgaccccctatcatcctcaagcaagcgaaaaagtggaagtctccaaccaggagatcaagagtattttgtcaaagatagtgaatgccaaacagactaattggttgaagaaacttgatgatgctctatggggctataggacggcttataaaacaccgattgggatgtcttcataccggttggtgtttgaaaagcttgtcaccttctggtggaacttgagcacaaagctatgtgggcattgaagaagctaaatcttgagtgggatgtcgctgctaacctgagggtggcacaattgaatgagcttgatgaattctggtaccatgcatatacaagttcttctttatgcaaagagaagatgaagtacctccatgacaaatacattcaaaacaaggagttcaaagaaggtgatcttgtgttattgttcaattctcggttacagatgtttccgggaaagttgaagtctaagtgtagtggtccgtttgaggttgtgaaggtgacaccctttggtgcattaaacttgaagaataaaaatgatgaagtgtttagagtcaatggtcacccggtgaagcattatcttggaaaagttgatgatggccacgtcgtggcattaattaatttcaagtgattgatggtaatctacgtcttgccgcggcattaaatcaggcgctttttgggaggtaactcgtgtttctttttattcttcttttccttatttttagaaaggttttgttttgtgctaactggttttgaagtgaattgcaggaatgattgtgctttgcaggaactgtgctcgaaaaaataaaaataaaaaatggctaagtgctgaaaaagtgcggactgcacatttattgtgcggaccgcacaatcttgcatgctacagcagaaaggagtctgcggccgcacaactggagacccaaaaatgcaactcactgaagtttgaaattgcagagaattggccaatgtgcgaccgctcttgatattatgcggtccacacaaatagttccggccgcatccaattttttgcggacctcagatcttcagcgggaccaggtaaagagtgcggaccgcacacaaaattgtgcggaccgcacacaaaattgtgcggccgcactcagctgcacaaaatgacctaagttggtcaacatataaataggcccccctctcattgttccaaatatacgcacttagaactcttaacaccaaagtaagcatagtgcaaaagaattgtttcaaacatcacactcatttcaacattctagattttcccctgcatctttcatcactggtatgttcaattcgtgtttagatttttccaaattttcttagtttttatccttaattagtatagttatctttaggcctaaatgtcagatgattcatcatatgtgcttaaaattatatgggtaatttcatatgtactcattgggggttgggtaaatcatgtatcatgtctaatttgccaataccatgtctaacttgtgtaaaaaataaaaataataataaaatgaataacctaagttcagtgccatttaattttgaattgtgcggttgcacatgaaattgtacggtacgcagatccttagttttagggcaagtctatgcattcaatgtgcggaccgcacccaaaattgtgcggtatgtagaaaatgatctgcggccgcagaaacatttgagtgaccatagacccaaactttagagaactggtattactaggcctggaattgtgcagccacactcataattgtgcggtccacacttcaattatgcggccgcacttcaaaatagtgcggtccgcacaagccattctgcggacgcactcaaaattgtgcggactgcacttccccctctttcccactaatttataatctatgtttaaactttaactgactcatgttgctatgtattgtagaaaatggttagatcaagaggacgtggtgatacttccaaagggaggggtgaaccctcccgaggccgaggcaggggtaacctaccactctccgtgcaaaaagtgattagtaagaaggcaacaataggccgaggtagaccgccggatccctaaaaatcaagttcatatgccccgtccaaggaagcatcagagggagactcagtgcaaaggcagcctgctgtgccatcacagccacaactgccccaggacagattccggctgagagatgagcctacctcttctaagagtacttctaagggatcgaaagggaacagtcaggctacgtagccctcatctactcatgccccctccgcaccagtcacatttgatgtaatgatgatatttcggatgatgatcgggggagaggggggtgataccagagttacaggtctggagaggtcaaagaagaaggaagtttgggaagataggtttgtgagcctgactacattcaacagattctgtgagtggtggccgcagagatcgctcactcttgagtggcagtttgtgttgaatgatctggatagatacaacccgaatgagttaagacaattttaggaaagaaaagggtggaaatggttcaccaaaagcgtattggatgccaaggagcacttagtccgggagttctacgccaatgtgacacacattaaaaaaggggactaaggtgactaaggtgcgaaacttaaaagtacgatttgatcagaccaccctgaacatttatttggtgctcgaggatatggagccgatgcagtatttagagaagttcgcactgggtgatgcagctcgcccttggctagctgagatactagcagctccaggaccaccaccaccaccatggatcacagcaggggttcctattctgcggaacaccctcaactttgaatcaaaagggtggaaaacattcgtatgcagtcgcatagaaccaagaaggaatgaaaacaatcttccaatcccccagtcaatcttagttgcatctatcatggatgggtatccaattaatgtgggtgccatcatgtgggccaatatgtctctggttgtcaggcagggtgaaagctcctatccatatgccaacactatcatggagtatctcacagatgcaggggtggaacccaagagctttgatatgaaggtaagggctaagcaacccttctcctggtactatctgaatgacacaagtaacccgaaaaataagggtaagtcgactactaccgtaggccagtctgatgagccatctgtggtagttgcagattctgccgctatgccttctacaacttccatgccttctacagtacccgggccttccaccgagacagcagtcatgccaccacctccatcttcagggccatcagcgctagtattagtgccttcttcctcaaattatccgctctctgcattgcgagtctcccaaacactggcgagtctcaacaattggatacagacagctactgcaaagctgtctgacctatccagtgctattgcagctcagacccctacctcagcaccacagattcctccgtcaatggaggaaactttgaagaaaatattggagaatcaaaagaccatcatggtcaccttggtggaacatgggggagaaattgaggaacttgggaagcaggtgaaaaagttgaggaaatcccaggcttcaaggaaatcagttgacaggttgagacgagaggtgaccaagatagcaactgatgaagatcttccatttgagttactgatagagacagatccatcagtaccagcaaacccagcggcaccattggcaccagctggccagtctgaggagccagacctcgctgcccacactgctgtagcggtgctacagatgttcgccaatccagttgctccccaagaagaggatgatgagatccagttggaggagcctgcgggaggtgatgctgctatggacactgagaccacatagggagtcctctcaactctttcccttccttgtttttattttggtaagaattggtgacaatgcttatttttattcagggggtggagtatattttgatttaacatttgacattgacctgtaataactgataacattctttttttatttttactttcattatgtacatacttgtctctctctattgatgtatatattctctttccctttctcagtttgtatattcatttattatgctttcagtagtttacttcataacttctttattttgttttcttagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagcttcttatttactttattagcttctttttaatttagtagtttctttcatgtttaagtgatcattaagcctttgattttcttaatgtcacggttctttccaaaggtgggttttttgtgaaccggatgactcttcccacaagaaggtcacggtagaggaagaggtgcaactcgcacaacacttagggcagcacctgtagatgcaccagttgccccagttcaagagcaggttccagttgtggataagcctgtgagaccagctcatgcaccacctgtgcccattgtgattccaggccttcaggaggtcttagctcagattctgatagtttgcaccggccttgctctggtggttttggctcaggccgcacctgtcacttctcaggttgagggaggtactcatacccctgttgcccatacaccagatcagatagcgcagagacttcagataacgggggcactacctgctcaaccggttgctgctgctcaggcccatatagttcttgttatgtctgatgatgagcagtggagattggagaggtttgggagactccaacctctttctttcggcagtacaaaggcggaggatgcccagggtttcttggacaagtatcagaggattctccgtacaataggtattctggagaccaatggggtctcgttcactactttttagttatctggggctgccttcagttggtgggaggcttatgagaggcgtaggctggttggctcaacacccttacatggcaggagttctccattctcttcctagagaagttcgtgcctcattcccgtagaacagagctgcgcagacagttcaagcagcttcgtcagggtgatatgtctgtgaagcagtacgagatgaggttttttgagttggccaatcatatagtatagttggttcccatagatagggagagaatcaggaggttcattgatggtctcacatttcagctgcggttgcttatgactagagagagagagtgtctggtgctacttttgatgaggttgtcgacattgcccgttagataaaaatggtctgcaattagaagcgggttgagagggaggccaagattcctcattgacagggtggactcgggggtgttccttcacggggtcagttctgccacgacaggggtcgtccttacaggcatgctgaaatggcccacccaattcactgaggtgtgtcatctggccatggttcacacagttatcaatagggtcattcatctctcagtgcccttccagcttagagttcgtctcgtgctccatcgggtcggggctcgtctatgccaggtccatctaccagttatcccggtgctcggggctccctccagtccccaccaccaacactggggggttgctatgagtgtggagagtttggccatatcatgagatattgtccccgccttacgggaggtccggctcagcagaggagtcagactatgacttcatcaccagttacttcaccacccgctcagccagctctgggtggtgcccagtcagctagaggtcgcccaagaggtggcggtcaggcccgattctatgctcttccttccagaccagatgccattgcttctgatgcagtgattactagtattgtctcattctgccacatggatgcctttgtatttttgaccctggttccacttattcatgcgtgtcatcatatttttcccattatccggatatgctccgtgagtctctagtttcatctgttcatatggacagggtataccgatcgtgtgtactgactattgggggattggagaccagacttgacctcttgttacttagtatggatgattttaatgtgattttaggtatggagtggttgtctctatgtcatgctattctggattgtcacgctaagactgtgacattggcgatgtcggggatgccacagatggagtggcgaggttttctagactatgttcccagtagagtgatttcatacttgaaggctcaacggatggctgggaagggttgtttatcttatttggcctttgtgagggatgttagtgctgatgctcccactattgattctgttccagtggtgcgggagattctgaatgtgtttcctgcagacccgccgggcatgccgcccgacagggatattgattttggtattgacttggtgccgggcactcaacccatttctattcctccatatcgtatggcaccggctgagttgaatgagcatcttcaggaactccttgataaggggtttattaggccaagtgtgtaaccttggggtgcacctgttctgtttatgaagaagaaggatggtactatgagaatgtgcattgattataggcatttgaacaaggtcacaatcaagaacaagtatcctttgccacacattaatgacctatttgaccaacttcatggagcgagggggttatccaagattgatttgaggtctgggtatcaccagttgaagattcgggactcggatattcttaatacaactttcatgaccctttatggtcattatgagttctttgtcatgtcttttgggctgatcaatggcccagcatcgttcatgcatctgatgaacagtgtatttcagccttatctcgactcgtttgttattgtgttcattgacaatatcctggtgtacactcgtagtcagaaggagcatacccaacatttgagggttgtgttgcagcagttgagggaggagaagctttatgccaagttctccaagtgtgagttttggctcagctcagtggcattcttggggcacatggtgtccagtgagggtatttggtagatccgacgaagatagaggcggtttagagttgtcccagaccatcctcagctacggagattcggagctttcttggcttggccggttattatcatcgatttatggagggtttcttgtctattacatcgcccttgaccaaattgacccaaaagggtgctcctttccggcggtcggatgagtgtgaggagagctttcagaagctcaagactgccttgaccacaactccagttctagttttgctgtcagctttgggatcttatacactatattgtgatgctttttggattggcattgggtgtgtattgatacagaagggtatagtgattgcttatgcttcgcactagttgaagccccatgagaagaactaccttgttcatgatttagagttggctgccattgttcatgcgctgaagatttggaggcactatctttatggtgtgtcttgtgaggtatttatagatcatcggagcctccagcacttgttcaaacaaaaggatctcaatttgaggtagcggggatggttggagctactaaaggactatgacatcattattctgtatcatttagggaaggccaatgtggtggccgatgccttaagtaggatggcggtgagtatgggtagtctagcttttttccccgttagagagagacctcttgtagttgatgttcaggctttggccaaccggttcgtgagattagagattgtggagcccaatcgggtcctcgcttgtgatttctcgatcttctatatttgatcgcatcagagagcgcaaatatgatggtcctcatttgcctgtcctcaaggatagggttcagcacggtgatgccagagatgtgactattggggatgtggggtaatgaggatgcagggtcagatttgtgtgcccaatgtggatgggctatgagagttgattcttggggaggcccacaatttgcagtattccattcatctgggtaccacgaagatgtacgatgacttgaggcagcacaattggtagaggaggatgaagaaggacatagtggggtttatagatcgcttccttaactgtcagcaggtaaaatatgtgcatcagagaccaggtggcttgcttcagaggttagatattccagagtggaagtgggagcggatcaccatggattttgtagttgggctccaacagacttcgaggaagtttgatgctatttgggtgattgtggattgtctgacaaagtccacgcacttaattctagttggtacaacttattcttcaaagcggttggcagagatttacattcgagagattgtgcgccttcacggtgtgccagtttccataatttcagatagagacacgcagtttataatgtaattttagagagccgtgcaacgagagttgggtactcaggtggagttgagtatagcatttcacccttagacggacgggcattctgagcacactatttagatattggaggatatgctacgtgcatgtgtcattgatttttggggttcatgggaccagattttgccactcgcggagtttgcctacaacaatagttatcagtcgagcatccaaatggccccgtatgaggctttgtatgggaggcagtgtagatctctggtggtttgggttgagcccggtgaggctaggcttttgggtacagacttagtttagaatgcattggacaaggtcaaattgattaaggagcggcttcgcatgacgcagtctagacagaagagctatgccgacaggaaggtcagtgatgtgtcttacatggttggggagaaggttctactgaaggtttcacccatgaagggtgttatgcggttcgggaagaagggtaagttgagcccttggttcattgggccatttgaggtacttcagaggattagggaggtggcttacaagcttgccttgccacctagattgtcgagtgtgcatccagtatttcatgtttatctgctccggaagtatgttggtgacccatctcatgttttggattttagcacggttcagttggatggtgatttgacttatgatgtggagccggtggctattctgggttgacaggttcggaacttgaggtcaaaggatataacttcagtaaaggtgcaatggagaggtcaaccagttgaggaggctacgtgaaagaccgagcgggagatgcagagcagatatccacacctatttgagactctaggtatgtttctagactcgttcgaggacaaacatttgtttaagagggataggatgtaacgacccggacggtcatttcgagagttctagcctcgttcccccattttccactccttttgtgttctacagttgttatatgacttaccgagttagttggttcgggtccagagagatttcagagtgaattgagacacttagtctcttaattgaaagcttaagttggaaaggttaactagatgtcgccttatcattaaaggacctcgtatttgaattttgatggttccgttagcatcgttagatgattttggactcagaagcgcgcccagattgtgatttggaggtcctagtagaattaggcttgaaatggcgaaagttggaattttagaaagtttgaccgggagtggaatttttgatatcggggtcagattgaattttcggaagttgtaataggttcgtggtgtcatttatgacttgtgtacaaaatttgagttcaaccgagcatgatttgataggttttgacgttgtttgtggaatatgagaatttcaaagtttattaggcttgaatctgtgtggcattcgtgtttttgatgttgtttgaggtaatttgagggtcagactaagttcgtattgggttataagacttgttggtatgtttggttgaggtcccgtggggcctcgggttgaattcgagtggataacggacttggaagtaagttgagaaagcagctgaagctttgctactactggtgtaatcgcacctgcggagtgggaaccacatgtgcgatcttgcagaagcggggagggagccgcaaaagcggccaggaaggacttggacaggggccgcaagtgcggacttgtgggcgcagaagcgcttgcgccgaagtaggaggacgggcgcaggtgcgggcaggcgcacatgtgcaatggaattttccgcacctgcgaaggcacagatgccgtccaaggctcatagaagcaaaggcagctgggctaagtaacttccacagtgtagagtttttaccgcagaagcgggaccacaaatgccgaaatatggccgtagatgcgaaagggtctaggcagaatgttttaaaaaatgaaagtttcgcgattttggcttcatttcaacattttgagctcagattttggagattttgagagggcttttcaagggaatttttgaggtaagatccttgtgtccatttttcttcaatgattatgtttccccactaattttacacctagttggtgagtttttgaggtgaaatttgggggattgcggctagggatttggagagataattttggggaattgaatggccatttgatgtcggattttgataagtttggtatgattagactcgtgattcaatgggctttcgggttttgtgactcttgtcgaatttcgagatgtgggtccacaggccgggtttgagccaatttcagatctttggcttataattcatatttttcttatggaattaatccctttagccatattgattgtattatattgcttatggctagattcaggacgtttggagctgattcgtgaggcaagggcattttagagtagagttttggctaaaattgaggtaagtaacaattttaaatctggtcctgagggttgaaaccccggattttgttgttatatgattattttagaggtgagacacatgctaggtgacgggcgtgtgggcgtgcaccgtaagaatcgtgacttagtccattctgtggaactataaagttgaataacttgttgttagctatatgctctccctgtattatatatatttgactgcaaatcatgttaggagtcatgcttaggctatgtgattacactgttgggacccgtagaggtcgtgtacttgctgaattatttgctaatttttgttttgtactcagtcatggtttacttgcgtatcatatctcagtctcttcttgtttcttgtagatatatgatattatctttgtttgggctaatttttatgacttctgagagcccgagagactagagaggttgatgactgagttagggcatgagtgccgaactgtgcgatatatgtacatatatggatcgggttgcacaccgcaacgggcctgagggctgtatgtttatggatcgggttgcaggcagcaacgagccttagggctgcatatatatatatatatatatatatatatatggatcggattgcacgtcgcaacgtgccttatggctatttatataggatcaagatgcacgccgcaacgatatagctcttgggctgaaggagcccctccgaagtctgtacacccccagtaagcgcaggtacttattaagtgtgagtattcagggctgagagtcgggtgataagctattgagctgagtgactgttgccctgagaggcggtacttgttttcattgttgtttcacatagcttctatatgtcattgttttgaaacttttaagagatactatatccagattttacttgaactcggcatgtaaaaattgatttgacttaaattgtcggatttggaatcatgtctactttctttttaagatcactgaaaatgaagtataacagcatagctcgtcactatctttcagttccttatttattattgttacttactgagttggttgtactcacgctacaccctgcacttcgtgtgcagatccaggtgttcccggtcataatgggtgttgatatttgagcagctgatcccggagactatcgaggtaactgcatggcgttagcaggccttgggtctccttcattatctttatcgtatttcatttcttattccttatacattgtattagagtgttcctggaatagtttctcatgtactcgatgtgtcacgacacaaaatccactagtcgtgatggcacctaactcaacccgctaggtaagccaactaataactatccaatttcaattaactttttaataagacacttaaacaaaggaattatcttaatcttatacatttcccaaggactggtagtacaaattatgagcttctaagaacagagtttacaaagctgatatgaactaaatacactttctatttgaaaagtatataaacagagttttaaaatcaaaggctaccatgaacaagagacaactacaacagggacgcaagtaaatcttccaatctagctcccatcgaacacaacaacatcggcatccgaaatctgcacgcaatgtgtaggaagtgtagtatgagtacaatcggccccatgcactcaataagtagcaaacctaaccttaggttcaagtgagttgactttggtcaacgtttttagtaaaaagacccggatcagtgttttgatagttctggtaactccgtatcgtgatatgggacttgggcgtatgcccggaatttaatttggaggtccctagctcaagttatgaccatttaacgaaaccagcaatttaaaggctaaatataccaagtttgaccacggggttggctttttgatatcagagccgaaatccgattctgaaaatttgaacagctctgttatgtcatttatggcttgtgtgtcaaatttgaagtcattccggattcatttaatattttttggcacaaggtttgcaaattgaaaagtttaaaactcaaagtctgaatcgaggtgtgaattgcaatttcgatgttatttgatgtgatttgagacctcgagtaagtctgtattatgttacgggacttgttgggatatttggataaggtttcaaggggctcgggtgagtttcgaacgaaattcggattgtttagagcatgttgaaagcagcaggttcttggcagaacctggtgtaatcgcacctgtgcaatggtggtcgcaggtgcgcaactgcatctgcgagaagctggttgcttctgcgacctgggcactggccagttgcatcgcttctgcgtagaaatggggtgcaaatgcgcgaccgcttctgcgaaggatgaatcgcttctgcggaagagaccgcttctgcggtcgtttggtcgcttctgcgacgttgcaggtgcgatagaaatgtccgcggatgcggaacctcgcctggaagccctacttcgcaaatgcgagatttatctcgcaaatgcgtgaccgcaggtgcgaaaatatagcccgcaaatgcgaaaatacggggcagaatacataaaatcgggtcttagccatttttactcttttttgagttttaagtctcggatttgggcgatttcaagggggatttttacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtaagtgtcggagttaaccttaacttgagggaatagaacccttaaattttttgttatgtgaattaaatgtaaatgacgtataggcgaggtgacgagtgtctatacgtcgtcaaattaattttttgtctgcttacttgaaaaattatacattatttttaatcataaattaattattataataattgtttctttcttattctttgcaactataaattcttgaattcctgcattaattgttatatgctatttaaattatgtgccttaattgttatttgacatttagcataataaatattaaactgcctatttgctccctgattttcataataatttgctatttgtcattgtttgcttcataattaaaccataattaatatatgtttgttgtctcgtaattttatattaattgttacatttattggaaaaaaaatttctataagaattggtaaatgaaaatattggaggtgcgggttgcacaccgcaacatgattgattataatgaatatattggaggagcaggttgcacgccgcaacagaactgaatgtggatatattgtgagagcgggttgcacgctgcaacagaaataatggaaatgataattagttataactgctgagttgcttttaattattataaatgaattacctgatttattcctattattgctgttgttactaatattgcgtataggttaatgtaagtgagccgccttagcctcgtcactacttcatccaggttaggctcagcacttaccagtacatgggatcggttgtactgatactacactctgcacttcttgtgcagatttaggagttggtcccagcggcgtgccatagttttactcggatttctgctactcggaggagacttgaggtataactgcatggcgtccgcagttctgaagttcctgtctatttcactttagctgtgtgttcatttccaaacagctttactttattcagacctttaattatatttattctagaagctcgtgcacttgtgacactaattctgggatggtatttagacaccgttgtttgatggattattttactatatttcaaactttgcttccgcttttgtttccttgattattaataatgtaaagattgtttaaaaattggttaatattattctaatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggttcgaaggtgggaaattcgggtcgtgacagttggtatcagagcactaggttacataggtctcacgagtcacgagcaagcttagtagagtctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaaccattctactcttattctctcgcagatggtgagaacgcgtaatacttctaccgatggacagggaccagaacctccggtggcaactatggccaggggtagaggtcgaggtcgtgctagaggctgaggcagaggccgaggtagagctcaatccagagctcgagcagctgcacttgttgtagaaccttaggtagaccttcaggagaaggtcccagttcagaatgtaccagttggaccagttcaggtcccgaaaggcttcatagccactctagtgctttaggacgctctagtccgattggtgagtcttatggagggtgtggcccagaatggtacatttccagtggcaccagccgtctcacgggctgggggaggagcacaaactcccactactcccaccccggagcagatggctccccagaatcaggctccagcagccccgctagttggggtagttcagccagttgttgcagcacagaccggtgataggcccaccatgtctttggaggccttattgagactggataatttcactaagctctttccagttcacttcagtggtacaccttctgaggacccacaggattatcttgaacgctgccatgaggtgctgcggaacatgggtatagttgagaccaatggggttgattttggtgtattccagatgacgggttccgccaagaggtggtggagagactacacattgacccgaccagtcggattgcctgcacttacctgggagcagttctcttagctatttctggagaagttcctccctatcacactgagagaggaatttcacaagcaattcgagcgtctacagcagggcagtatgactgttactcagtatgagtcccattttgtggatttggcccgtcattctctccttttactacctacggagggagagagagtgagtaggttcattgagggactcacacacccatcagacttcagatagccaaggagaccggaggtgagatttcttatcaggcggctgctaatgttgcgaggaggatcgagatggttcttgcacaggaaagagggcagaggtccgataagaggcctcgtcagtttggtggttatagtggtacctcgtctggaggccggggtaattttggtaggggtcatcctcctagatcatttcattcagcacttcatgtatctcccggtgcttcagggagtcacggtcctattatgccttactctgggcagccagtattcagtgcacattcagctcctatcagtgcaccaccactccagagttactacagtggttatccggcccatctaggtcagcttcagcttcggcagccacgacatccagatgggtgttatgagtgtgggaacattggtcacatcaggaggtattgccctagattggcgagtaacagatctcggcaagattctcgtgccnnnnnnnnnnnnnnnnnnnnnnnnnnnnnnnnnnnnnnnnnnnnnnnnnnnnnnnnnnnnnnnnnnnnnnnnnnnnnnngcaccacctgctcagccagctagaggcaggggtcaggcagttagaggtggaggtcaggccattagaggtggaggtcaggccattataggtggaggtcagaccgttataggtgaaggccacccagttagaggccgtcccagagatgtagttcagagtggtgagggccagccccggttttatgcttttccagctaggtccgaggccgagtcatctgatgctgtgatcacatgtattattctagttttccatagagatgcttcagttctatttgatccaggatctacttattcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgcttctgtgtgtgcatctacaccggtgggagactctgtggtagtagatcatgtctaccgttcgtgtgtagttacaattggtaatcttaaaactagtgtggatcttctacttcttgatatattgattttgatgtcattttgggtatggattggctgtctccttatcatgctatattggactgtcatgccaagatagtgaccctagctatgccggggttacctcgattagagtggaaaggaactcctggccattctgccagcagggttatttcttatatgaaagctcggcgtatggtagagaaagggtgtctagcctatttggcttatattcgcgatcccagtgccgatgtcccttctatggactcagtaccagttttttgtgaatttttagaagtatttcctgcagatctgccggggatgccacccgacagagatattgacttctgtattgatttggctcttggcactcggcccatttctattccaccataccgtatggccccgccaaagttgaaagaattgaaagagcaattgtaagacttgcttgatcagggattcattagacccagtgtttcgccatggggtgcgcaagtattatttgtaaagaagaaagatggctagatgcagatgtgtatagactataggcagttgaacaaggccactatcaaaaacatatatctgcttccaagaattgatgacttatttgatcagcttcagggtgccaaggtattttcgaagattgatttgagatctggttaccatcagttgaagattagggcatctgatgtccctaagacagcttttcggactcggtatgggcattacgagttcctagtgatgtcatttgggttgacaaatgctccagcagcatttatggatttgatgaatcgggtgttcaagccttatttggattcttttgtggttgtattcattgatgatatcttgatttactccagcagtcgagaggagcatgagcagcatcttcgaagtgtgcttcacaccttgaagaataatcagttatatgccaaattttcaaaatgtgagttttggttagactcagttgcctttttggggcatgttgtatcggcagaaggcataaaggtggatcctaagaagattgaggttgttcagagttggcctagacctacttcggttacagagatccggagtttcctgggtttggcaggttattatcgtgggttcgtggaagggttttcatctatagcaagtaccttgaccagactaacccagaagggtgttccattcagatggttagacgagtgtgagttgagttttcagaagctctagaccgctttgactacgacgccagtattggtattacccacaggttcaggatcgtatacggtatattatgacgcatctcacattgtgcttggtgcattattaatgcaagatggcaaggtaattgcatatgcatcgcgtcagttaaaagttcacgaaaagaattatcctgttcatgacctagaattggcagccattgttcatgtgctgaagatttggaggcattacctctacggtgtctcgtgtgaggtatttactgatcatcgtagccttcagtatctgttcaaacaaaaagatcttaatttgaggtagagaagatggttggatttgttgaaatactatgatatcaccattttttatcaccccgaaaagaccaatgtggtgatcgatgctttgagtaaaaaggctgtgagtatgggcagtcttgcgtatattccggttggtgagaggccattagctacagatgttcagactttggctaatcagttcgtgaggttagatgtttcagaacccagtcaagttctagcttgtacagtcgctcggtcttctttatatgagtgcatcagagagaggcagtatgatgatcctcacttacttgtccttaaggacacggtgcggcacggtgattccaaacaggttactgtgggggaagatggagttctgcgaatgcagggccgtatttgtgtgcctaatgtggatgggctttgtgaattaattcttgaagaggcacacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgagttaggcacgcgggtggagttgagtacaacatttcatccacagacagacggacagtcagagtgcactattcagatattggaagatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttgaaccgggagaggctcggttgttgagtaccgatttggtacagtatgccttagataaggtcaagattattcaggatcgagttcgcacagctcagtctaggcaaaagagttatgccgaccgtaaagttcgtgatattgcattcatggttggagaacgaatattgctccgggtttcacctatgaaaggtgtaatgaggttcggaaagaagggcaagttgagccctaggtatatcggaccctttgaaattcttgaaagggtgggtgaagtagcctacaggcttgcattaccaccaagtttatcagcggttcatctggtcttccatgtgtctatgctacggaaatatcatggtgattcgtcccatgtgttagatttcagcttagtccaattggacaaagatttgacttacgaggaggagccggtggctattctagcctggcaggtctgacagttgaggtcaaagagttatccttcagttcgggtgcaatggagaggtcatccggtagaggcatctatctgggagtccgagtcatacatgcggagtaaatatccacaccttttctccagctcaggtactttttctaactccgttcgaggacgaacgtttgttttagaggtagagaatgtgatgacccaaaatgtcatctttaaatttaataagtaattctatgttctaagacctagaaaagcatcatttatcattcctcgacttgcatgcgcagtccgtacaatttttcggaaagtttttatgtgaaaaatagattaaaataggaaatagagctttaaaattcaagcgagttgactttggtcaaattttttagtaaacggacccggatcagtattttgacagtttcggtagctccgtatcgtgatttgggagttgggcgtatgcctgaaatttaatttggaggtccctagttcaagttatgaccatttaacggaactagcaatttaaaggctaaatattccaagtttgaccacagggttgacattttgatatcggagtcggaatccgattctaaaaatttgaacagctctgttatgtcatttatgacttgtgtgccaaatttgaagtcattccggattcatttaatatgttttggcacgaggtttgcaaattgaaaagtttaaaactcaaagttcgaatcgaggtatgaattgcaatttcgatgttatttgatgtgatttgagaccccgagtaagtccgtattatgttatgggacttgttgggatatttggataaggttccgaggggctcgggtgagttttggacgaaattcggattgtttagagcatgttgaaagcagcaggttcttggcagaacctggtgtaatcgcacctgcgcaatggtggtcgcaggtgcgcaaccgcatctgcgagaagctggtcgcttctgcgacctgggcattggccagttgcatcgcttttgcggagaaatggggtgcaaatacgcgaccgcttctgcggtcgtttggtcgcttctgcgacgtcgcaggtgcaatagaaatgtccgcagatgcagaacctcgcctggcagccctacttcgcaaatgcgagatttatctcgcaaatgcgtgatcgcaggtgtgaaaatatagcccgcaaatgcgaaaatgctgggcagaatacataaaatcgggtcttagccatttttactcttttttgagttttaagtctcggatttgggcgatttcaagggggatttttacg

SEQ ID NO: 3 - DNA, 20 bp, Artificial Sequence
  Description of Artificial Sequence: Synthetic primer
caacctagccactggtccat

SEQ ID NO: 4 - DNA, 20 bp, Artificial Sequence
  Description of Artificial Sequence: Synthetic primer
tcaaaccaagagcgaggagt

SEQ ID NO: 5 - DNA, 22 bp, Artificial Sequence
  Description of Artificial Sequence: Synthetic primer
gggcaatggaaatgaatctagc

SEQ ID NO: 6 - DNA, 19 bp, Artificial Sequence
  Description of Artificial Sequence: Synthetic primer
cttccttcctttcacatag

SEQ ID NO: 7 - DNA, 22 bp, Artificial Sequence
  Description of Artificial Sequence: Synthetic primer
ccattcattttcatccaaaccc

SEQ ID NO: 8 - DNA, 22 bp, Artificial Sequence
  Description of Artificial Sequence: Synthetic primer
cggagtacttttcatgggattc

SEQ ID NO: 9 - DNA, 21188 bp, Nicotiana tabacum
atggatctggtccatcaagatgaagatgtgactgctgaactggaggttcagactcctaagcccaagaaatccaagactttctccaagaagtctacttctatgtcaaagtctgctgaactatccaccctggcaaaaaggaccaggtccacagtgaaaaccatacaagcaaaagttactgaaggagaggcgtggagtagtgaagaggaagatgaatcagacagtgaaaaggacaagatggctaagtttggcaaaagaactattctgaagggtagattcctcaaggatttggaggaggaagggatagtattgctgttggaaaaattagaagtacaaggctggaaggacatggtcctttagatggatggcaagttggctagggatgaaatagttgaatttatggcaaatgctgcagtgctagatggaagggatactagcttagtgaaaggggtgcaaatctcttttgatatgaaggagttgggtggaattctaggtgtacatgatgaagggtacaataattacaaaaagcttaagtggcaaagcctagaaaattttcctactgcccttgccatcaccagaaaattcagtgatcatgagaaggaaagtgtgcccaagactgtgtacaagagtgaaatgaagtcaccccacaaggttttgtttgaatttgtcatcaaatatgttctgcctaggtatgagaggaggcacactgcaaacttcatggacttggttctaatggagtgtctagattgtgggaagtagataaattggcctggatttataatccagtttcttgatagggttatcaatggtaccaagtctcattctattccctatggtttcattcttacaactgtgctttcttgttttaaggtgcctttgaataagtgtgaggtggctacaagcaaagatcactttggggcgaaaactttgattgcttgtgactatgaggtccatgccactcctaatgaacctggttcacatccaagaagataccagtaaatagctcttggtataggaaagtgaggcaaaggaagctaagatagcaaggatgaagacacggttggctgaggtagaatctgagagagatgctctcagaacaaaacttgcaagacaaaaggagaagaatgatggaatttttcaagacatgctgaaacttctccaagaaaataacccagcacctcgttcttccaagcctaaagttcctagcctagtgtagttccttcagtgacccagcttgggatgtttcttttgttgatgtttgctcatgttttcaatatttttatttccttttatgtattgtggaagaatcatatcaactatcaatgaaatcaatgaaatctactggtttttgttctaactgtttgtttttatttctttgatggttgaaattcttagcttaatcaatgatgattaatccatgattgcatttgggatagcccgagtgtacatgagtaagttttacaatccgggtattgcacatttttatgcactttttctatgatgccaaaagggggaaaataagttgtgctttaaacaagcgatatttagctttgaacatgtgatatttataaccttatgaacctggtccttgatgataagtgataacaaggaaaaatatttctaacattttgttgatattaagctgagtttaaacagggcctaagcttatgaaaagcacatagtttgtcatcatcaaaaaggaaaaatttattggcccaagtgaaggtttgttttgaagactgacaaaggaactcaggcatgagccaggtctatcctttgtgaacacgggcagagttgtgcatgtgggatgcacgtgatggagataaacttaacttggcacaattgatatctcctgatcggaaaggttgtataattgattaggagaaggacttcttactcaaagagaacattatccaagatagggaaggagtcagaagttgggatcaactagaacttttccactaaggaagagtagtattagaactctagttatttgttcatatactaactctatatattgtaggatgttctcatttacaggtaatgtacaaatgcagaagttaaacaagaattgagagcaaaatagcaaggcattttgcaagcagtttgtgtgtgattcaagtgtgcaaatatgaatctacatgaaccagatagaagaaccagttccaagtgtctctcttttattctagttcaattatagtaggtgttttcatattgtacctttcagctttatgtagaggcaattgtaatatatactcaaaatattcaatttagagttaacttgaagttgccacaataattagaggttgtgtgctacaacgtgattagagttagtcctaggtttacaaatatttttttgtaaatgcagtttttggttcagtgattttagtggagagtttggaaaaatcctactggaaagtaggtcgtggttttttcaccctttgagccaaatattttcacgtaaaatacttgtgttttttacttttcgcatttactatttctgcaatagtaggttaaggatcacttagaagaatcacgttcttccataatcagtttaagtaaaaaattggacaccacacaaattatcctttgtgtggtattgaagttgaaacatcaatgttatgcgtatgatcttcccacaaagtttaacaaggatctgttcaaaaaattaccctgatttagacccgtggagttctatctccttgttttgtatgacttttcttgtgggaaggtggatggtgttgcgtgtggcagtgttggtggggagagataaggagaaagtagatggtggtgaaaggtgttccatgtctgcaatgtgtgcatatctaatagtaatatacgttaacttaggttcaggtgttcaataggaataaagtttagtttaggtatctaaattaaaaaggcggacaagttccaggggagcatatgtatttgaccttggataaagatgcagattctattttatacaattatgacatgtatcaatcgcctattttgtacattgcacttcctttctgtagtagtaagtgtattcctagcagtttctcttttacgtatttagttttctcattgtcttaagaggtctttggggaattcagttttcctgcgaggatactctatggagtatatgtaatgtttatgatcactgcgactgtttcttaacttaatactagtaaggcaagcccgtgctacgcacgggtccaacactattaacataacttttctgatacaaaagatattttctgtattaagttcaattaacacataaaaacttgagagtttgaaaattggatacaacttctaatgcaattttatttttcgtcatctgaagccaccttcccgttgcaatctcaataaagggaaacctttgaagaaaaaatgagttgaaatctctttatttcatgacggagtaatataaaattataaattataaggttggaaaatcattctaaataacaaaagtgatgaaattcacttgcttgaaaaatgcggaagacaaaataaaagaataacagggttctggttcaaaacattgcgtatacttaaaaaggaaataatacattcaataaatatcactttctcaactttcctaaaacatttggacataaaaaagatacatttactatctcatattaaattcttctaggcacttgatgcgattatataccgcccttttgttggtttcctttacactacaatcacgtaagaacagatcaatataacgcatcaactcttgatgccttaacattatcctctgaactcttatggcagatcaaaggaaactattccaaaaatattttattgaccattatcttcgtattttggagctttgtaaatttgctttatagatgacacaatgttattcctcttaacattattccaaagtttggcgaacttgatattttcacttattaagtccttatatgaagagctagcttacaaagatcaaatgatttgtcttcaacctgcagtaaagagcaacaacttaatgagagaacacaagtgaactcataaagagccattttacaactttcaacaatgtggccgtttagaaatcaaatattccatgtccaaaaaaaccttaaagtacaagaactatttgattatctaataattttggattttatatttcatccaagagtttctaaataaagatataaaatgtcagaatgaaaattcgatgaccaacaacttatgacagaatatgtgtattcattgtgtgtgatgatccaaagggtcataaccggttttctacctttttctgggctttcgaggtcttgaaaacctcatctttagttgcctcgatttgcgtgcatagtccaggcgcgtagccggaaaagcttatgtgttaaattatgtgaaatttgataaattgtggctttaaaatggttaaagttgattttggtcaacattttgggtgaacgaacccggacccatgatttgatggtcccgaaggatctgtagaaaaatatgggactcgggcgtatgcctggaatcgaaattcgaggtcccgagcccgagaaatgaatttttaaaagaaattgttttttgaaatttaatatgaaaatttgaaataaaaatgaattagaaagcattggtatcaggcccgtattttggttcaggcactcgatacaggtattatatgtggtttaagcgctttctatgaaatttggttgaaatcggacgtcatttgacgtgtttcggacctaaaactctaaatttgaaagtttatgaagtttgatagaaaaaaatgatgattttgaggcttgattcattgattttgatgttattttggcgatttgatcgcttgagtaagttcataggatgttattgagttagtgtgtgtgtttggttaggagccccgagggctcgggagtgattcagaggcggttcggggtgtttttgaccttaggaagtgttgcagaatttctgcagtcagtgcccagtcattttcttctatgcgatcacataggtatgtctgcaatcgcgtagagttattttggagtcgcccagttttgttctatgcgatcgcgttataggccatgcaatcgcgtacctctgtaaactcattctatgcgatcacacactcccttctgcgttcgcaattcacaaaaggcctagccccgctttgaccctctatgcgatcgcactcgtcatcccgtgattgcagtgaccagcctaccttcccctatgcgatcgcattccctttcccgcgatcgcatagggcaattccgcccagttattttaaaagtccaaaacagacccattacgggagttctaccatttttcataaaacttgtcttctccaagctctaggggcgatttttgaagctcttcttcatcaaagtcttttgggtaagtaatttcccacctatttccttcactcttcttcattaattactgaaattctaaacctaaatcatgaaatcaaagtagaaattaggagttttgggtagagttatgtttttggaaattttgagtgattcaacctgaatttggggtcggatcttaaaataaattatatatttgaactcgtggggttatgggtaatcaggttttggtccgaccctcgtgtttggaccatgtgggcccggggtctaattttggtatttttggaagaatgctaggaacttcatatctaagctatgtgattttgttatcgagtctttattgatattattgaattaattatgcctagatatcgttgtttcggagtcggattataaaggaaaggcggtatttgagggttgattgctattctttggaccgaggtaagtgtttgttctaactttggcttgagggaataggattagagtgttgtttgctatttgctaattgttgagtacggtgtataggcatggtgacgagtatctatacaccggagtctagcatgaccgtgagtcttatttgtgtttattcggattttgtgatacctcttccttgttaaattgataaatttcatataatgtgaagagtttgaggaagaattatgatttgtacattcttggagcattggctcgagtatatcataaagcgtgaaagtatatgaaatgattgaacccctttggagcgttggctcaggtggtaaagtgagataagaggtaaaagtgaaagaaagagaaagaattattgaattgctcccttgccgggatgcttgttgctttgttgactatctcttgccgggatgctattgttgacccttgcctgagattattgatattgttcccttgccgggtttttaactgcttaattgtgctcccttgccgggagttagctgtttatttgtattcccttgccgggatttctatcattatttgtctactcccttgccccttgtttgtgattgttgcttgggtgaggaagagtgataaagcacgaagggtgatgccgtgcattgtttgctattgtgaggaaagagtgtaaagcactgatgtgatgaaattgagtgtaaagcacgaagggtgatgccgtgattgattgatatggtgaggaaagagagtaaaagcacgaagggtgatgccgtgcatatttcatttatatgattgctttggtgaggacgagagtaaaagcacgaagggtgatgccgtgcatttgttgctttctgattctttgttgatatccgagttatgttgtttctttcattacttgttcttatttgatttacttcgaggttatagatttccttaccctatttgccttgtgattgttgtttgggtgaggaagagcgtaaagcacgaagggtgatgccgtgcaaattgttgacttttgattcttgttgacattctggctttgttacttctttctgttattgaggatttctatttgaaactgttagctccccatagcatgctcccccctcttagctgtttaaattctgtatatttccttttattgcatatatctgcacaggttgtttttggtaggtcctgtctagcctcgtcactacttcgccggggttaggccaggcacttaccagcacatggggtcggttgtgctgatgctacactctgtgcatctttttgcacagatccaggagcagcttttggacctcagcagtaggatttgatcgggagctgacttcagtccagagacaccgaggtagccttgctgacgtccgcaggcccggagtctctctctctttattcagtttgttatcttttgtaccgaaacaaacagtttataattttctttcagacgattgtatttagtaaatcttagaagttcgtgagcattgtgacaccaatcttgggtagaggattatgttaaactttccgcatttctattcagtttttatataagttaagacttccgcttgaaatttttaattatgttgcctttattacatgttgataattatggaaaagaatgtgtgttaaacggaaggtaatttaagttggcttgcctagctcctattagtaggcgccatcacgaccccgagggtgggaaatccgggtcgtgacaagttggtatcagagcactaggttacttaggtctcacaactcacggacaagctcggtagagtctgagggatcggtacggagacgtctgtatttatcccgcagaggctactgagttaggaaaacttcacatctgttctttcttgtcgtgcggttctgtttccccaatactgattgaatttctactccgttctttcgcagatggcgaggacacgcgcttcctcatcgaccgcgcagcagcccgagcccccagtagcagctcctattaggggcagagggggcgaggccgtgccagaggccgaggcaggggcagagctcagccccgagcagcagttccagaggtggagcctcatgttgattatgatgaggaggttccagctccagcagctccggtgggcccagctcaggtcccagagggtttcattgccaccccagttcttcaggacgccctggttcgattggtgggccttatggagagagtcacccgaacaggtttgcttcctgtagcaccagccacttctcaggctggaggaggggctcagactcctgctacacgcactccggagcaggtagctccccagattcagactccagcggttcagccagttggggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatggtagaggccatcctcctaggccctttcagtcagctctccaggtatcacatggtatctcaggtggtcgtggttctcagacgcattatttggatcagcagtccttcagtgcaccaccagctcccatcagtgcaccgccgcttcagagtttccgaggtggtcattcaggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgttgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccttagagtggagagggagactcccctgttatttctatgtgaaggcgtatggtcgagaaggggtgtttggcctacttggcttatgttcgtgattccagtgctgagattccctctattgattctgtgcccgtggttcgtgagtttcctgaggttttcccatcagacttgccagggatgccacccgatagggatattgatttttgcatcgatttggctccgggcactcagcccatttctattccgccatatcgcatggccccgccagagttgaaagagttgaaagagcagttgcaagacttgcttgagaagggtttcattagacccagcgtatcgccttggggtgcgccggttctgtttgtaaagaaaaaggatggctcgatgagaatgtgcattgattaccggcaattgaacaaggttacaattaagaataagtatccactgccgaggattgatgatttgttcgatcagcttcagggtgccaaggtattttcaaagattgacttgagatctggctaccatcagttgaggattagggcatccgatgtccctaagacagcattccgcactcggtacgggcattatgagttcttggttatgtcatttgggttgaccaatgccccagcagcctttatggatttgatgaaccgagtgttcaggccttatttggactcgttcgtgatagtcttcattgatgatattttgatatattcccgcagccgggaggagcacgagcagcatcttagagtggttcttcagaccttgagggatagtcagttatatgctaagttctcgaagtgtgagttctggttgagctcagttgcatttctgggtcatgttgtatcagcagagggtattcaggttgatccaaagaagattgaggcagtcaagaactggcctagaccagcatcagcctagagattcggagtttcttggggttagcaggttactatcgtcggttcgtggaggggttctcatctattgcagccccgatgaccaggttgacccagaagggagcccagttcagatggtcggacgagtgtgaggcgagctttcagaagctcaagacagctctgactacggcaccggtattggttttgcccacaggttcagggccttatacagtctattgtgatgcatctcgtattggacttggtgcagtgttgatgcaggatggcaaggtcattgcctatgcttcgaggcagttgaaggttcatgagaagaactatccagtgcatgatttggagttggcagccattgttcacgcattgaagatttggaggcactatctgtatggcgtggcgtgtgaggtgttcacggatcataagagtcttcagtatttgttcaagcaaaaggagttgaatttgaggcagaggaggtggttggagttgttgaaagattatgacatcactatcctatatcacccgggaaaggccaatgtggtggccgatgccttgagtaggaagtcagccagtatgggcagtcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtacagcgtggaggtgccaagcaggttaccttagatgctgatggagttttgagattgcagggtcgagtttgtgtgcctaatgtggatgggcttcgagagttgattttagaggaggcccatagctcccggtactctattcatccgggcgccgcgaagatgtatcaggacttgcggcagcattattggtggcgtagaatgaagaaggatatcgttgcctatgtggctcggtgtttgaattgtcagcaggttaagtatgagcatcagaggcctggtggtttatttttggagtggaagtgatcactatggacttcgttgttgggctcccgcagactcggaggaagttcgacgcagtttgggtcattgttgataggctgaccaagtcagcgcatttcattcctgtggcagtctcctattcatccgagaggttagctgagatctatatccgggagattgttcgccttcatggtgtgccggtatctatcatttcggaccgaggtacgcagtttacctcgcgtttctggaaagcagtcagcgagagttaggcacccaggttgagttgagtacaacatttcatcctcagacggacgggcagtccgagcggactattcagatattggaggatatgctccgagcttgtgtcattgactttggaggttcgtgggatcagttcttgcctttagcagagtttgcctacaacaacagctaccagtcgagtatccagatggctccttatgaggctttgtatggtaggcgatgtcgatctccggttggatggtttgagccgggagaggctcggttgttgggtacagatttggttcaggaggcttggacaaggtcaggatcattcaggataggcttcgtacagctcagtccaggcaaaagagctatgcagatcgaaaggttcgagatgtggctttcatggttggtgagcgggtattgctccgagtgtcgcctatgaagggcgtgatgagatttgggaagaagggcaagcttagccctaggttcattggtccatttgagattcttgatcgagtgggagaggtggcttatagacttgcattgccaccgagcttatcagccgtacatccagtgtttcatgtgtccatgcttcggaaatatcacggcgatccatcccacgtgttagatttcagcactgtccagttggacaaggacttatcttatgaggaggagccggtagctattctagaccggcaggttcgccagttgaggtcgaagagttttccttcggttcgtgttcagtggagaggtcagcctcctgaggcatcgacctgggagtccgagtccgatatgcgggaccgttatcctcaccttttccccgactcaggtacttccttcttatgtccgttcgaggacgaacggttgttttagaggtggagaatgtgacgacccaaagggtcatcaccggttttctccctttttcgtgcttccgaggccttgaaaacctcacctttagttgcctcgatttgcgtgcgcagtccgggcgcgtagccggaaaagcttatgtgttaaattatgtgaaatttgataaattgtggctttaaaatggttaaagttgactttggtcaacattttgggtaaacggacccggacccgtgatttgacggtcccggagggtccgtagaaaaatatgggactcgggcgtatgcccggaatcgaaatccgaggtcccgagcccgagaaatgaatttttaaaagaaattgttttctgaaatttaatatgaaaatttgaaataaaaatgaattagaaagcattggtatcgggcccgtattttggttccggcgcccggtacaggtcttatatgtggtttaagcgctttctgtgaaatttggttgaaatcggacgtcgtttgacgtgattcggacttgaattcctaaatttgaaacttgatgaagtttgagaaaaactcttgattttgaggtttgattcattgtttttgaagttatttaggcgatttgatcgcacggataagttcgtatgatgttgttgagttagtgcatgtgtttggttaggagccccgagggctcgggtgtttgtttcggaatggttttagacttagaaaaattgcagaactgctgtctgctggtgtccagtcttttgtgctatgcgatcgcatagctatgtccgcgatcgcatagtgtaaattttcagggttttagtttgttctatgcgatcgcatagttagtagttagcctgagaggtcctatattttgctctacgcgatcgcattatttcctctgcgatcgcagtgtgttagccagccttcactatttcctttatgcgatcgcatagtgtcattcgcgatcgcagagccctgtcccatttactctatgcgatcgcactcctttgtccgcgatcgcataggccaaattcgcccagttaaattttaaaatccagaacagtagccttacgggattcttacaaaatttcacaaactctttcttctccaaagttctagggcgatctttgaagcattctttcaccataaactcttgggttagtaatctttaacttattctcttccattttcatcaacatctattgaatttcttggcctaaaacatgtaatttagggtagaaattgggggagtgggtagagttagggctttttactttttcttgatttggacctcgttttggggtcgaatttgaaaaaattatatattcgggctcgtggatgaatgggtgatatggttttggtccgaacctcgtgtttggaccatgtgggcccggggtcgaattttggtatttttggaagaatgctaggaacttcatatctaagctatgggattttgttatcgagtctttattgatattattgaattaattatgcctagatatcgttgtttcggagtcgggttataaaggaaaggcaatatttgagggttgattgctattctttggaccgaggtaagtgtttgttctaactttggcttgagggaatatgattaaagtattgtttgctatttgctaattgttgagtacggtgtataggcatggtgacgagtatctatacaccggagtctagcatgaccgtgcctcttatttgttttttttcggatttaatgatacctcttccttgttaaattcataaatttcatataatgtgaagagtttgaggaagagttatgatttgtacattcttggagcgttggctcgagtgtatcataaatcatgaaagtatatgaaatgattaaacccctttggagcgttggctcaggtggtaaagtgagataagaggtaaaagtgaaagaaagagaaagaattattgaattgctcccttgccgggatgcttgttgctttgttgactatctcccttgccgggatgcttgttgttttgttgactatctcccttgccgggatgcttgttgctttgttgactatctcccttgccggaatgctgagattattgttattgttcccttgctgggttttttttaactgcttaattgtgctcccttgccgggagttagctgtttatttgtattcccttgccgggatttctatcattatttgtctactcccttgccccttgtttgtgattgttgcttgggtgaggaagagtgataaagcacgaagggtgatgccgtgcattgtttgctattgtgaggaaagagtgtaaagcactgatgtgatgaaattgagtgtaaagcacgaagggtgatgccgtgattgattgatatggtgaggaaagagagtaaaagcacgaagggtgatgccgtgcatatttcatttatatgattgctttggtgaggacgagagtaaaagcacgaagggtgatgccgtgcatttgttgctttctgattctttgttgatatccgagttatgttgtttctttcattacttgttcttatttgatttacttcgaggttatagatttccttaccctatttgccttgtgattgttgtttgggtgaggaagagcgtaaagcacgaagggtgatgccgtgcaaattgttgacttttgattcttgttgacattctggctttgttacttctttctgttattgaggatttctatttgaaactgttagctccccatagcatgctcccccctcttagctgtttaaattctgtatatttccttttattgcatatatctgcacaggttgtttttggtaggtcctgtctagcctcgtcactacttcgccggggttaggccaggcacttaccagcacatggggtcggttgtgctgatgctacactctgtgcatctttttgcacagatccaggagcagcttttggacctcagcagtaggatttgatcgggagctgacttcagtccagagacaccgaggtagccttgctgacgtccgcaggcccggagtctctctctctttattcagtttgttatcttttgtaccgaaacaaacagtttataattttctttcagacgattgtatttagtaaatcttagaagttcgtgagcattgtgacaccaatcttgggtagaggattatgttaaactttccgcatttctattcagtttttatataagttaagacttccgcttgaaatttttaattatgttgcctttattacatgttgataattatggaaaagaatgtgtgttaaacggaaggtaatttaagttggcttgcctagctcctattagtaggcgccatcacgaccccgagggtgggaaatccgggtcgtgacaagttggtatcagagcactaggttacttaggtctcacaactcacggacaagctcggtagagtctgagggatcggtacggagacgtctgtatttatcccgcagaggctactgagttaggaaaacttcacatctgttctttcttgtcgtgcggttctgtttccccaatactgattgaatttctactccgttctttcgcagatggcgaggacacgcgcttcctcatcgaccgcgcagcagcccgagcccccagtagcagctcctattaggggcagagggggcgaggccgtgccagaggccgaggcaggggcagagctcagccccgagcagcagttccagaggtggagcctcatgttgattatgatgaggaggttccagctccagcagctccggtgggcccagctcaggtcccagagggtttcattgccaccccagttcttcaggacgccctggttcgattggtgggccttatggagagagtcacccgaacaggtttgcttcctgtagcaccagccacttctcaggctggaggaggggctcagactcctgctacacgcactccggagcaggtagctccccagattcagactccagcggttcagccagttggggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatggtagaggccatcctcctaggccctttcagtcagctctccaggtatcacatggtatctcaggtggtcgtggttctcagacgcattatttggatcagcagtccttcagtgcaccaccagctcccatcagtgcaccgccgcttcagagtttccgaggtggtcattcaggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgttgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccttagagtggagagggagactcccctgttatttctatgtgaaggcgtatggtcgagaaggggtgtttggcctacttggcttatgttcgtgattccagtgctgagattccctctattgattctgtgcccgtggttcgtgagtttcctgaggttttcccatcagacttgccagggatgccacccgatagggatattgatttttgcatcgatttggctccgggcactcagcccatttctattccgccatatcgcatggccccgccagagttgaaagagttgaaagagcagttgcaagacttgcttgagaagggtttcattagacccagcgtatcgccttggggtgcgccggttctgtttgtaaagaaaaaggatggctcgatgagaatgtgcattgattaccggcaattgaacaaggttacaattaagaataagtatccactgccgaggattgatgatttgttcgatcagcttcagggtgccaaggtattttcaaagattgacttgagatctggctaccatcagttgaggattagggcatccgatgtccctaagacagcattccgcactcggtacgggcattatgagttcttggttatgtcatttgggttgaccaatgccccagcagcctttatggatttgatgaaccgagtgttcaggccttatttggactcgttcgtgatagtcttcattgatgatattttgatatattcccgcagccgggaggagcacgagcagcatcttagagtggttcttcagaccttgagggatagtcagttatatgctaagttctcgaagtgtgagttctggttgagctcagttgcatttctgggtcatgttgtatcagcagagggtattcaggttgatccaaagaagattgaggcagtcaagaactggcctagaccagcatcagcctagagattcggagtttcttggggttagcaggttactatcgtcggttcgtggaggggttctcatctattgcagccccgatgaccaggttgacccagaagggagcccagttcagatggtcggacgagtgtgaggcgagctttcagaagctcaagacagctctgactacggcaccggtattggttttgcccacaggttcagggccttatacagtctattgtgatgcatctcgtattggacttggtgcagtgttgatgcaggatggcaaggtcattgcctatgcttcgaggcagttgaaggttcatgagaagaactatccagtgcatgatttggagttggcagccattgttcacgcattgaagatttggaggcactatctgtatggcgtggcgtgtgaggtgttcacggatcataagagtcttcagtatttgttcaagcaaaaggagttgaatttgaggcagaggaggtggttggagttgttgaaagattatgacatcactatcctatatcacccgggaaaggccaatgtggtggccgatgccttgagtaggaagtcagccagtatgggcagtcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtacagcgtggaggtgccaagcaggttaccttagatgctgatggagttttgagattgcagggtcgagtttgtgtgcctaatgtggatgggcttcgagagttgattttagaggaggcccatagctcccggtactctattcatccgggcgccgcgaagatgtatcaggacttgcggcagcattattggtggcgtagaatgaagaaggatatcgttgcctatgtggctcggtgtttgaattgtcagcaggttaagtatgagcatcagaggcctggtggtttatttttggagtggaagtgatcactatggacttcgttgttgggctcccgcagactcggaggaagttcgacgcagtttgggtcattgttgataggctgaccaagtcagcgcatttcattcctgtggcagtctcctattcatccgagaggttagctgagatctatatccgggagattgttcgccttcatggtgtgccggtatctatcatttcggaccgaggtacgcagtttacctcgcgtttctggaaagcagtcagcgagagttaggcacccaggttgagttgagtacaacatttcatcctcagacggacgggcagtccgagcggactattcagatattggaggatatgctccgagcttgtgtcattgactttggaggttcgtgggatcagttcttgcctttagcagagtttgcctacaacaacagctaccagtcgagtatccagatggctccttatgaggctttgtatggtaggcgatgtcgatctccggttggatggtttgagccgggagaggctcggttgttgggtacagatttggttcaggaggcttggacaaggtcaggatcattcaggataggcttcgtacagctcagtccaggcaaaagagctatgcagatcgaaaggttcgagatgtggctttcatggttggtgagcgggtattgctccgagtgtcgcctatgaagggcgtgatgagatttgggaagaagggcaagcttagccctaggttcattggtccatttgagattcttgatcgagtgggagaggtggcttatagacttgcattgccaccgagcttatcagccgtacatccagtgtttcatgtgtccatgcttcggaaatatcacggcgatccatcccacgtgttagatttcagcactgtccagttggacaaggacttatcttatgaggaggagccggtagctattctagaccggcaggttcgccagttgaggtcgaagagttttccttcggttcgtgttcagtggagaggtcagcctcctgaggcatcgacctgggagtccgagtccgatatgcgggaccgttatcctcaccttttccccgactcaggtacttccttcttatgtccgttcgaggacgaacggttgttttagaggtggagaatgtgacgacccaaagggtcatcaccggttttctccctttttcgtgcttccgaggccttga

SEQ ID NO: 10 - DNA, 13251 bp, Nicotiana tabacum
tcaaggcctcggaagcacaaaaaagggagaaaaccggtgatgaccctttgggtcgtcacattctccacctctaaaacaaccgttcgtcctcgaacggacataagaaggaagtacctgagtcggggaaaaggtgaggataacggtcccgcatatcggactcggactcccaggtcgatgcctcaggaggctgacctctccactgaacacgaaccgaaggaaaactcttcgacctcaactgcgaacctgccggtctagaatagctaccggctcctcctcataagacaagtccttgtccaactggacagtgctgaaatctaacacgtgggatggatcgccgtgatatttccgaagcatggacacatgaaacactggatgcacggctgataagctcggtggcaatgcaagtctataagccacctctcccactcgatcaagaatctcaaatggaccaatgaacctagggctaagcttgcccttcttcccaaatctcatcacgcccttcataggcgacactcggagcaatacccgctcaccaaccatgaaagccacatctcgaaccttcgatctgcatagctcttttgcctggactgagctgtacgaagcctatcctgaatgatcctgaccttgtccaaggcctcctgaaccaaatctgtacccaacaaccgagcctctcccggctcaaaccatccaaccggagatcgacatcgcctaccatataaagcctcataaggagccatctggatactcgactggtagctgttgttgtaggcaaactctgctaaaggcaagaactgatcccacgaacctccaaagtcaatgacacaagctcggagcatatcctccaatatctgaatagtccgctcggactgcccgtccgtctgaggatgaaatgttgtactcaactcaacctgggtgcctaactctcgctgaactgctctccagaaacgcgaggtaaactgcgtacctcggtccgaaatgatagggcacaccatgaaggcgaacaatctcccggatatagatctcagctaacctctcggatgaataggagactgccacaggaatgaaatgcgctgacttggtcagcctatcaacaatgacccaaactgcgtcgaacttcctccgagtctgcgggagtccaacaacgaagtccatagtgatccgctcccacttccactcgggaagctcaatcctctgaaataaaccaccaggcctctgatgctcatacttaacctgctgacaattcaaacaccgagccacatatgcaacgatatccttcttcattctacgccaccaataatgctgccgcaaatcctgatacatcttcgcggcgcccggatgaatagagtaccgggagctatgggcctcctctaaaatcaactctcgaagcccatccacattaggcacacaaactcgaccctgcaatctcaaaactccatcatcatctaaggtaacctgcttggcacctccacgctgcaccgtgtctctaaggacacacaaatggggatcatcaaactgccgatcacggatacgctccaataacgaagaacgagcgaccgtgcaagctaatactctactaggctcagaaatatccaacctcactaactgattggccaaagcctgaacgtccaaagcaagcggtctctcaccgaccggaatataagcaagactgcccatactggctgacttcctactcaaggcatcggccaccacattggcctttcccgggtgatatagatagtgatgtcataatctttcaacaactccaaccacctcctctgcctcaaattcaactccttttgcttgaacaaatactgaagactcttatgatccgtgaacacctcacatgccacgccatacagatagtgcctccaaatcttcaatgcgtgaacaatggctgccaactccaaatcatgcactggatagttcttctcatgaatcttcaactgcctcgaagcataggcaatgaccttgccatcctgcatcaacactgcaccaagtccaatacgagatgcatcacaatagactgtataaggccctgaacctgtgggcaaaaccaataccggtgccgtagtcagagctgtcttgagcttctgaaagctcgcctcacactcgtccgaccatctgaactgggcacccttctgggtcaacctggtcatcggggctgcaatagatgagaacccctccacgaaccgacgatagtagcctgccaaccccaagaaactccgaatctctgtagctgatgctggtctaggccagttcttgactgcctcaatcttctttggatcaacctgaataccctctgctgatacaacatgacccagaaatgcaactgaactcaaccagaactcacacttcgagaacttagcatataactgactatccctcaaggtctgaagaaccactctaagatgctgctcgtgctcctcccggctgcgggaatatatcaaaatatcatcaatgaagactatcacgaacgagtccaaataaggcctgaacactcggttcatcaaatccataaaggctgctggggcattggtcaacccaaatgacataaccaagaactcataatgcccgtaccgagtgcggaatgctgtcttagggacatcggatgccctaatcctcaactgatggtagccagatctcaagtcaatctttgaaaataccttggcaccctgaagctgatcgaacaaatcatcaatcctcggcagtggatacttattcttaattgtaaccttgttcaattgccggtaatcaatgcacattctcatcgagccatcctttttctttacaaacagaaccggcgcaccccaaggcgatacgctgggtctaatgaaacccttctcaagcaagtcttgcaactgctctttcaactctttcaactctggcggggccatgcgatatggcggaatagaaatgggctgagtgcccggagccaaatcgatgcaaaaatcaatatccctatcgggtggcatccctggcaagtctgatgggaaaacctcaggaaactcacgaaccacgggcacagaatcaatagagggaatctcagcactggaatcacgaacataagccaagtaggccaaacaccccttctcgaccatacgccgagccttcacatacgaaataacactgcgggtagaatgaccaggagtccctctccactctaaacggggcaaatccggtaaggctaaagtcacagtcttggcatgacaatccaagatcgcatgatacggggacaaccaatccatccctaatataacgtcgaaatccaccatatctaagagcaacaaatcaacacgggtctcaagtcccctaaacaccacaacacaggaacgatgaacccgatcaaccactatagaatcacccactggtgtagatacatacacaggaatactcaaggcctcactaggcataaccaggtagggtgcaaaataggacgacacatatgaatacgtagatccagggtcaaatagcactgaagcatctctatcacagaccaaaatagtacctgtaataacagcatcggatgactcagcctctggcctggctggcaaagcataacatcggggctgggccccacctccctgaatcacatccctgggacgatcggctgctggctgacccctacctctggcggtctgagctccacctctatgacctctacctccacctctatgtcctctacccccgcctctagctggctgggcaggctgtggagcaactggtgcctgaatcataggacgaggaccctgctgctgagaactacccgaagctcgagggcaaaacctggcaatgtgacccatatcaccacaagtgtaacaagccctcggctgctgagactgctgaccctgtcgccctgaatgaccacctcggaaactctgaagcggcggtgcactgatgggagctggtggtgcactgaaggactgctgatccaaataatgcgtctgagaaccacgaccacctgagataccatgtgatacctggagagctgactgaaagggcctaggaggatggcctctaccatacgaatctctacctccagacgaggtaccactgaatctgcctgaatgacggggcctcttatccgacccatgaccacctccctgtgacagaaccatctcaactctgcgggccacattggccgcctcctgaaatgtgatctcgctcccggcctccttggccatctgaagacgaatcggcagaataagaccatcaataaaccttctcaccctctctctctcggtgggaagtatgatgagagcatggcgagctaaatcgatgaacctggtctcatactgggtaacagtcatagaaccctgctggaggcgctcaaactgcctccgataggcctctctctgagtaacggggagaaacttctctagaaacaacactgtaaactgctcccaagtcaaagatggcgatccggctggtctcgctaagcaataatccctccaccaagtcttggcggatccagacaagcgaaatgtagcaaaatcaaccccattggtctcaacaatacccatgtttctgagaacctcgtggcagctgtctagataatcctggggatcctcagtagatgcaccgcaaaagtagaagtgaagagcttggtgaacctatccaatctccacaaagcatcggcggacatagccgctccatcgccggtctgagctatacccggctgaacccactgctggctgaaccaccggaacctgaacctggggagctacctgctccggagtgtacgtgtagcaggagtctgacccctcctccagcctgagaagtggctggtgctactggaagcaaacccgctcgtgacgctctccatgaaggcctaccaatcggaccaaagcgtcctgaagaactggagtggcaatgaaaccctctgggacctgagctgggcccaccggagctgctggagctggaacctcctcatcataatcaacatgaggctccacctctggaactgctgctcggggctgagctctgcccctgcctcggcctctgggcctcgcctcgccctctgcccctaataggagctgctgctgggggctcgggctgctgcgcggtcgatgaggaagcgcgtgtcctcgccatctgcgaaagaacggagtagaaattcaatcagtattggggaaacagaaccgcacgacaagaaagaacagatgtgaagttttcctaactcagtagcctctgcgggataaatacagacgtctccgtaccgatccctcagactctaccgagcttgtccgtgagttgtgagacctaagtaacctagtgctctgataccaacttgtcacgacccggatttcccaccatcgggagtcgtgatggcgcctactattggagctaggccagccaagtattaaaacatttctgataacattcgcaacaatataacaaaacgagacaattaaataaaagcggaagtcttaacttatataaaactgaatagaaatgcggaaagtttaacataatcctctacccaagattggtgtcacaatgctcacgaacttctaagatttactaaatacaatcgtctgaaagaaaattataaactgtttgtttcggtacaaaagataacaaactgaataaagagagagagactccgggcctgcggacgtcagcaaggctacctcggtgtctctggactgaagtcagctcccgatcaaatcctactgctgaggtccgcgtaaagcacgaaaggtgattccatgtattgttttggtgaggacgagagtaaaagcacgaagggtgatgctgtgcaaattgttgactttttattcttcttgacattctggctttgttacttctttctgttattgaggatttctatttgaaacttttagctccccatagcatgctccccccttcttagctgtttaaattctgtatatttccttttattgcatatatctgcataggttgtttttggtaggtcctgtctagcctcgtcactacttcgcctgggttaggccaggcacttaccagcacatggggtcggttgtgctgatgctacactctgtgcatctttttgcacagatctaggagcagctttttcttcctcacccaaacaacaatcacaaggcaaatagggtaaggaaatctataacctcgaagtaaatcaaataagaacaagtaatgaaagaaacaacataactcggatatcaacaaagaatcagaaagcaacaaatacacggcatcacccttcgtgcttttactctcgtcctcaccaaagcaatcatataaatgaaatatgcacggcatcacccttcgtgcttttactctctttcctcaccatataatcaataaaatcggcacggaatggtacatcgtgcggcacgacatcacccttcgtgctttacactctttcctcacaatagcaaacaatgcacggcatcacccttcgtgctttatcactcttcctcacccaagcaacaatcacaaacaaggggcaagggagtagacaaataatgatagaaatcccggcaagggaatacaaataaacagctaactcccggcaagggagcacaattaagcagttaaaaacccggcaagggaacaatatcaataatctcagcatcccggcaagggagatagtcaacaaagcaacaagcatcccggcaagggagcaattcaataattctttctctttctttcacttttacctcttatctcactttaccacctgagccaacgctccaaaggggttcaatcatttcatatactttcacgctttatgatatactcgagccaatgctccaagaatgtacaaatcataattcttcctcaaactcttcacattatatgaaatttatcaatttaacaaggaagaggtatcacaaaatccgaataaacacaaataagactcacggtcatgctagactccggtgtatagatactcgtcaccatgcctatacaccgtactcaacaattagcaaatagcaaacaacactctaatcctattccctcaagccaaagttagaacaaacacttacctcggtccaaagaatagcaatcaaccctcaaataccgcctttcctttataatccgactccgaaacaacgatatctaggcataattaattcaataatatcaataaagactcgataacaaaatcccatagcttagatatgaagttcctagcattcttccaaaaataccaaaattcgaccccgggcccacatggtccaaacacgaggttcggaccaaaaccatatcacccattcatccacgagcccgaatatataattttttcaaattcgaccccaaaacgaggtccaaatcaagaaaaagtaaaaagccctaactctacccactcccccaatttctaccctaaattacatgttttaggccaagaaattcaatagatgttgatgaaaatggaagagaataagttaaagattactaacccaagagtttatggtgaaagaatgcttcaaagatcgccctagaactttggagaagaaagagtttgtgaaattttgtaagaatcccgtaaggctactgttctggattttaaaatttaactgggcgaatttggcctatgcgatcgcggacaaaggagtgcgatcgcatagagtaaatgggacagggctctgcgatcgcgaatgacactatgcgatcgcataaaggaaatagtgaaggctggctaacacactgcgatcgcagaggaaataatgcgatcgcgtagagcaaaatataggacctctcaggctaactactaactatgcgatcgcatagaacaaactaaaaccctgaaaatttacactatgcgatcgcggacatagctatgcgatcgcatagcacaaaagactggacaccagcagacagcagttctgcaatttttctaagtctaaaaccattccgaaacaaacacccgagccctcggggctcctaaccaaacacatgcactaactcaacaacatcatacgaacttatccgtgcgatcaaatcgcctaaataacttcaaaaacaatgaatcaaacctcaaaatcaagagtttttctcaaacttcatcaagtttcaaatttaggaattcaagtccgaatcacgtcaaacgacgtccgatttcaaccaaatttcacagaaagcgcttaaaccacatataagacctgtaccgggcgccggaaccaaaatacgggcccgataccaatgctttctaattcatttttatttcaaattttcatattaaatttcagaaaacaatttcttttaaaaattcatttctcgggctcgggacctcggatttcgattccgggcatacgcccgagtcccatatttttctacggaccctccgggaccgtcaaatcacgggtccgggtccgtttacccaaaatgttgaccaaagtcaactttaaccattttaaagccacaatttatcaaatttcacataatttaacacataagcttttccggctacgcgcccggactgcgcacgcaaatcgaggcaactaaaggtgaggttttcaaggcctcggaagcacgaaaaagggagaaaaccggtgatgaccctttgggtcgtcacattctccacctctaaaacaaccgttcgtcctcgaacggacataagaaggaagtacctgagtcggggaaaaggtgaggataacggtcccgcatatcggactcggactcccaggtcgatgcctcaggaggctgacctctccactgaacacgaaccgaaggaaaactcttcgacctcaactggcgaacctgccggtctagaatagctaccggctcctcctcataagataagtccttgtccaactggacagtgctgaaatctaacacgtgggatggatcgccgtgatatttccgaagcatggacacatgaaacactggatgtacggctgataagctcggtggcaatgcaagtctataagccacctctcccactcgatcaagaatctcaaatggaccaatgaacctagggctaagcttgcccttcttcccaaatctcatcacgcccttcataggcgacactcggagcaatacccgctcaccaaccatgaaagccacatctcgaacctttcgatctgcatagctcttttgcctggactgagctgtacgaagcctatcctgaatgatcctgaccttgtccaagcctcctgaaccaaatctgtacccaacaaccgagcctctcccggctcaaaccatccaaccggagatcgacatcgcctaccatacaaagcctcataaggagccatctggatactcgactggtagctgttgttgtaggcaaactctgctaaaggcaagaactgatcccacgaacctccaaagtcaatgacacaagctcggagcatatcctccaatatctgaatagtccgctcggactgcccgtccgtctgaggatgaaatgttgtactcaactcaacctgggtgcctaactctcgctgactgctttccagaaacgcgaggtaaactgcgtacctcggtccgaaatgatagataccggcacaccatgaaggcgaacaatctcccggatatagatctcagctaacctctcggatgaataggagactgccacaggaatgaaatgcgctgacttggtcagcctatcaacaatgacccaaactgcgtcgaacttcctccgagtctgcgggagcccaacaacgaagtccatagtgatcacttccactccaaaaataaaccaccaggcctctgatgctcatacttaacctgctgacaattcaaacaccgagccacataggcaacgatatccttcttcattctacgccaccaataatgctgccgcaagtcctgatacatcttcgcggcgcccggatgaatagagtaccgggagctatgggcctcctctaaaatcaactctcgaagcccatccacattaggcacacaaactcgaccctgcaatctcaaaactccatcagcatctaaggtaacctgcttggcacctccacgctgtaccgtgtctctaaggacacacaaatggggatcatcaaactgccgatcacggatacgctccaataacgaagaacgagcgaccgtgcaagctaatactctactaggctcagaaatatccaacctcactaactgattggccaaagcctgaacgtccaaagcaagcggtctctcaccgaccggaatataagcaagactgcccatactggctgacttcctactcaaggcatcggccaccacattggcctttcccgggtgatataggatagtgatgtcataatctttcaacaactccaaccacctcctctgcctcaaattcaactccttttgcttgaacaaatactgaagactcttatgatccgtgaacacctcacacgccacgccatacagatagtgcctccaaatcttcaatgcgtgaacaatggctgccaactccaaatcatgcactggatagttcttctcatgaaccttcaactgcctcgaagcataggcaatgaccttgccatcctgcatcaacactgcaccaagtccaatacgagatgcatcacaatagactgtataaggccctgaacctgtgggcaaaaccaataccggtgccgtagtcagagctgtcttgagcttctgaaagctcgcctcacactcgtccgaccatctgaactgggctcccttctgggtcaacctggtcatcggggctgcaatagatgagaacccctccacgaaccgacgatagtaacctgctaaccccaagaaactccgaatctctaggctgatgctggtctaggccagttcttgactgcctcaatcttctttggatcaacctgaataccctctgctgatacaacatgacccagaaatgcaactgagctcaaccagaactcacacttcgagaacttagcatataactgactatccctcaaggtctgaagaaccactctaagatgctgctcgtgctcctcccggctgcgggaatatatcaaaatatcatcaatgaagactatcacgaacgagtccaaataaggcctgaacactcggttcatcaaatccataaaggctgctggggcattggtcaacccaaatgacataaccaagaactcataatgcccgtaccgagtgcggaatgctgtcttagggacatcggatgccctaatcctcaactgatggtagccagatctcaagtcaatctttgaaaataccttggcaccctgaagctgatcgaacaaatcatcaatcctcggcagtggatacttattcttaattgtaaccttgttcaattgccggtaatcaatgcacattctcatcgagccatcctttttctttacaaacagaaccggcgcaccccaaggcgatacgctgggtctaatgaaacccttctcaagcaagtcttgcaactgctctttcaactctttcaactctggcggggccatgcgatatggcggaatagaaatgggctgagtgcccggagccaaatcgatgcaaaaatcaatatccctatcgggtggcatccctggcaagtctgatgggaaaacctcaggaaactcacgaaccacgggcacagaatcaatagagggaatctcagcactggaatcacgaacataagccaagtaggccaaacaccccttctcgaccatacgccttcacatagaaataacaggggagtctccctctccactctaaggggcaaatccggtaaggctaaagtcacagtcttggcatgacaatccaagatcgcatgatacggggacaaccaatccatccctaatataacgtcgaaatccaccatatctaagagcaacaaatcaacacgggtctcaagtcccctaaacaccacaacacaggaacgatgaacccgatcaaccactatagaatcacccactggtgtagatacatacacaggaatactcaaggcctcactaggcataaccaggtagggtgcaaaataggacgacacatatgaatacgtagatccagggtcaaatagcactgaagcatctctatcacagaccaaaatagtacctgtaataacaacatcggatgactcagcctctggcctggctggcaaagcataacatcggggctgggccccacctccctgaatcacatccctgggacgatcggctgctggctgacccctacctctggcggtctgagctccacctctatgacctctacctccacctctatgtcctctacccccgcctctagctggctgggcaggctgtggagcaactggtgcctgaatcataggacgaggaccctgctgctgagaactacccgaagctcgagggcaaaacctggcaatgtgacccatatcaccacaagtgtaacaagccctcggctgctgagactgctgaccctgtcgcctgaatgaccacctcggaaactctgaagcggcggtgcactgatgggagctggtggtgcactgaaggactgctgatccaaataatgcgtctgagaaccacgaccacctgagataccatgtgatacctggagagctgactgaaagggcctaggaggatggcctctaccatacgaatctctacctccagacgaggtaccactgaatctgcctgaatgacggggcctcttatccgacccatgaccacctccctgtgacagaaccatctcaactctgcgggccacattggccgcctcctgaaatgtgatctcgctcccggcctccttggccatctgaagacgaatcggcagaataagaccatcaataaaccttctcaccctctctctctcggtgggaagtatgatgagagcatggcgagctaaatcgatgaacctggtctcatactgggtaacagtcatagaaccctgctggaggcgctcaaactgcctccgataggcctctctctgagtaacggggagaaacttctctagaaacaacactgtaaactgctcccaagtcaaagatggcgatccggctggtctcgctaagcaataatccctccaccaagtcttggcggatccagacaagcgaaatgtagcaaaatcaaccccattggtctcaacaatacccatgtttctgagaacctcgtggcagctgtctagataatcctggggatcctcagtagatgcaccggcaaaagtagaagtgaagagcttggtgaacctatccagtctccacaaagcatcggcggacatagccgctccatcgccggtctgagctatggcacccggctgaactaccccaactggctgaaccgctggagtctgaatctggggagctacctgctccggagtgcgtgtagcaggagtctgagcccctcctccagcctgagaagtggctggtgctacaggaagcaaacctgttcgggtgactctctccat

SEQ ID NO: 11 - DNA, 3518 bp, Nicotiana tabacum
atggcgaggacacgcgcttccttatcgaccgagcagcagcccgagcccccagcagcagctcctattaggggcagagggcgaggccatgctagaggccgaggtaggggcagagctcagccccgagcagcagttccagaggtggagcctcatgttgattatgatgaggaggttccagctccagtaactttggtgggcctaactcaggtcccagagggttttattgccaccctagttcttcaggacgccctggttcaattggtgggccttatggagagagtcacccgaatatgttttcttcctgtagcaccagccacttctctggctggaggaggggctcagactccttctacacgcactccggagtaggtagctccccagattcagattccagcggtttagctagttagggtagttcagccgggtgccatagctcagaccggcgatggagcggctatgttcgtcgatgctttgtggagactggataggttcaccaagctcttcacttctacttttgccggtgcatttactgaggatccccaggattatctagaaagcttccacgaggttctgagaaacatgggtattattgagaccaatggggttgattttgctacatttcgcttgtctggatccgccaagacttggtggagggattattgcttagcgagaccagccggatctccatctttgacttgggagcagtttacagtgttgtttctagagaagtttctccccgttacttagagagaggcctatcggaggcactttgagcgcctccagtagggttctatgactgttacccagtatgagaccaggttcaacgatttagctcgccatgctctcatcatacttcccaccgagagagagagggtgagaaggtttattgatggtcttattctgccaattcgtcttcagatggccaaggagggcgggagcgagatcacatttcaggaggcggtcaatgtggcccgcatagttgagatggttatgtcatatggaggtggtcataggtcggataagaggccccgtcattcaggaagattctgtggtattgcgtctggaggtagagattcgtatggtagaggccatcctcctaggctcgttcagtcagctcaccaggtatcacatggtatctcaggtggtcgtggttctcagatgcattatttggatcagtagtctttcagtgcaccaccatctcccatcagtgcaccgccacttcagaatttctgaggtggtcattcagggcaatagggtcagcagtctcagcagccgagggcttgttacacttgtggtgatatgggtcacatttctaagttttacccttgagcttcgggtagttctcaacaacagggtcctcgccttatgattcaggcaccagttgctccatagcctgcccagccagctagaggcgggggtagaggacatagaggtggaggtagaggtcatagaggtggagctcagaccgccagaggtaggggtcagccagcagccgatcgtcccagggttgtgatttagggaggtagggcccaaccccgatgttatgctttgctagccaggccagaggctaagtcatccgatgctgttattacaggtactattttggtctgtgatagagatgcttcagtgctatttgaccctggatctacgtattcacatgtgtcgtcctattttgcaccctacttggttatacgtagtgaggccttgagtattcctgtgtatgtatctacactagtaggtgattctatagtggttgattgggttcatcgttcctgtgttgtggtgtttaggggacttgagacccgtgttgatttgttgctcttagatatggtggattttgacattatattagggatggattggttgtccccgtatcatgcgatcttggattgtcatgccaagattgtgactttagccttatcggattttccccatttagagtggagagggactcctggtcattctacccgtagtgttatttcgtatgtgaaggctcggtgtatggtcgagaaggggtgtttggcctactcagcttatgttcgtgattccagtgctgagattccctctattgattctgtgaccttggttcgtgaatttcctgtggttttcccatcagacttgccaaggatgccacccgatagggatattgatttttgcatcgatttggctccgggcactcagcccatttctattccaccatatcacatgtccctgctagagttgaaagagttgaaagagcagttgcaagacttgcttgagaagggtttcattagacccagcatatcgccttggggtgcgccgactttgtttgtaaagaaaaaggatggctcgatgagaatgtgcattgattaccggcaattgaacaaggttacaattaagaataagtatccactaccgaggattgataatttgttcgatcagcttcagggtgccaaggtattttcaaagattgacttgagatgtggctaccatcagttgaggactagggcatccgatgtccctaagacagcattccgcactcggtacgggcattataagttcttggttatgtcatttgggttgaccaatgcccctgcagcctttatggatttgatgaaccgagtgttcaggacttatttggactcgttcgtgatagtcttcattgatgatattttgatatattcccgcagccgggaggagcacgagcaacatcttagattggttcttcagaccttgaggtatagtcagttatatgctaagttctcgaagtgtgagttctggttgagctcggttgcatttctgggtcacgttgtatcagcagagggtattcaggtgggcccgaagaagatagaggtagtcaagaattagcctcgaccagctttaactacagagattcagagtttcttggggttagaaggttactaccgtcggtttgtggaggggttttcatccattgcagccccgatgaccaggttgacccagaagggagcccagttcagatggccggacgagtgtgaggcgaactttcagaagctcaagaccgctctgactacgacaccggtattggttttgcccgcaggctcagggccttatacagtctattatgatgcatctcgtattggacttgatgcagtgttgatgtaggatggcaaggtcattgcctatgcttcgaggcagttgaaggttcatgagaagaactatcctgtgcatgatttggagttggcagccattgttcacgcattgaagatttggaggcactatctgtatggcgtggcgtgtgaggtgttcacggatcataagcgtctttagtatttgttcaagcaaaaggagttgaatttgaggcagaggaggtggttgaagttgttgaaagattatgacatcactatcctatatcacccgggaaagtccaatgtggtggccgataccttgagtaggaagtcagccagtatggtcagtcttgcttatattccggtcggcgagagacctcttgctttggacgttcaggatttggccaatcagttaatgaggttggatatttctga

SEQ ID NO: 12 - DNA, 11658 bp, Nicotiana tabacum
tcacaactgattggccaaagcctgaacgtccaaagcaagcggtctctcaccgaccggaatataagcaagactgcccatactggctgacttcctactcaaggcatcggccaccacattggcctttcccgggtgatataggatagtgatgtcataatctttcaacaactccaaccacctcctctgcctcaaattcaactccttttgcttgaacaaatactgaagactcttatgatccgtgaacacctcacacgccacgccatacagatagtgcctccaaatcttcaatgcgtgaacaatggctgccaactccaaatcatgcactggatagttcttctcatgaaccttcaactgcctcgaagcataggcaatgaccttgccatcctgcatcaacactgcaccaagtccaatacgagatgcatcacaatagactgtataaggccctgaacctgtgggcaaaaccaataccggtgccgtagtcagagctgtcttgagcttctgaaagctcgcctcacactcgtccgaccatctgaactgggcacccttctgggtcaacctggtcatcggggctgcaatagatgagaacccctccacgaaccgacgatagtaacctgctaaccccaagaaactccgaatctctgtagctgatgctggtctaggccagttcttgactgcctcaatcttcttcggatcaacctgaataccctctgctgatacaacatgacccagaaatgcaactgagctcaaccagaactcacacttcgagaacttagcatataactgactatccctcaaggtctgaagaaccactctaagatgctgctcgtgctcctcccggctgcgggaatatatcaaaatatcatcaatgaagactatcacgaacgagtccaaataaggcctgaacactcggttcatcaaatccataaaggctgtggggcattggtcaacccaaatgacataaccaagaactcataatgcccgtaccgagtgcggaatgctgtcttagggacatcggatgccctaatcctcaactgatggtagccagatctcaagtcaatctttgaaaataccttggcaccctgaagctgatcgaacaaatcatcaatcctcggcagtggatacttattcttaattgtaaccttgttcaattgccggtaatcaatgcacattctcatcgagccatcctttttctttacaaacagaaccggcgcaccccaaggcgatacgctgggtctaatgaaacccttctcaagcaagtcttgcaactgctctttcaactctttcaactctggcggggccatgcgatatggcggaatagaaatgggctgagtgcccggagccaaatcgatgcaaaaatcaatatccctatcgggtggcatccctggcaagtctgatgggaaaacctcaggaaactcacgaaccacgggcacagaatcaatagagggaatctcagcactggaatcacgaacataagccaagtaggccaaacaccccttctcgaccatacgccgagccttcacatacgaaataacactgcgggtagaatgaccaggagtccctctccactctaaacggggcaaatccggtaaggctaaagtcacagtcttggcatgacaatccaagatcgcatgatacggggacaaccaatccatccctaatataacgtcgaaatccaccatatctaagagcaacaaatcaacacgggtctcaagtcccctaaacaccacaacacaggaacgatgaacccgatcaaccactatagaatcacccactggtgtagatacatacacaggaatactcaaggcctcactaggcataaccaggtagggtgcaaaataggacgacacatatgaatacgtagatccagggtcaaatagcactgaagcatctctatcacagaccaaaatagtacctgtaataacagcatcggatgactcagcctctggcctggctggcaaagcataacatcggggctgggccccacctccctgaatcacatccctgggacgatcggctgctggctgacccctacctctggcggtctgagctccacctctatgacctctacctccacctctatgtcctctacccccgcctctagctggctgggcaggctgtggagcaactggtgcctgaatcataggacgaggaccctgctgctgagaactacccgaagctcgagggcaaaacctggcaatgtgacccatatcaccacaagtgtaacaagccctcggctgctgagactgctgaccctgtcgccctgaatgaccacctcggaaactctgaagcggcggtgcactgatgggagctggtggtgcactgaaggactgctgatccaaataatgcgtctgagaaccacgaccacctgagataccatgtgatacctggagagctgactgaaagggcctaggaggatggcctctaccatacgaatctctacctccagacgaggtaccactgaatctgcctgaatgacggggcctcttatccgacccatgaccacctccctgtgacagaaccatctcaactctgcgggccacattggccgcctcctgaaatgtgatctcgctcccggcctccttggccatctgaagacgaatcggcagaataagaccatcaataaaccttctcaccctctctctctcggtgggaagtatgatgagagcatggcgagctaaatcgatgaacctggtctcatactgggtaacagtcatagaaccctgctggaggcgctcaaactgcctccgataggcctctctctgagtaacggggagaaacttctctagaaacaacactgtaaactgctcccaagtcaaagatggcgatccggctggtctcgctaagcaataatccctccaccaagtcttggcggatccagacaagcgaaatgtagcaaaatcaaccccattggtctcaacaatacccatgtttctgagaacctcgtggcagctgtctagataatcctggggatcctcagtagatgcaccggcaaaagtagaagtgaagagcttggtgaacctatccagtctccacaaagcatcggcggacatagccgctccatcgccggtctgagctatggcacccggctgaactacccaactggctgaaccgctggagtctgaatctggggagctacctgctccggagtgcgtgtagcaggagtctgagcccctcctccagcctgagaagtggctggtgctacaggaagcaaacctgttcgggtgactctctccataaggcccaccaatcgaaccagggcgtcctgaagaactggggtggcaatgaaaccctctgggacctgagctgggcccaccggagctgctggagctggaacctcctcatcataatcaacatgaggctccacctctggaactgctgctcggggctgagctctgcccctgcctcggcctctgggcctcggcctcgccctctgcccctaataggagctgctgctgggggctcgggctgctgcgcggtcgatgaggaagcgcgtgtcctcgccatctgcgaaagaacggagtagaaattcaatcagtattggggaaacagaaccgcacgacaagaaagaacagatgtgaagttttcctaactcagtagcctctgcgggataaatacagacgtctccgtaccgatccctcagactctaccgagcttgtccgtgagttgtgagacctaagtaacctagtgctctgataccaacttgtcacgacccggatttcccaccatcgggagtcgtgatggcgcctactattggagctaggccagccaagtattaaaacatttctgataacattcgcaacaatataaacaaaacgagacaattaaataaaagcggaagtcttaacttactagaaaactgaataaatgcggaaagtttaacataatcctctacccaagattggtgtcacaatgctcacgaacttctaagatttactaaatacaatcgtctgaaagaaaattataaactgtttgtttcggtacaaaagataacaaactgaataaagagagagagagactccgggcctgcggacgtcagcaaggctacctcggtgtctctggactgaagtcagctcccgatcaaatcctactgctgaggtccaaaagctgctcctggatctgtgcaaaaagatgcacagagtgtagcatcagcacaaccgaccccatgtgctggtaagtgcctggcctaaccccggcgaagtagtgacgaggctagacaggacctaccaaaaacaacctgtgcagatatatgcaataaaaggaaatatacagaatttaaacagctaagaggggggagcatgctatggggagctaacagtttcaaatagaaatcctcaataacagaaagaagtaacaaagccagaatgtcaacaagaatcaaaaatcaacaatttgcacggcatcacccttcgtgcttttactctcgtcctcaccaaaacaatacacggcatcacccttcgtgctttacgctcttcctcacccaaacaacaatcacaaggcaaatagggtaaggaaatctataacctcgaagtaaatcaaataagaacaagtaatgaaagaaacaacataactcggatatcaacaaagaatcagaaagcaacaaatgcacggcatcacccttcgtgcttttactctcgtcctcaccaaagcaatcatataaataaaatatgcacgacacccttcgtgcttttactctctttcctcaccatataatcaataaaatcggcacggaatggtacatcgtgcggcacacatcacccttcgtgctttacactctttcctcacaatagcaaacaatgcacgacatcacccttcgtgctttatcactcttcctcacccaagcaacaatcacaaacaaggggcaagggagtagacaaataatgatagaaatcccggcaagggaatacaaataaacagctaactcccggcaagggagcacaattaagcagttaaaaacccggcaagggaacaatatcaataatctcagcatcccggcaagggagatagtcaacaaagcaacaagcatcccggcaagggagcaattcaataattctttctctttctttcacttttacctcttatctcactttaccacctgagccaacgctccaaaggggttcaatcatttcatatactttcacgctttatgatatactcgagccaatgctccaagaatgtacaaatcataattcttcctcaaactcttcacattatatgaaatttatcaatttaacaaggaagaggtatcacaaaatccgaataaactgaattataaaggaaaggcggtatttgagggttgattgctattctttggaccgatgtaagtgtttgttctaactttgacttgagggaataggattaaagtgttgtttgctatttgctaattgttgagtacggtgtataggcatggtgacgagtatctatacaccgaagtctagcatgaccgtgagtcttattccgactccgaaacaacgatatctaggcataattaattcaataatatcaataaagactcgataacaaaatcccatagcttagatatgaagttcctagcattcttccaaaaataccaaaattcgaccccgggcccacatggtccaaacacgaggttcggaccaaaaccatatcacccattcatccacgagcccgaatatataattttttcaaattcgaccccaaaacgaggtccaaatcaagaaaaagtaaaaagccctaactctacccactcccccaatttctaccctaaattacatgttttaggccaagaaattcaatagatgttgatgaaaatggaagagaataagttaaagattactaacccaagagtttatggtgaaagaatgcttcaaagatcgccctagaactttggagaagaaagagtttgtgaaattttgtaagaatcccgtaaggctactgttctggattttaaaatttaactgggcgaatttggcctatgcgatcgcggacaaaggagtgcgatcgcatagagtaaatgggacagggctctgcgatcgcgaatgacactatgcgatcgcataaaggaaatagtgaaggctggctaacacactgcgatcgcagaggaaataatgcgatcgcgtagagcaaaatataggacctctcaggctaactactaactatgcgatcgcatagaacaaactaaaaccctgaaaatttacactatgcgatcgcggacatagctatgcgatcgcatagcacaaaagactggacaccagcagacagcagttctgcaatttttctaagtctaaaaccattccgaaacaaacacccgagccctcggggctcctaaccaaacacatgcactaactcaacaacatcatacgaacttatccgtgcgatcaaatcgcctaaataacttcaaaaacaatgaatcaaacctcaaaatcaagagtttttctcaaacttcatcaagtttcaaatttaggaattcaagtccgaatcacgtcaaacgacgtccgatttcaaccaaatttcacagaaagcgcttaaaccacatataagacctgtaccgggcgccggaaccaaaatacgggcccgataccaatgctttctaattcatttttatttcaaattttcatattaaatttcagaaaacaatttcttttaaaaattcatttctcgggctcgggacctcggatttcgattccgggcatacgcccgagtcccatatttttctacggaccctccgggaccgtcaaatcacgggtccgggtccgtttacccaaaatgttgaccaaagtcaactttaaccattttaaagccacaatttatcaaatttcacataatttaacacataagcttttccggctacgcgcccggactgcgcacgcaaatcgaggcaactaaaggtgaggttttcaaggcctcggaagcacgaaaaagggagaaaaccggtgatgaccctttgggtcgtcacattctccacctctaaaacaaccgttcgtcctcgaacggacataagaaggaagtacctgagtcggggaaaaggtgaggataacggtcccgcatatcggactcggactcccaggtcgatgcctcaggaggctgacctctccactgaacacgaaccgaaggaaaactcttcgacctcaactggcgaacctgccggtctagaatagctaccggctcctcctcataagataagtccttgtccaactggacagtgctgaaatctaacacgtgggatggatcgccgtgatatttccgaagcatggacacatgaaacactggatgtacggctgataagctcggtggcaatgcaagtctataagccacctctcccactcgatcaagaatctcaaatggaccaatgaacctagggctaagcttgcccttcttcccaaatctcatcacgcccttcataggcgacactcggagcaatacccgctcaccaaccatgaaagccacatctcgaacctttcgatctgcatagctcttttgcctggactgagctgtacgaagcctatcctgaatgatcctgaccttgtccaagcctcctgaaccaaatctgtacccaacaaccgagcctctcccggctcaaaccatccaaccggagatcgacatcgcctaccatacaaagcctcataaggagccatctggatactcgactggtagctgttgttgtaggcaaactctgctaaaggcaagaactgatcccacgaacctccaaagtcaatgacacaagctcggagcatatcctccaatatctgaatagtccgctcggactgcccgtccgtctgaggatgaaatgttgtactcaactcaacctgggtgcctaactctcgctgactgctttccagaaacgcgaggtaaactgcgtacctcggtccgaaatgatagataccggcacaccatgaaggcgaacaatctcccggatatagatctcagctaacctctcggatgaataggagactgccacaggaatgaaatgcgctgacttggtcagcctatcaacaatgacccaaactgcgtcgaacttcctccgagtctgcgggagcccaacaacgaagtccatagtgatcacttccactccaaaaataaaccaccaggcctctgatgctcatacttaacctgctgacaattcaaacaccgagccacataggcaacgatatccttcttcattctacgccaccaataatgctgccgcaagtcctgatacatcttcgcggcgcccggatgaatagagtaccgggagctatgggcctcctctaaaatcaactctcgaagcccatccacattaggcacacaaactcgaccctgcaatctcaaaactccatcagcatctaaggtaacctgcttggcacctccacgctgtaccgtgtctctaaggacacacaaatggggatcatcaaactgccgatcacggatacgctccaataacgaagaacgagcgaccgtgcaagctaatactctactaggctcagaaatatccaacctcactaactgattggccaaagcctgaacgtccaaagcaagcggtctctcaccgaccggaatataagcaagactgcccatactggctgacttcctactcaaggcatcggccaccacattggcctttcccgggtgatataggatagtgatgtcataatctttcaacaactccaaccacctcctctgcctcaaattcaactccttttgcttgaacaaatactgaagactcttatgatccgtgaacacctcacacgccacgccatacagatagtgcctccaaatcttcaatgcgtgaacaatggctgccaactccaaatcatgcactggatagttcttctcatgaaccttcaactgcctcgaagcataggcaatgaccttgccatcctgcatcaacactgcaccaagtccaatacgagatgcatcacaatagactgtataaggccctgaacctgtgggcaaaaccaataccggtgccgtagtcagagctgtcttgagcttctgaaagctcgcctcacactcgtccgaccatctgaactgggctcccttctgggtcaacctggtcatcggggctgcaatagatgagaacccctccacgaaccgacgatagtaacctgctaaccccaagaaactccgaatctctaggctgatgctggtctaggccagttcttgactgcctcaatcttctttggatcaacctgaataccctctgctgatacaacatgacccagaaatgcaactgagctcaaccagaactcacacttcgagaacttagcatataactgactatccctcaaggtctgaagaaccactctaagatgctgctcgtgctcctcccggctgcgggaatatatcaaaatatcatcaatgaagactatcacgaacgagtccaaataaggcctgaacactcggttcatcaaatccataaaggctgctggggcattggtcaacccaaatgacataaccaagaactcataatgcccgtaccgagtgcggaatgctgtcttagggacatcggatgccctaatcctcaactgatggtagccagatctcaagtcaatctttgaaaataccttggcaccctgaagctgatcgaacaaatcatcaatcctcggcagtggatacttattcttaattgtaaccttgttcaattgccggtaatcaatgcacattctcatcgagccatcctttttctttacaaacagaaccggcgcaccccaaggcgatacgctgggtctaatgaaacccttctcaagcaagtcttgcaactgctctttcaactctttcaactctggcggggccatgcgatatggcggaatagaaatgggctgagtgcccggagccaaatcgatgcaaaaatcaatatccctatcgggtggcatccctggcaagtctgatgggaaaacctcaggaaactcacgaaccacgggcacagaatcaatagagggaatctcagcactggaatcacgaacataagccaagtaggccaaacaccccttctcgaccatacgccttcacatagaaataacaggggagtctccctctccactctaaggggcaaatccggtaaggctaaagtcacagtcttggcatgacaatccaagatcgcatgatacggggacaaccaatccatccctaatataacgtcgaaatccaccatatctaagagcaacaaatcaacacgggtctcaagtcccctaaacaccacaacacaggaacgatgaacccgatcaaccactatagaatcacccactggtgtagatacatacacaggaatactcaaggcctcactaggcataaccaggtagggtgcaaaataggacgacacatatgaatacgtagatccagggtcaaatagcactgaagcatctctatcacagaccaaaatagtacctgtaataacaacatcggatgactcagcctctggcctggctggcaaagcataacatcggggctgggccccacctccctgaatcacatccctgggacgatcggctgctggctgacccctacctctggcggtctgagctccacctctatgacctctacctccacctctatgtcctctacccccgcctctagctggctgggcaggctgtggagcaactggtgcctgaatcataggacgaggaccctgctgctgagaactacccgaagctcgagggcaaaacctggcaatgtgacccatatcaccacaagtgtaacaagccctcggctgctgagactgctgaccctgtcgcctgaatgaccacctcggaaactctgaagcggcggtgcactgatgggagctggtggtgcactgaaggactgctgatccaaataatgcgtctgagaaccacgaccacctgagataccatgtgatacctggagagctgactgaaagggcctaggaggatggcctctaccatacgaatctctacctccagacgaggtaccactgaatctgcctgaatgacggggcctcttatccgacccatgaccacctccctgtgacagaaccatctcaactctgcgggccacattggccgcctcctgaaatgtgatctcgctcccggcctccttggccatctgaagacgaatcggcagaataagaccatcaataaaccttctcaccctctctctctcggtgggaagtatgatgagagcatggcgagctaaatcgatgaacctggtctcatactgggtaacagtcatagaaccctgctggaggcgctcaaactgcctccgataggcctctctctgagtaacggggagaaacttctctagaaacaacactgtaaactgctcccaagtcaaagatggcgatccggctggtctcgctaagcaataatccctccaccaagtcttggcggatccagacaagcgaaatgtagcaaaatcaaccccattggtctcaacaatacccatgtttctgagaacctcgtggcagctgtctagataatcctggggatcctcagtagatgcaccggcaaaagtagaagtgaagagcttggtgaacctatccagtctccacaaagcatcggcggacatagccgctccatcgccggtctgagctatggcacccggctgaactaccccaactggctgaaccgctggagtctgaatctggggagctacctgctccggagtgcgtgtagcaggagtctgagcccctcctccagcctgagaagtggctggtgctacaggaagcaaacctgttcgggtgactctctccat

SEQ ID NO: 13 - DNA, 2639 bp, Nicotiana tabacum
atggcttatcctgcagtgaactctttaattcaaactttggagctattccaaaagacttatccagcattgatccatggtcaaactgcagagatgattgactctctccatgccagtgctgaatattttcaaaatattcttgagaacgctagccaccagaaacaggaatatgatacattcaaatattttgaggcagagataagatcagcgatgcaccaagctgaagatgtgcttgaatcaaatgttgcggaaattatgagagaatgatggaggcaacaagaagagaataatattgacgagacttttcaggatgaagtaggggttcttcttcgagtcttgcctcaagcggtagacaagattgatgctgtaaagaaataggtgaggcggattaactccttctccactgaaacctatgctcgttgccttggcccccctgatgatgaggatcatttcttcaaaaagggacattctctggtagctggttcttcttcaaaccttgctcctacttcccttctaggtgatgatgatgatgatgatgatacagtcggtttggcgaattccttgagaaaactcactgatgcactacttggattagcttctgagcagaacgtcattcctattttgggaatgggtggatgtggcaataccacacttgctaaaaaggctcaagatgatcaatcaattagatcacattttgacatccaaacgtgggttactatatctcaagaatatcacttaaacgaagtgttgccaagccttgcacgtagccttacaggatacgagtttcagggaatgagtgatgaccagttaatggaccagtcatataaagcacttaagggtcggaagtatcttatcgtagttgatgatatttggagtacaaagatttgggatttgattgcgagaacccttcctgatgacaataatggaagtcgaatcattctgactacgaggctaaaagatgtggctgagtatgctaaccctgatatccctcctcttgaagtgctgccgttaggggtagatgagagttggaagttacttcagaataagttgttggggaaaagccacattaattgtcattctgaattagaagatatcgggaagaaaatagtacaaaaatgccagggactgcctctagcaattttggtggttgctgggcatctctctaggatttccccaaaaagggaaaactgggtaactgtatctgaaaatgtgaatgaagttgttacaagttatccgaatgaatgcatagcagtgcttgcgatcagttaccatcacctgcctattcacctcaaaccttgtttcctccatatgggagcattccctgaggattctgagattgatgcttggcggttaattcgtctgtgggttgcagagggttttctgaagagggataagctgagaagcctggaaaaagtggcagaggattgtttggaagatctggctagcagaaatttaataatggtcaaaagggggaaactcaatggccggatcaaaaatttgccgtatgcatgacttgttggggatgtgagcgcttccggatgtgtttagaactaatcaaattcctaattttcattatgagactcctcgctttagtttgcatacacgcatttcaggggaaaactttaccaagtcagcaaaatttttgcgttgcttgtatcttttcaaggaacctcataaaacaataggaaaaccattggaattcaaagctttgagggtgttggctgccattcctaggtatcatttcatcttcaggcgtcgcatgaccttagattcagctatcttgagattcacatagacaatcattttactgaatcacttgaatatatgcataacctgcaaacctttagttttgttcatcacaatctggagtggcgtggaattttaactttacctaaccatatctggaatatgaagcagctgaggcatctccgtctacatggtagcacttatttgcccaacccatatgtggtagacgagttgggtctgcaacatctgcaggagctttccagtctctgtcttgctagctgtacaaaagaggtatttcttggccttcctcatctaaagaaattacgtatctatgatatcggggaaaaatacaaagcattagaggaaacatgttggagcctgctctacttgaataaactccgagtattagagtgttcctttgatgaagggaactctctctggctaaatgttgtttcccaatatcgctaaagagattgaccctatctggaagttggcttccctgggaagacatggcaaatcttgccaagttaccaaatctccaactactcaaacttagatgtcatgcattcagaggtgaggtatggaaattaaaggaggaagatgagttcaagcagctaaagttccttctacttgatgacacagagacacaactctgggaggctaccaatgttaactttccaaatcttcaacgcctcgtattggagaaaatcaagattcttaggcgaattcctatagcctttgcagatacatacaccttggagtcaattgagttgtataaatgcggtctaattgtggattcagccagagaaattcaggaggaagtagctgccatggcgggaagtgattgtcttgctcttcgcatatatatatatgaaggtaacgactttcagaattaa

SEQ ID NO: 14 - DNA, 1207 bp, Nicotiana tabacum
atggcgagaacacacgcttcctcatcaattgataagcagcccgagcccccagcagcagctcccacgaggggcagagggcgaggccgaggtaggggcagagctcagcctagagcagcagcaccagcggcggagcctcaggttgagtttgatgatgaggttacgacccaggaagttccggtgggcctagctcatgtctcagaggggttcattgctaccccagtactccaagatgctctggtccgtctagtgggccttatggagagtgtcacccgggcatacttgcttcatcgtagcaccaaccatctctcaagctggaggaggagcccaaactcctactactcgcacttcggagcagatggctccccagtttcagactctaacaactcagccagttggagcagttcagccggatgtggtagctcagaccggtgatagagcagctatgtctgtcgatgccttgtggagattggacaggttcaccaagctcttcactaccacttttagcggtgcatctttggaggatccccaggattatttggacagatgtcatgaggttctcaggaacatggggatattggagaccaatgggatcgactttgctactttttgcttatctggattcgccaagacttggtggagggattattgtttggccagaccagttgggtcaccagctttggcttgggatcagttttctcacctttttttggagaagtttcttcccgtcactcagagagagatctatcgaagacagttgaatgtttccaacagggttctatgactattactcagtacgagaccaggtttattgatttggcccgtcatgatctacttatactccccattgagagagagagtgaggaggttcattgagggactcattcagcctattcgacttcagatggatgaggagacagggagtgagatttctttccaggaggtagccaatgtggctaggagagttgagatggttctatcgcagagaggtggtcaggagtctgataagaggcctcgtcattcaggcagattcagtggcgcctcatctggaggaaaggatttgtatggtagaggccaaccttctaggctttttcattcagcacttcaggtttctcacggtgcttcaggtggctgtggtcctcatatgcaatattctgatcagcagtcctacagtgcaccaccaactcctatcagtgcaccgtcgctttag

SEQ ID NO: 15 - DNA, 1335 bp, Nicotiana tabacum
ctagcaacgacgaggacactgcctccacatatgtccaaactctccacactcaaaacaactcccaggtgctggagaaggggactgaagggaacccctcgcaccggagtgaccagctgatgcactcggcatagaagaaccctgagctgacggggcacgagatgaactctgggctggaagggcactaagtgatgactggccctgctgagatccatgataaccatgacccgaagatgccccacgataacctgggcgggctgactgagcaggcctgaaagaacgacctctaccatgctgaaactggcccctcgaaggagcaccactataactgccccctcgaggcctcttggcctccctctcctctcgatcctgacggcgaaccgtctcaatctcgcgagcgatatcaaccacctcctcgaacgtagcacccaacaccctctctcgggtcataagaatacggagatgatagttaaggccatcaacaaatctcctgatcctctcacgatctgtcggaaccatccaaatggcatgacgagccaactcagaaaacctcgactcatactgtgacacagtcatatccccctgtcgcaaccactcaaactgtctacgcagctcctctctgcgggactgcggtacatacttctccaagaagagagtggagaactgctgccaagtaaggggcgctgctccaaccggcctacgcctctcatacgcctcccaccaagtgaaggcagccccagtaaactgaaaggtggtaaatgccacaccactagactcaagaatccctgctgtacggagcatccgctgacacttatccaagaaaaccctgggcatcctcgccctcagcaccactgaatgacggaggctggagtctaccaaacctctcaagagacgctgctcatcatccggcataactggcacaacaaactcctgagctggtgcaaccggctgggctggaggtgcccccggcgtctgaagtccctgcactacctgctcaggtgtgcgagcagcgggggtctgattgcctccggcctgtgaagtagctgctgctgtagtggctgaaactgcctgagccaggccagtgcaaactgataagatctgtgccaaggcctcctgaagacccggaatcacgatgggcacagctggtgcctgaactggtgctgctggagcatccatagctggagcctgatccggagctagggcagctggtggatctacaggtgctgccctcgctgctctgcctctgccacgaccacgaccgcgtccacggcctctggtggtctcagctggtggcactggtggtcgtccacctcgtccggtagctcgcgtcctcaccat

SEQ ID NO: 16 - DNA, 4422 bp, Nicotiana tabacum
atggggatagttgagaccaatggggtcgattttgccacttttcgcttgtctggatccgccaagacttggtggagggatttctgtttggctagaccagccggatcaccagctttgacttgggagcagtttactcagctatttctggagaagtttctccccatcactcagagagaggcctatcggaggcagtttgagcgtctccagcagggttctatgactgttacccagtatgagaccagattcatcgacttggctcgtcatgctcttcatacttcccaccgagagagagagggtgaggaggttcattgatggacttattcagccgattcgtcttcagatggctagggagactgggagtgagattactttccaggaggcggccaatgtggccaggagagtggagatggttctgtcgcagggaggtggtcatgggtcgacaagaggccccgtcattcaggcagattcagtggtacctcgtctggaggtagggattcatatggtagaggccatcctcctaggccttttcagtcagcacttcaggtttctcacggtgcttcaggtggccgtggttctcagatgcagtattctgatcagcagtcctacagtgcaccaccagctcctatcagtgcaccgccgctccagagttttcggggtggtcattcaggtcgcagggtcagtcagtttcctcagcagcactcaggtggatgttttgagtgtggtgatatggtcatatccctctcagcagcagggttcccgtgctatggttcaggcaccaggtgttccacagccgcccagccagctagaggtgggggtagagaggtgctagaggtggagcttagaggtggaggccagccagctgcaggccatcccagagatgtagttcagggtggtgggcccagccccgatgttatgctcttccagccaggcctgaggctgaggcttccgatgcagttatcacaggtactgttctggtttgtgatagagatgcttcagttttatttgatccagggtctacgtactcctatgtgtcatcttattttgcaccgtatctggtcatgcctagtgattctttgagtgcctgtatgtgtctacaccggtgggtgattctattgtggtagatcgagtccatcgttcttgtatagttgtgattgggggtcttgagactcgtgtagatttgcttcttttggacatggttgattttgatgtcatattagggatggactggttatcaccttaccacgctatcttggactgtcatgccaagactgtgaccttagccttaccgggtttacctcgtttagagtggagagggactcctggtcattctacccgtagtgttatctcttatgtgaaggctcggcgtatggtcgagaaggggtgtttggcctatttggcatatgttcgtgattctagtgctgaggttccttctattgattctgtgcccgttgttcgtgagtttcctgaggtattcccttcagacctgccgggtatgccacccgacagggatattgacttttgcattgatttggctccgggcactcagcccatttctatccccgtatcgtatggccccgcctgagttgaaagagttgaaggagcagttgcaagacttgcttgagaagggtttcattagaccgagtgtttcgccttggggtgcgccggtgttgtttgttaagaagaaggacggatcgatgagaatgtgtattgattaccggcagttgaacaaggttacaatcaagaataagtatccattgccgaggattgatgatttgtttgatcagcttcagggtgccaaggtattttcgaagattgacttgagatctggctaccatcagttgaggattagggcatccgatgtccctaagacagctttccgcactcggtacgggcattatgagttcttggtgatgtcattcgggttgacaaatgccccagcagcttttatggatttgatgaaccgagtgttcaggccttatttggattcgttcgtgatagtcttcattgatgatattttgatatattcccgcagccgggaggagcacgagcagcatcttagagtggttcttcagaccttgagggatagtcagttatatgctaagttctcgaagtgtgagttctggttgagttcagttgcattcctgggtcatgttgtatcagcagagggtattcaggttgatccgaagaagattgaggcagtcaagaactggcctagaccagcatcagctacagagattcggagtttcttgggattggcaggctactatcgtcggttcgtggaggggttttcatctatcgcagccccgatgaccaggttgacccagaagggtgcccagttcagatggtcggacgagtgtgaggcgagctttcagaagctcaagacagctctgactacggcaccggtgttggttttgcccacaggttcagggccttatacagtttattgtgatgcatctcgtattggacttggtgcagtgttgatgcaggatggcaaggtcattgcctatgcttcgcggcagttgaagattcatgagaagaactatccggttcatgatttggagttggcagccattgttcacgcattgaagatttggaggcattatctgtatggcgtggcatgtgaggtgttcacggatcacaagagtcttcagtatttgttcaagcaaaaggagttgaatttgaggcagaggaggtggttggagttgttgaaagactatgatatcaccatcttatatcatccgggaaaggccaatgtggtggccgatgctttgagtaggaagtcagccagtatgggcagtcttgcttatattccggtcggtgagagaccgcttgctttggatgttcaggctttggccaatcagttcgtgaggttggatgtttctgagcccagtcgtgtgttagcttgcacggtcgctcgttcttctttattggagcgtatccgtgatcggcagtatgatgatccccatttgtgtgtccttagagacacggtgcagcacggaggtgccaagcaggttaccttaggtgatgatggagttttgagattgcagggtcgagtttgtgtgcctaatgtggatgggcttcgagagttgattttagaggaggcccatagctcccggtactctattcatccgggcgccgcgaagatgtatcaggatttgcggcagcattattggtggcggagaatgaagaaggatatcgttgcatatgtggctcggtgtttgaattgtcagcaggttaagtacgagcatcagaggcctggtggttcatttcagaggattgagcttcccgagtggaagtgggagcggatcactatggatttcgttgttggactcccgcagactcggaggaagttcgatgcagtgtgggtcattgttgataggctgaccaagtcagcgcatttcattcctgtggcagtctcctattcttccgagaggttagctgagatctatatccgggagattgttcgtcttcatggtgtgcccgtgtctatcatttcggaccgaggtacgcagtttacctcatttctggagagcagttcagcgagagttgggcaccggttgagttgagcacaatttcatcctcagacggacgggcagtccgagcggactattcagattttggaggatatgctccgagcttgtgtcattgactttggaggctcgtgggatcagtttttgcctttagcagagtttgcctacaacaacagctaccagtcgagtatccagatggctccttatgaggctttatatggtaggcggtgtcggtctccggttggatggtttgagccgggagaggctcggttgttgggtacggatctggttcaggatgccttggacaaggtcaggattattcaggataggcttcgtacagctcagtccaggcaaaagagttatgccgaccgcaaggttcgtgatttggcattcatggtcggtgagcgggtattgcttcgagtgtcgcctatgaagggcgtgatgagatttgggaagaagggcaagcttagccctaggttcattggcccgtttgagattcttgatcgagtgggagaggtggcttatagacttgcattgccgccgagcttatcagccgtgcatccagtgtttcatgtgtccatgcttcggaaatatcacggcgatccatcccacgtgttagatttcagcactgtccagttggacaaggacttgtcttatgaggaggagccggtagctattctagaccggcaggttcgtcagttgagatcgaagagttttccttctgttcgtgttcagtggagaggtcagcctcctgaggcatcgacctgggagtccgagtccgatatgcggagccgttatccccatcttttcctcaggtacttcagtccgttcgaggacgaacggttgttttagaggtggagaatgtgatgacccaaaaggtcatcacttgttttaa

SEQ ID NO: 17 - DNA, 2586 bp, Nicotiana tabacum
atggtgaagacttctaaaatggctccccaaaaagtcacttcttcttctcaaccgaccaccaaaattgatgaaaccactcctgatgtggtcgacctggagaggtacgctgctgatgtggttaccgatgaaccggctatcgaacctcccttaaaaatgttcattcccgagggttgtttggtcgccgacgactttaaggttgagaatccctcttcggtgtagggtcagcatgaggaggcatcgagatatatatgctcgatcaccgaagatgtcctccttgaagtccgaaatgactgcaactgggcagataaggacatagtggtccccgaccctgaggaggccattactacccatatcgagggatatctaagtatttacacttatcccttcacactaggcccggtggacccgaccattatagacttctgttagaggtacaaagtatgtctcagtcaaatccacccatcgctgaggaggattgcaatcttcattcgattcatcgtgaacaagatcgactcctatcagctcacggttgatcatctactccgcttgtacagttcccgaatcttctgagggggctaataaagctcgtgcaccgaactaacaaagcatcattctcaagcatcgatgaggactggtattgaggctggcatgggagctttgctgggtaaggacctcagacttgatccctaccaaatttaggccattccccgagaggtggaatgcatcacgtaagcacgactttcctttaaatgttgatttatgttcatctcttttttcctcattggtatttgtggtggtacaattgttgctcgagtccccaacactatccctcggctcaagaagtggattgaggatatcatctcacagatgccttactccgagcgctcgtggcgcaaactctcgaagggccgttggtaggctcgttcccatggtaagatttatttcccaaataagttacattaggcttctccttctagcatcacgttctcattttcttgattcctctactttagggcagctcggggctgcatcaggagagaagaagaagaagaagaaaagaaaggctttgggttccccgagctcagagaagaaaaaaccgaagagaagattggcctataagccaaaggatagctccagctctcgagcaccagactcagacttgctctactggctcagggaagagcatgaggaggatgatctttttacggcctacgaaccgacctcccccaaagagcgggcgatagccgaggaggagacaacaaaggcctgtctttctcaggttcgggagaccgatgtagaaacgagggctcagccttctcgagacgctggctctgctccacccagcatcaaagaaatttctgggtcaccttctttcaccgaatctatgttggacaaagctcgagcggagaaggagagatataacgaaggggcctatggtgtggacgacccccttcgttgcctttttgaaggtgtggactcaaccgccctaaaagacttctccggttgggttatttggagctgccgagactatctttggaggtcagcgggctgaactcgagcccaaaattaaacaatcgattccctgccccgagcatggatctcgacaaaaagcagtcaataatcatcactgtcctggtagatgccttggttcttttcgcccccgttggagtagctagataccttcggtgcctagtaaccaataaagagtaggaaaagtgaatgaggtggacacaccgtgcttgttcaacaaagcatagcaggcgctgaaccaggtaatgcatcattaccctctttcatcttcgtattttagtctttgatatctatgatgccttttttttatatttttgcaggctttggtacttcatcataaaaattttctctggtaccagcctgaggttaaccagctcgaggctgaggtcaaggagcttgctgagaagagggacacatataagtttctcagcgagaaacataaggaagcggtcaagagtctttgaacaaagtcggacgcgggtcagaaggagcatgctgacctccgagtcagatgaacgaggccaagtccatggctgaaaggtggaaagaaaaaatggatcgattggcttcggagaaagagactgcccgggagcaactgacatcggtgtaggtccaactccgagtggcaaaagagaaggaaaatgcatgtgctcgacaaatcgatgacctccatgctcaactaggctcagctgctgctaaacgggatacctttaggaaggagctcgaatcagtgaagtctgtgtcagaaataactaggggtgatgctgaagagatggtggcccagtacagggccgatgtcgaggtagcccaggacctccttaaagttactattgagtacgtaagtggttgtcctgaagggagactctcgaggaggtccatgtccagggtttctacctgttagccgagattgaagatgcaaaaaggctcgaggccgaggccaagaagctggctgaccccaaggatggggagggctatgagggctccggtgaccccgaggatggagaagaccctgacaaccctactaacgaggtgggttctggtgaagatcgggcttag

SEQ ID NO: 18 - DNA, 3476 bp, Nicotiana tabacum
atggcgagaacacgcgcttcctcatctaccgctcagcagcccgagcccccagcagcagctcccactaggggcagagggcgaggccgtgctagaggccgaggtaggggcagagttcagccccgagcagcagcaccagtggcggagcctcaggttgattttgaggaggaggttccggccccagcagttccggtgggcccagctcaggtcccagaggggtttattgctaccccagttcttcaggacgctctggtccgattggtgggcctcatggagagtgtcacccgagcaggtttgcttcctgtagcaccagccacttctcaggctggaggaggggctcagactcctgctacacgcactccggagcaggtagctcctcagattcagactccagcggttcagccagttggagcagttcagccgggtgtagtagctcagaccggtgatggagcggctatgtctgccgatgctttgtggaggctggataggttcaccaagctcttcactactactttcagcggtgcttcttctgaggatccccaggattttctatatagctgcacgaggttctcaggaacatgggtattgttgagaccaatggggtcgattttgctacatttcgcttgtctggatccgccaagacttggtggagggattattgcttagctaggccagccgggtcgccatctttgacttgggagcagtttacagtattgtttctggagaagtttctccccgttactcagagagaggcctatcggaggcagtttgagcgcctccagcagggttccatgacggtcacccagtatgagaccaggttcatcgacttagctcgccatgctcttgtcatacttcctaccgagagagagagggtgaggaggtttatcgacggtcttattcagccgattcgtcttcagatggccaaggaggccgggagtgagatcacttttcaggaggcggccaatgtggcccgcagagttgagatggttctgtcgtagggaggtggtcaggggtcggataagaggccccgtcattcaggcagattcagtggtacctcgtctggaggtagagattcatatggtagaggccatcctcctaggccctttcagtcagctcttcaggttttcacggtgcttcaggtggtcgtggtcctccgattcagtattctgatcagcagtccttcagtgcaccaccagcacctatcagtgcaccgccgcttcagagttttcagggtcgtcagccccagcagccgagggcttgttttacttgtggcgacacgaggcacattgctaggtattgccctcgagcttcgagcagttctccgcatcagggttcccgtgctatggttcaggcaccagatgttccacagcccgcccagccagctagagctagaggtggaggtagaggtcctagaggtggagctcaggccgccagaggtggaggccagccagcagcaggccgtcccagagaggtagttcagggtggtggggcccagccccgatgttatgctctcccagccaggcccgaggctgaggcttcagatgcagttattacaggtacggttctggtttgtgatagagatgcttcagtgttatttgatccagggtctacatactcgtatgtgtcatcttattttgcaccgtatctggtcatgcctagtgattcgttgagtattcctgtttatgtgtctacaccggtgggtgattctattgtggtagatcgagtccatcgctcttgtgtagttgtgattgggggtcttgagactcgtgtggatttgttgcttctagacatggtcgatttcgatgtcatattggggatggactggttatcaccttaccacgctatcttggactgtcatgccaagactgtgaccttagctttaccgggtatgcctcgtttagagtggagagggactcctggtcattctacccgtagcgttatttcttatgtgaaggctcggcgtatggtcgagaaggggtgcttggcctatttagcttatgttcgtgattctagtgcggaggtttcctctattgattctgtgcccgtggttcgtgagtttcctgaggtattcccttcagacctgccgggtatgccgcccgacagggatattgacttttgcattgatttggctccgggcactcagcccatttctattccgccgtatcgcatggccccgcctgagttgaaagagttgaaggagcagttgcaggacttgcttgagaagggtttcattagacccagtgtttcgccttggggtgcgccggtgttgtttgttaagaaaaaggatggttcgatgagaatgtgcattgattaccggcagttgaacaaggtcaccatcaagaataagtatccactgccgaggattgatgatttgttcgatcagcttcagggtgccaaggtattttcaaagattgacttgagatctggctaccatcagttgaggattagggcatccgatgtccctaagacagctttccgcactcggtacgggcattatgagttcttggttatgtcatttgggttgacaaatgccccagcagcttttatggatttgatgaaccgagtgttcaggccttatttggactcgttcgtgatagtcttcattgatgatattttgatatattcccgcagccaggaggagcacgagcagcatctcagagtggttcttcagactctgaaggatagtcagttatatgctaagttctcgaagtgtgagttctggttgagttcagttgcattcctgggtcatgttgtatcagcagagggtattcaggttgatccgaagaagattgaggcagtcaagaactggcctagaccagcatcagctacagagattcggagtttcttgggattggcaggctactatcgtcggttcgtggaggggttctcatctattgcagccccgatgaccaggttgacccagaagggtgcccagttcagatggtcggacgagtgtgaggcgagctttcagaagctcaagacagctctgactacggcaccggtgttggttttgcccacaggttcagggccttacacagtttattgtgatgcttccgtattgggcttggtgcagtgttgatgcaggatggcaaggtcattgcctatgcttcgaggcagttgaagattcatgagaagaactatccggtcatgatttagagttggcagccattgttcacgcattgaagatttggaggcattatctgtatggcgtggcatgtgaggtgttcactgatcacaagagtcttcagtatttgttcaagcaaaaggagttgaatttgaggcagaggaggtggttggagttgttgaaggattatgatatcactatcttatatcacccgggaaaggccaatgtggtggccgatgcttgagtagaaagtcagccagtatgggcagtcttgcttatattccggtcggtgagaggccgcttgcttggatgttcaggctttggccaatcgatttgtgaggttggatatttctga

SEQ ID NO: 19 - DNA, 4967 bp, Nicotiana tabacum
atggcgagaacacgcgcttcctcatctaccgctcagcagcccgagcccccagcagcagctcccactaggggcagaggccgaggccgtgctagaggccgaggtaggggcagagttcagccccgagcagcagcaccagtggcggagcctcaggttgattttgaggaggaggttccggccccagcagttccggtgggcccagctcaggtcccagaggggtttattgctaccccagttcttcaggacgctctggtccgattggtgggcctcatggagagtgtcacccgagcaggtttgcttcctgtagcaccagccacttctcaggctggaggaggggctcagactcctgctacacgcactccggagcaggtagctcctcagattcagactccagcggttcagccagttggagcagttcagccgggtgtagtagctcagaccggtgatggagcggctatgtctgccgatgctttgtggaggctggataggttcaccaagctcttcactactactttcagcggtgcttcttctgaggatccccaggattttctatatagctgtcacgaggttctcaggaacatgggtattgttgagaccaatggggtcgattttgctacattccgcttgtctggatccgccaagacttggtggagggattattgcttagctaggccagcgggtcgccatctttgacttgggagcagtttacagtattgtttctggagaagtttctccccgttactcagagagaggcctatcggaggcagtttgagcgcctccagcagggttccatgacggtcacccagtatgagaccaggttcatcgacttagctcgccatgctcttgtcatacttcctaccgagagagagagggtgaggaggtttatcgacggtcttattcagccgattcgtcttcagatggccaaggaggccgggagtgagatcacttttcaggaggcggccaatgtggcccgcagagttgagatggttctgtcgcagggaggtggtcaggggtcggataagaggccccgtcattcaggcagattcagtggtacctcgtctggaggtagagattcatatggtagaggccatcctcctaggccctttcagtcagctcttcaggcttttcacggtgcttcaggtggccgtggtcctccgattcagtattctgatcagcagtccttcagtgcaccaccagcacctatcagtgcaccgccgcttcagagttttcagggtcgtcagccccagcagccgagggcttgttttacttgtggcgacacgaggcacattgctaggtattgccctcgagcttcgagcagttctccgcatcagggttcccgtgctatggttcaggcaccagatgttccacagcccgcccagccagctagaggtgggggtagaggtgctagaggtggaggtagaggtcctagaggtggagctcaggccgccagaggtggaggccagccagcagcaggccgtcccagagaggtagttcagggtggtggggcccagccccgatgttatgctctcccagccaggcccgaggctgaggcttcagatgcagttattacaggtacggttctggtttgtgatagagatgcttcagtgttatttgatccagggtctacatactcgtatgtgtcatcttattttgcaccgtatctggtcatgcctagtgattcgttgagtattcctgtttatgtgtctacaccggtgggtgattctattgtggtagatcgagtccatcgctcttgtgtagttgtgattgggggtcttgagactcgtgtggatttgttgcttctagacatggtcgatttcgatgtcatattggggatggactggttatcaccttaccacgctatcttggactgtcatgccaagactgtgaccttagctttaccgggtatgcctcgtttagagtggagagggactcctggtcattctacccgtagcgtgtgtaggtgcttggcctatttagcttatgttcgtgattctagtgcggaggtttcctctattgattctgtgcccgtggttcgtgagtttcctgaggtattcccttcagacctgccgggtatgccgcccgacagggatattgacttttgcattgatttggctccgggcactcagcccatttctattccgccgtatcgcatggccccgcctgagttgaaagagttgaaggagcagttgcaggacttgcttgagaagggtttcattagacccagtgtttcgccttggggtgcgccggtgttgtttgttaagaaaaaggatggttcgatgagaatgtgcattgattaccggcagttgaacaaggtcaccatcaagaataagtatccactgccgaggattgatgatttgttcgatcagcttcagggtgccaaggtattttcaaagattgacttgagatctggctaccatcagttgaggattagggcatccgatgtccctaagacagctttccgcactcggtacgggcattatgagttcttggttatgtcattttgggttgacaaatgccccaacagcttttatggatttgatgaaccgagtgttcaggccttatttggactcgttcgtgatagtcttcattgatgatattttgatatattcccgcagccaggaggagcacgagcagcatctcagagtggttcttcagactctgaaggatagtcagttatatgctaagttctcgaagtgtgagttctggttgagttcagttgcatttctgggtcatgttgtatcagcagagggtattcaggttgatccgaagaagattgaggcagtcaagaactggcctagaccagcatcagctacagagattcggagtttcttgggattggcaggctactatcgtcggttcgtggaggggttctcatctattgcagccccgatgaccaggttgacccagaagggtgcccagttcagatggtcggacgagtgtgaggcgagctttcagaagctcaagacagctctgactacggcaccggtgttggttttgcccacaggttcagggccttacacagtttattgtgatgcttctcgtattgggcttggtgcagtgttgatgcaggatggcaaggtcattgcctatgcttcgaggcagttgaagattcatgagaagaactatccggtcatgatttagagttggcagccattgttcacgcattgaagatttggaggcattatctgtatggcgtggcatgtgaggtgttcactgatcacaagagtcttcagtatttgttcaagcaaaaggagttgaatttgaggcagaggaggtggttggagttgttgaaggattatgatatcactatcttatatcaccgggaaaggccaatgtggtggccgatgcttgagtagaaagtcagccagtatgggcagtcttgcttatattccggtcggtgagaggccgcttgctttggatgttcaggctttggccaatcgatttgtgaggttggatatttctgagcctagtcgagtattagcttgcacggtcgctcgttcttcattattggagcgtatccgtgatcggcagtttgatgatccccatttgtgtgtccttagagacacggtgcagcgtggaggtgccaagcaggttaccttaggtgatgatggagttttgagattgcagggtcgagtttgtgtgcctaatgtggatgggcttcgagagttgattttagaggaggcccatagttcccggtactctattcatccgggcgccgcgaagatgtatcaggatttgcggcagcattattggtggcgtagaatgaagaaggatattgttgcatatgtggctcgatgtttgaattgtcagcaggttaagtatgagcatcagaggcctggtggattgtttcagaggattgagcttcccgagtggaagtgggagcggatcactatggacttcgttactggacttccgctgactcggaagaagttcgacgcagtttgggtcattgttgataggctgaccaagtcagcgcatttcattcctgtggcagtctcctattcatccgagaggttagctgagatctatatccgggagattgttcgccttcatggtgtgcctgtatctatcatttcggaccgaggtacgcagtttacctcgcgtttctggagagcagttcagcgagagttgggcaccaggttgagttgagtacaacatttcatcctcagacggacgggcagtccgagcggactattcagatttggaggatatgctccgagcttgtgtcattgactttggaggttcgtgggatcagtttttgcctttagcagagtttgcctacaacaacagctaccagtcgagtatccagatggctccttatgaggctttgtatggtaggcgatgtcgatctccggttggatggtttgagccgggagaggctcggttgttgggtacggatctggaggccttggacaaggtcaggatcattcaggagaggcttcgtacggctcagtccaggcaaaagagttatgcagaccgcaaagttcgagatgtggcttttatggttggtgagcgggtattgctccgagtgtcgcctatgaagggcgtgatgagattcgggaagaagggcaagcttagccctaggttcattggtccatttgagattcttgatcgagtgggagaggtggcttatagacttgcattgccgcctagcttatcagccgtgcatccagtatttcatgtgtccatgcttcggaagtatcacggcgatccatcccacgtgttagatttcagtactgtccagttggacaaggacttgtcttatgaggaggagccgtggctattctagaccggcaggtcgtcagttgagatcgaagagttttccttcggttcgtgttcagtggagaggtcagcctcctgaggcatcgacctgggagtccgagttcgatatgcggagccgttatcctcatttattccccgactcaggtacttccttcttctgtccgttcgaggacgaacggttgttttag

SEQ ID NO: 20 - DNA, 1593 bp, Nicotiana tabacum
ttagatgagaaaaatgtaaataatccaagcatcgtatctcttgattgcgtctgaattaattggttttggccaaattgctccatcaatttttgcaagtatgggtgctcctcctgtcagcaccctgtgaaccatatacgaaccttgccagttgagggagaatttcccttttgattcatcttaatgtgggaagatcttctgcagcaccaactgacctggtgtaaattgccttagtttgaccctttagttgaaagctctggacattatgttctgataaatttggccttggcacactgcattcatcctctttccatcgatgaaggccaattgttcatagcgacttcttatctattctgcatcgctgagttcagcttcctatatgactctcaaagaagcaatctctacttcggctgggatgacaacttcggtaccgtaaactagcatgtaggaagttgccctggttaatgtgcgaaccatagtgcgatatcccaataaagcaaatggtagcttttcgtgccactatttgtgattctctaccatcttccttagtatcttcttgatgtttttgttggccgcttctacggctctattcatctgaggtttgtaggttgtggaattcttgtgcttgattttgaaagtttcacccatggcttttatcagatcactattgaggttggcggcattattagtaagaatggactcgggaactcctaatcgacaaacaattcgatccttgacaaaatctacgatgactcttttggttacagctttgtaagatgcaacctctacccattttgtgaagtaatcaatggctactagaataaacctgtgttcgtgtgaagcagtgggctaaatcggaccaataacatccattccccaagcggcgaatggctaatgagagcttgttacattgagctcgtttggcggcacttttatcatatcggcatgcacctggtattgaaagcatttgcggacatactggatgcaatccgtttccatggtcatccaaaagtaaccgaccctaagtatcttcttagccaagacgaaaccattcatgtgcaggccacaagtcccggcatgtacatcctcaagtagcttagaagcttcctttgcatcgacacatcttaggaaacccaaatcaggagttctcctgtacaaatttcctccgccgtggaagaagtgattgtaaaatctctggagtgtgcatttctgagtgtggtttgcgtgctcaagatattctccctttgacaaatacttcttgatgtcatggaaccaaggctttccatctatttcttcttcaacatgagcgcaatatgccgactgattatggatcttcactgggatgggatcaatataatttttatatggatgttgtatcatagatgacaaggtggctactgcatcgacaaactcattctgaattctgggcacatgtcgaaattctatcttcatgaacctctttcttaattcctgcacatggtgcagatatggcaatatcttggaattcttggtggcccactctccttgtacctggtgcataagcaaatctgaatcatcgatcactagcaactcttgaatgttcaagtcgatttccat

SEQ ID NO: 21 - DNA, 1508 bp, Nicotiana tabacum
ctagatggacaacttagatgaggcagtcttcatccagttgttgaaatttagaagtgcctggcttagacggtgggtagtaatatgatgggcccagtaagatgggatctccgggcccgctgatgtggatagaccagcaggaatagctgtggatgtggaaggtccgggagagatgtcagcaggagtagaggtaggctcagcagggacctctaccataactggatctttagactggacaattggggcagaagcatgagctttgtagttcttgctcttggggttgttatcccccttcatgctataccaggaaaatggggctatctccttgaccttgatgtcatagggcctctcatccactttcaggtcccggaagtactcagtcaggaagctggggaatggattgtttctatcatgctcggcacccacaatagtaataatcctcgacatcacattccccatattgatggggtaccccaccataatagaagtgaccaatacagcccgatggagaggaaaggcgttgtcatgagtggtagggtccaaccggctgcaaacaaaagtctctcatcccctcgcttcaaagttcaggctctttctcaatattttgattccagcagccaaccagtcagggacggtacgtgggattgccaagtactgtgctagccatggacaaacctcctctcccatttccaaatttgccatgtataaggtctcgtcctctcattgaagctcaggtattcatttatatacttcccatcaaacaacaccttccaattttgaaccttggtcactttggagccctttttgatgtgggctacattgctgtaaaattctttgaccaagtgttcgttggaatcctcacacttatcaaggaaatggtcccagccaactctcatcctaaactgtctcctcatgttggggttgtgaggtagcaagtcactatcaatgaaactccgctccgggatcaactttctcaccggccaccactcctagaatttatggtatgccacttcactaacaaacctatcttgccaaacctcggctttctagttctcacaatcccccccccccccacacttgtggttcacctccttcttctacttcatcgtcaccacctacttcttcctcatctcctacaacaccctcttcagataatgaagctgtgggagtggtagagtattcatccctactacccgctggtgagccctcagacgacctagaagaaatgttcactgatgcttgggctgcggggaaaggggaagagtgtctctatgtctggccctctacggatacgagatgtattctgggattgagtccaaagagatatcccgagatggctcgtactcactccccgaaatgtcaatgtctttgtcagccacttttatggccttccttatgttcttgatgttttgcctagcttggggagtgagtttgaccattttctgtttccctcccagggaggattctcctcggcctggttgtttagagcctttcccttgttgtttcaccat

SEQ ID NO: 22 - DNA, 2919 bp, Nicotiana tabacum
tcattgtgggtacatcttgatcacatcacttgaaatgatgtgagtactttgttttgttagagaatgagtgggaggacagtgcagtacggcagaaacagtgacgccagtcacttcatttctagttgtgtccaattgactctgtacagctatgacgaaaccacaagagcatcaggtccttgtgtgggtttctagctcctgaagctgtagcagttcacctttagctggaatacgttaaagcttgcagcaatccaagtaggtcaggttccctatctagttcttaacagtaagtttgttagattatcaaaacataaggcaagagtatttaaaatatatcaatttcccctttttgatgatgacaaacttaacatttataaactggaattagggcagtaccagttttaaagtatcagggaacacagagagttccccctaagactatgccttatcttttacatgatcagagtagtaagaactagttcctccatgtgtgttccccctgattattatttttttccttcttttggcatcattaaaaaaataacagcacaaagaagtccagtgaagctaactcatgccacatatgtgcacacaatcatgatagagaatagaacacatagagtactgacataataaaactagaattaatattaataacgatttaatatacctctgcctatgaaaaaggctagaggcaacatttggacttgctaacgggagtagtaatgtttcctcccaaccatcaaaaaaagaaaacaaaaaaacatccgccaaaccatcaacaatgaaacaaaaacataagaaacatatccagaaaactggtcactaaaggggtactttagggcactaggagtaaaaggattggtagcagcagaaaatgcctggagaacgaggtctattaaggtgtttgccgacttttgctcgttgagcagttccgccttcaagttctcaacttgcgccctgagattagcattctcctgtgtcaaacaagccacttcatcattcgacatgggaaccccttgggcttgctgatcttccaggataacattcatggccttcaaccgatgaatttcctcagctgcactgttttggacgttgataagctgagaaacggttgatgtatttcctactcctcccccccaatacttttccacacactcacactcttccaaagttgtctatgagaatgtccgctttcgagaccccactttacctattcccagtggaactttaaagaatttgaacactggagtaagaaagaatccatagggaagtccatgattaccgtccttgaaggtggaaaccttttgcatgtgttcgatcataatagcaggaagaatcataggattgaaaccgtcaagttgctccattaggaataggtcagacttagaagtcactaacctcctttcggctcgaggcaacatgactttgttaaccaatttaaataacaactggtaaacagggagtagtgctttcttatggatctagtcccctttctgattagcattttctttcaccattgcatttctgaagttatactgacaaacatctcgtacactcaacaccctaactgtaggaacttttaaaatctctccaagcaattttacatcaaacacgatgtccaccccattgaccaaagcatagacatggtcagtatcaactggaaagaggctagcaaagaaactttgtacctcctcctcatacaccttaggtgcatccatgtgaaatagatgcacccaacgttgaaactcgaccatttccagaatttggcgcattccagccatatcagagattgttgggtcaaacatacgacccaatagaactttttgatgcctcaaaagctcagagccaaggctgacttcacttctcattttcttcatagaactaggttcgtcaaaagattccgacttgcgtttcccaaacttctctccactgactttgccttttgccttagacttaactagtacatcctcatcagacatagaaaactcactcactacctccttctttttggacttagatgttgaccctttctctattgacacaggctttgtctttttcaaagatcgcctaacaagtgaaccgggttcctctggagttccctcttccacctcgactacaaggatagcctcatcacttacaggtacaccatccttcaccaacttttttctttttttttcttactactcttcttgctcgtttggagagtagagtcgtaggccactttgacttgaagcgtggtagtaggtcgtttgatttcagactcaagggtggacgcaacccttcgcttacttatgaatgcatcaagagccacattatccaggtcttattcatcactagatcgtatttcaggtgcttgaattcccaggggcacaacatcaaatgcaggaatagtactgtcctagggatgagagccctaacctgggtcctccggagagggatcaggttcctcatgtgatgccccagtagtatctgctattgcatacccttcaatagccacaatggccccttattcctccacatcgtgtatctcatttttttgggatgtaatttcatgcaataccccatcagtggatactacaaacatagttacaacatctttcttttcttcaaccggtgcttccaaaaccatgaaatcggtggcaacgatttcagaacccttgtgaactcagtattttgaccttgttctccacttagggtttgattggtgggaacaacagacgatggggagaacaaaatagtagttttaaaggtttctgagttgggaagatattgggaaattggggaaggtgtgactgcagcagcaagagtggtagagggtgaggaaggctcagtcaaaatgaaaggttccatatatgggtcagtggtgtagaacctgctcatctccatagaggcaaagagatcggaagttttttcagccat

SEQ ID NO: 23 - DNA, 2397 bp, Nicotiana tabacum
ctaaggaacacacaaatggggatcatcatactgccgattacggatacgctccaataaagaagaacaagcggctgtgcaagctagcacatggctgggctcagagacatccaacctcatgaattgattggccaaatcccgaacatccaaagcaagcggtctctcaccgcccggaatataagcaagattgcccatactggatgacttcctactcaatgcatcggccaccacattggcctttcccggatgatataagatagtgatatcataatctttcaacaactctaaccacctcctctgtctcaaattcaactcctgttgcttgaacaaatactgaagactcttgtgatccgtgaacacctcacatgccacgccatacagataatgtctccaaattttcaatgcgtaaacaatggctgccaactccaaatcatggaccgggtagttcttctcatgaatcttcaactgccgcaaagcataagcaatgaccttgccatcctgcatcaacactgcaccaagttcaatacgatatgcatcacaatagactgtataaggccctgaatctgtgggcaaaattaacactggtgtcgtattcagagctgtcttgggcttctgaaagctcgcctcacactcgtccaaccatctgaattgggcacccttctaggttaatctagtcattggggctgcgatagatgaaaacccctccacgaaccgacgatattagcctaccaatcccaagaaactctgaatctgtgtagctgatgctggtctaggccagaaatgcaactaaactcaaccagaactcacacttcgagaacttagcatataaccggttatccctcaaggtctgatgaaccactctaagatgctactcgtggtcctcccagctacaagaatatatcaaaatatcatcaatgaagactatcacaaacgagtccaaataaggcctaaacacgcggttcatcaaatccataaaagctgttggggcattgatcaacccaaatgacatgaccaagaactcataatgcccataccgagtgtggaaagctgtcttagggacatcggatgccctaatcctgaactgatgatagccagatctcaaatcaatctttgagaacaccttggcaccctgaagctgataaaacaaatcatcgatcctcggcaatggatacttattcttgattgtaaccttgttcaactgccggtaatcaatatacattctcattaatccgtccttcttcttaacaaacaacaccggcgcaccccaaggtgaaacaagggtctaatgaaacccttctcaagtaggtgttgcaacttatccttcaactctttcaactcagacggagccatacgatacggcggaatagaaacgggctgagtgcccagatccaaatcaatgcaaatgtcaatatccctatcgggtgtcatacctggcaggtctgaagtgaaaacctcaggaaactcatgaacaacgggtacagaatcaatagagggaacctcggcactagaatcacgaacatatgccaaataggacaaataccccttctcgaccatacgccaagccttcacataagagataaacctacgggtagaatgactaggagtacctctccactctaaacgaggtaaacccgataaggctaaggtcacagtcttggcatgatagtctaagatagcgtggtaaggtgataaccagtccatccccaatataacatagaaatcgaccatgtccagaagcaacagatctacacgagtctcaagaccctcaatcacaactataaaagagcgatggactcgatctaccataatagaatcacccaccggtgtagacacatatacaggaacactcaatgaatcactaggcatgtccagatacggtgcaaaataagatgacacatacgagtacgtagaccctggatcaaataacactaaagcatctctatcacaaacaagaaccgtacctgtaataactacatctaaagcctcagcctcgggcttggctggaagagcataacatcagggatgggccccaccaccctggactacatttctgggacggcctgtagctggctggcctccacctctagcggtctgagctccacctctaaatcctctacctccacatctagaacctctagctggctgggtggtctgtggaaaacctggtgccccaaccatagcgcggaaaccctgctgctgcgactgagtacccactaacctcggacaagtcctcctaatataaccatactcaccacactcaaaacatccacctaagtgttgtggctgaggaaactgagactgaccctggcgacctgaataaccaccccgaaaactctggagcagcagtgcactgataggagctggtggtgcactgtaggactgctgatcagaatattgcat

SEQ ID NO: 24 - DNA, 895 bp, Nicotiana tabacum
atggttaagtttgggaagagaaccatcttgaaaggtaggctcctcaggaacttagaggaggaaggaatggtaatgcttctggagaagttacaggtgcaaggatggaaggacatggtctttcagatgatggaaggttggccataactgatattgtgcagtttatggcaaattgtgagatcaagatggtagggtcaccagtgtggtaaagggtgatggtgacttttgatgagaaagagctgagagagatcttggggtgcattctaaaggatacaatgactataagaagctcaaatggacaagcctagagaatctccctactgcccttgccagtactagaaaattttgtgacaatgaggaggaaattgagcccaaggctatttacaaaaatgagatgaagccacccaacaaagtgttgctccaatttgtaaacaaatgtgtgctgccaaggtaggaaaggaggcacatttccacattcatggacctggtccttatggaatgtttggacaataggcggcaaataaattggcctgggtctaaaattcagcttcttgacagggttctaaatggaactaagacttatgtcataccctatggttttattctcacgattgttcttgcacatttaaaggtacccatcaagaaatgggaagttggtacaaacaaggatcattttggggctaacactttgactgcttgtaactatgaggctcaaatcactcccaaaaaacctggttcatccaaaaaggtaccagtgaatagcaaagtgcgagttttggtgcaagaaagtagggcaaaggatgctgagcctgataggctaaagaagaggttggctgaaatggagaccgagagagatgctctcagagctgagcttgcaaaagagaatgagaagaattag

SEQ ID NO: 25 - DNA, 4787 bp, Nicotiana tabacum
tcaccggggaaacactggtctggggaatattccaaaggacacccttgcttccaaggaaagggacgccgagacttcgcctcggcctcgtattgatgtgttggtaaccctctcactcatttgacctattccaaataaaacatgtgttcatgaatacaggttgttcaattaattataccaacgatgtcaaaccaaagccaatggggcgattcggactaacgaaccaagtcactcccacatctcgaatctttgacagattctaggcaccgatcgccacatcaggaagaccactcccttaatacaacccgtatcagctcggactggaatgccgaacacgcaaggcacgtacgtcttattcagatgacaacgggcacgcctccccggaggcaacttcgaccctactccaccaaatggatgaaaccccaggacaagggtgggactaaagtattcgacaaggagctgcacacgacgagaggaaaaccctcaccatgtaacgcatcgccggcatcaatacgtccgccctcaaaaggatcaaagggtaagcagaatcgcatcttctgctaagcttggttgaacacagcagaaggctgtattagggctcgtgcctcggaacagcagaaacatcccgaacctcgaaaggttacctacgcaccccgcggtgaggaggaactacttcactccttcattattttttcactaacttatatgcaggcaatcagccggggcattcgaaagttctaactccacacggagatccaaggccttagcagggcccgttgtgctctattccctcgatcagactttagacccaaagagggtcccgccaaaaagattattagcagagcagtgtacccccaaagagggtcctgccagcaggatacgacaaaatcacatgccttcttctacaatcgaacgacgggcgatgatcttctttcaagggcaccattccctcagaaggaccgaaaatatcagactgagtgtcaagagggaaccttgtaacgaatcagatggtccgaagagtcgtacctacgtgggccgagctcacaacgacgagagaacatgtatttacaacatatatttatgacaagtaataaagaatatcttttcggcatttcgtacttcggaaaaggggatttcaacatactcatggcaagggcctctctaccgaatgcatcccgagatactcggagacttagcatcagcaattcaatacccgcacgaccccagggttagaactccgggctcaacaagcccctacaaggcaactccgagctcatgaggagcggtcttcaagcttaaacaaattatatgactcagagactgccattgatcgtcatatgctggaaaaatcgaaactgtgagacccctagcaggcagcctcaacgtaaccagatctattatatattacacaaactataagaccttaacaggcatgataaactgtaagacctcaacaggcatgacaaactataagacctcaagaggaatgattaactgtaagacctcaacaaacatgaaaatcctgaagtttaggttatacgtcgcatgtgtaaaaatccctaaagggcataccctcggtgtagacacctaaactatcaatcgggattaaaaatggctacggccaaacgcacatgactatgatcaaaacggttaatacagccaaaataacatgactcggggacacccgactgttactaaaatctcaggacactactccaaatatacttcgaaaagaaccggttaaaatagggttcccttaacaggcaaaaacgaaccccgaccatgtcgactccaaaccgccaaagtgttgatctactcaacctacgagctatgaaccttttgaggtgctcaaaacatcgccgacaacgacttgaaatcgaagttcctctagaaccgaagacgggtcaagcaaaaatattccaaaagaccttaacgagcagaaaacaaagcctacaaaaaagcccacaggcaaaaacagcgtaagagccattgtcgccatctaagcaagcctccgggccatatattaaaaggtctctacgaccaaacagcgtaagagccattgtcactagctaaaatttgacaacttgaggattaaaatgagctcaaatcgtaacccggttcagagatcggatccaaaatagttaactatgcaaacctccgagccacatattgaaaggtctcaacgaccgaaatagcgtaagaggcactatcgtcagtctgaaaaccagaggtacttaagggtcaataaaagatcaagtcacaacgcgactcggaggcttgacccggaataattaaactacaatatgcctaagggcacgacataaatgccactatcgccagccgagcaaatctccgggccatgtgccagtaaggtcatttcgacccggagcacaaaaggccatcatcatccgcctatgcaggcaggaaagagcttgagggtcaattgaagctcgagtcacagtacgactcggagactgaatccaaaatagtcgaaacggcaaatgcccaagagcaagaaataaaaataattaatgcctgcccgagcgggcataaaagattcaagggcaaaaggcttgagacgaagcccgactcagagactaagcctaaaacagtcgggccaagcatggaggccccagcaccagctcacgtaagggattacacttaagagcccctaggtctatccgaccagttccggacctacgaggatcccgccaaacaccaaaaccggcctgcccagtcgaaaagcaataacaaaaaagaggtacagaaaaaataaagcttcaagtttcttcctacatattatatgcgcgaaaagggcgcattctccatctacaagcatgctctacatatatcagaaacaaagcgacaaaatggcgaaatctacactccgcactaaagggctacaacttgtcaaattctccctccgcgacgtcagcaagaagttacagagcgtcgcgctcatccacccttgctcgagccaattctttcgagagaacgaagccccgtacactggcctcctcgagtacctctctccgagatctgcaacgaacatactcctcgatcctcttctcccggtcgagggctcgctttagctcagcttgggcatcagcaacatccttcatatgaatcgccatctcctgatcagccttggtccggcttagcgccactttagcctgggcattaattatctcagctctgaccttcaagagatcagattcgagtttcccaatcatgtccgcttgaactttggcgttatcacgagtcaagcagagttgggcctcgatggcagggaccctggctgaggcacatatctcctctaaagctcaagcttgctcttgagcccttagctccccacaaacaactctgacgcggttgacgtcgcctttgaggtactccaaggcctctgcctttttttgcagctgatataacaaaaggggtgagccttaaggttagagaggagcaaagcgcatactatataaagttacctgctctatcaaacaactctcatagtttgagctctgatacgcctcatatcgccaacgtgccaacttagccccattctcttggctaaggagcctaaaggactcgccatcgttcaagaatttctggagcctggccccttgacagagcagcttagacataagcccatcacaggcctatgcaaggaaaactcaataaagggaggagggcgtgacatacaggaaaaaacgcgcctaaactcacctcgaagagaagccgatggacttcctctaagccagaacacattcctgttgatcctgcctctccggccccaggagaaccaacctcgggcagagcatattcactcggaggaatcgccgcccgggaatctgatactccgggaacatcaggctcagacgatgccctctactcaaagatctgagcccgcccaatgccactaaaagctccatcacaccgcgggtgccgatcccccttatcaccatcctccctcggcttggaggctgacgactctttctcctcttcggaagaacactgtctcatcccaaacaaccgccctgtatctacaaacggtgaatccagtacaaatgaaaggggaaaatattacctcgaatatacgaaggccaagtcaaaggcaacatacgcacataccttggtatttcactccccatttggtacgaaatacagctcgccacctgcgctcgtcgcaagtcgaatgggtcgccaacttatggacccagacgggaaggtcaaggactttgcccggcatccacgaagttgctgcaacaaggtagacaacattattactcaactgattttcgctataggcaaaatttaaaaaagcgccagacactccactcacgtgcatgattccacccttcaggaaatggcaaaagccctgttgggataatgtcagcagtttgagcctgaataaaccaactggcccactctcggtccttgtcttcttcatcatcgacaacaaagggcgtggacaaacggcacctcagagttagcaggcctcgataatgaaatggccggtatagtctaacgaggtgattaaacgtgaattcgagcccaaccttctccacgaagaacctcattatcattaccattcgccgaaacgatggataaatctgcgccagagtaactcgatacttcaagcaaaaatcaagcacaaccctagcaggggggccaaatgcgaaagggtataggtatacgctcaaaactccatcagtggagtctgtaatacccttatttggagaaagcacctgcagtgttaccccctcgctccacccgcagtaattcctcaccat

SEQ ID NO: 26 - DNA, 918 bp, Nicotiana tabacum
atgcggaggagtagaagaacaagcaatctcttccctcttgatcctgaaattgaaagatcacttcatagagagaggaaggagttggaagctagatacaaaacagaaagagagttgggcattttagttcaaccacagccaatagtgatggcaggtaatggagggcgttcggtgatagaagctcgaaggccaaatcttgctaatatgactcaggctattgttaagcctgatatcactgattactttgagcttaaacagtacacggtacagctaattcagtccactaggcaatatgtaggtctatctcatgaagacccgcagaggcacattcagaattttttggaaatcacggatacttacaactatccaaatgtttccaaggactatgtcaggctaaccttgtttcctttttcattgttgggggaagctaaagaatggttgcagaaggagcctgctaattcaatccatacttgggatgatttatcaaagaaatttttaatcaagtttttccccactaaaaagacaaagcctttgcggagccagattcttgggtttcaacaacgggatggtgagactcttcgccaagcttgggaaagatacaagaaactactccgagactgtccacatcattgtcaaactgatgaattattgggccatacttttgttgatggattagatgagacttcaaagatgaatcttgattcagcttgtggacgtagttgcatggcgagactatatagtgaaatacaacttttgctaaacaacttcactgttaatgatcataattggcaaggtgagggagaaccaaggagagcaatgaaacagaaagcagcaggggtacttgaacttgatgatttttcagccatgagagcagatatagcaaaattggcaaatcaaatgaatagaatgacaatgaactag

SEQ ID NO: 27 - DNA, 6603 bp, Nicotiana tabacum
tcatctgctcggggaatcatcctcttcctcttgggaggcctctgggactgctctagctgagggtgagatgttggcacagggtcttgtagcaataaatccaaagcgtctttctgccttcatcctatcaaccttaaccctcaactccttcacggactccttggaagcccgcgtctttctcatcttcttggcctccctagcaagctctttgagagcttttccatatgactccacagcgtccgtaagaaatttttgagtgtcaagaatttttttctagttgtccagaatatccttgagggcatcctcatagactgtaggacctgtagaggtggaggtgtcgactgagatgctactgcagtagtgagggcaaacaacttagaggaagctgtctgcatccaactgttgatgctaagaagggtctggcttagacattgtgcagtcactggatgagccgaggtagagggtatctctagagctgctaaaatggatggaccagggtggatgtccattgaggtggaggcaagatgagtaggagccactaccacaactggctcttcagacttgccagttggatcagtggatgttcccttgtagttcttgcctttcgggttgtcatcaccctgtatgttataccatgagaacggggcctttgcttttaccttgatatcaaatggccgcttttcaactttgcggtccctaaagtacatggtcaagaagctagggaagggttagttctatcaccttcactaactacctgtgtaatcacccgagacatcaccttcccgacgttaattgggtaccctaccatgattgatgctaccaatactgcccggtgaagagggagtgagttttcatgagtagtggggtccaatctgctacacacaaatgtttcccaccccttggcctcgaaattcaaacttcttatcaaaattttcactcccgcattcaaccaatcgggggtgatacctgggtttgccagatactgtgccaaccaaggacagacctcctcacctaattccatcttttccaaatacagcgactcatccttctcatcgaagtccaagtagtcatttattgttttcctatcaaacaacactttcaaattgcacaccttggtcactttggtgcccttcttgatgtgggcaacattggtgtagaattccttgactaggtgctcgtttgcatcctcacaattgtttaagaaatactcccagcccactctatctctaaattgccttctcacattggggttgtgaggcaaaaggtttctatctacaaaaattctctccgaaattaatttcctcacaggccaccattctttgaatttatggtaggccacctcactcacaaagtggtcttgccacacctccggatttctagttcgttctaccctaccaacctggggctgacccccttctcctactacctcttcttcccctactacaccctcttcggataatgaagttgtgggagaggtggagtattcatccccactaccttcagctgagccctcagacgaaccagaagatacatttactgacgcttggacagtggggaaaggtggaagagtgtctcttagtctgtttctctccggccagtcagggatgtactctgggattgagtctgaagatatatctcgggagggctcgtattcactcccagactggtcaatggacctatcagcagctttagtgagcttccttgtgtttttaatgttttgtcgggcttggggagtcaatcttagcatcttctgtttccctccccgggaggactctcccctgcctggttgtttagaacccttgcctcttgtttcaccattgtctgcaaacaacatccattagacttgttagtatcagtagaagaaattaagttcacaattgtagaaaataaaaagatgcagacagtagcagatgttgcacagtgcggaccgcacaaaatataaagcggtcgcatagaggccaatgcggaccgcacaaaaatgctaatactgtctgcatagaggtggtgttcagactacccactctctgaacaattgcaccacggaccgcacaaaatggtaatgtggtccgcattgaggcaccgtggaccgcacaaaatacaaggcggccgcggtggcaaacttcagagagctagtattttcatcctttatcaatgcggtctgcactgattttgtgccccccacactgagttatttgcggccgcacacaatgtagtgtggtccgcattgaaaacttcagagacttgaataatttttccaccatatgccgcactgcataaacacaaacatgtaacatctcacaaccggtcaacctaaaaataaatcctatattacaatgaaaatcaaagaaaaacaagaagaaaaacacatgggttgcctcccaaaaagcgtctgatttaacgtcgcagcacgacgcaagttaccatcaaatcatttgagatgaagaagtgccaccatgtggctatcatcagttttgccgaagtagtgcttgaccctatgcccattcactctgaaaacttccccatttttgttctttaaatcaagtgcaccaaacgggatcacacataccacttcaaaaggtccactccatttcgacttaagcttttccggaaacagacgtaaccaagagttgaacaagagaaccaaatcacccactttgaaatccttactacgagcatatttatcatgaaggtacttcatcttgtccttgtacaaggaagaactggagtaggcatggaatcgaaattcatcgagttcattaagctgctccacacagagattggctgcaatatcccattcaagatttagcttccataaggcccacatggccttgtgctctaactcaaccggtagatggcaagctttcccaaacaccaaccgatatggaaacataccaatcggagtcttgtaagaatcttataagcccatagagcatcatccaacttctttgaccaatcgatcctataagcattgaccgtcgttgacaatatctttttgatttccatgttgtagacttcaacttgaccacttgcttgaggatgatagggagtagaaactttgtgattgacaccatactttgcaagaaaaatgtcaaaagctctattgcaaaaatgagaccccccatcacttatgattgcacgaagagtaccaaaccttgtaaaactgctcttcttgagaaatgcaacaacactctgcgcctcatagttgggaaaagccacggcttcaacccactttgaaacatagtccaccgccacaaaaatgtatgtgttcccacatgagctaacaaacggacccataaaatcaatgcctcatacatcaaaaatatccacctcaaggatggtattgagaggcatctcatctttcttcgaaattccgccccctctttgacattcgtcacacctctttacgagttcacttgcatctttgtacaaagttggccaataaaatccacaactaagaactgtggaagtcgtcctcgccccgccattatggccaccatagggagaggaatgacaaacctccaagatactcaatttctcttcctctgggacacaccttcggatcacaccatccgtgcaaatcttgaacaagtatgtctcataccaatagaaatccaaactatctcgcttgagcttcttcttttggttagaagagagctcacacgggattataccagtcacaaggaaattagcaacatctgcaaactatagcattccattcatcgacaccgaaaggagttgttcgtcgggaaatgaataattgctttctaggccatcacgaggcctcccctcctcctcaaagcttgaagtaacaagacccatcgcatcagtctagctttggaatccttcttcgtcatcaagtatcggagtgcggcatgatcggtatgaataataaccttagcacccatgagatacggccgaaatttttccattgcgaacacaatagacaaaagctcttgcttagtcaccgtgtagttcacttgagcatcatgcattgtcttgctcgtatagtacaccggatgaaacattttgttcactcgttgacccaaaaccgctccaaccacaacgtcgctcgcatcacacatgagctcaaagggcaagctctaattaggtgcggtaatgataggagtggtggtcaacttatgcttgagaagttcaaaggcttgcatacatttttcatcaaacacgaacttggcatctttttctaacaacttgcacaaacgattcactaccttcaaaaagtctttgataaatctccggtagaacccctcatatccaagaaaacttctaactccattgatagatgtagggggagggagacctgaaatcatatcaatttttgctttgtctacctcaataccatgctttgaaattttatgcccaagaactataccctcttccaccataaagtggtatttctcccaattgagaacaagattggtttcttcacaacgggccaaaactctatcaagattcttcaagcattcatcaaatgaatcacccacaacactaaagtagtccatgaacacctccaaaatgccttccaccatatcggtgaaaatggccatcatacaccgttaaaatgtagccggtgcattacacaatccgaaaggcatcctagaaaaaaaaatgtgctatatggacaagtgaatgtggtcttctcttgatcttctggagcaatcaagatttggttgtacctagaatatccattcaagaaacagtagaaggcatgcccagcaggtcggtctaacatctggtcaagaaaagtcaaaggaaagtgatccttgcgggtcactttattcaacttgtggtagtccatgcataccctccaaccagtgatggttatggtaggaattaactcattttgttaatttgcaaccagggtcatgccacccttcttcggtatacattgcaccggtgaagtccaagagctatcagaggtggggtacataacccctgatcacctcctttttcacaacttcttgcattgcctggttcaacttcctttgatgctccaaggagggctttacatcatcttccagaataatcttgtgcatacaaaatgtggggcttatcccccgaatatcagctaaagtccatccaattgcctttttccacttttgaagcaccgctaattggcatcaacatgcatgttagtaagacaagaggaaagaataactggcaaagtagagtttgagcctaagaactcatacctaaggtgtgaaggaagtggtttcaaatccaacaccggaggctcctcaattgaaggctttgttggtggagtcttcctattctcgagatccagagatagtttcctaggttcataagagtaagagcccatcccatgtaaagcattcacgcactccactcggccctcatcatcattgacatcaagattcaacaatacggcctccaatgagtcctccacattgatcattacactggtgtcatcaattatcactattgtgacgaggtccataaaagagcacactttggtactgttgggctgtttcattgacttgtaaacatgaaagaccactttttcatcacccacccgaaaggtgaggtcccctacttccacatgaactaaggccttcccggtagcaaggaaagatctccccaatatgataggaacttcataatccacctcacagtccaagatcacaaaatcagctggcaagataaatttgtccacccggataaggacatcatcgataatatccaatgatctcttcatcgttctatccgccatttgtaatctcatggaagtcggcctaggttgcccaatacacaaaattttgaaaaccgagtaggaatcaaattgatactagcccccaagtcacatagagccttggcaaaatccgcactcccaatggtgcaaggaatggtgaaagcaccgggatcttcaagattcgggaccattgattgcactattgtactaacttggttagtcatttttatagtttcacaatccatagaccacttctttgtcaccaagtccttcatgaattttgcatagcccggcatttgctcaagagcctccaccaaaggcacattaatggataagctcttcatcatgtcaatgaactttttaaactgattctcaattttctacttatcaagactttgaggataaggcggaggtgatcttggaaaaggtaccttggctttaggcaccaccagctccgacatatctattacgtgttccctagacgggttcacgtcattttgagtttccacctcggcatcttgaatatcaatcatcacttcttcattcatattgtcatctatcacattttctacaaccaaaggaacttcatcttcttgcaactcaatatcatcactcaaaacttgcttttgtttagaggcattcacatcaccgcctcgtccactccttgtagttactgccataacatgattgttctcaccctttgggtttactactatatcacttggtagagcacccttagggcgtgtattcaaggactgagagatttggcctatctgaacctccaaatttctgattgaggtattgtggaaagccaactgtgcatcagaatctgcatttttcttcatcatctgttcgaacatcatttcaattctacccat

SEQ ID NO: 28 - DNA, 5379 bp, Nicotiana tabacum
  modified_base (1428)..(2569): a, c, t, g, unknown or other
  See specification as filed for detailed description of substitutions and preferred embodiments
atggctgatgtagcagtgaattttctggtagagaatttgatgcagttgttgagggacaatacagagctaatatttggagtgaaaggtgaggcagagaatctgcttcaagatttgagtgagttcaatgcgtttctgaagcaagcagacaagtcccgcagcgataacgaagttctaaaagaattggtgaagagtatcagaaaagtgacgaatgattctgaagacgctattgataagtttgtaattgaggcaaagcttcacaaggacaaaggggtaggcaggtttgtggacattgcgcattataaaagagtgaaagatgtagcccttgagattaaaggtatcagagatagggtgaaagaaatccgtctgaacaatgcacatggccttcaagctcttcaagatgatgatccatccaacagaggcgtggaagacagaaaggtacctatattatatatgccttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaatcgaatctcgctcattttcaggtaagatttacttagctcgctccttgctcgcgaagcggcataccaataaaaagaaaagcgttatcggatttccatcgtcgttgtccgtcgataggaaggagatactgagaatgagagacacaaagataagacttaagagaagcgaactaacaagtgaggcttgctcagttgataaaagcacctctacccacgaccgttaggtcctgggttcgagtcatgctggaggagaagggtggaaacactatagatcctcctaaattgggagggatattaaaaaaaaaaaaaaaaaaaagagaagcgaaaagagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagacttcgatataaactaagaaaaaataagtctaaagagagtggatgggttcggattctcggatatccgatccaaatgcacagccctaaacccagcattgcatttatatatatatatatatatatatatatatatatatatatatatttaacaggtttagactccttaataagaatgaaggtgagtaagattagatgacaatatgctgcttaaatataaccaattcagatgtctccattgagcctccagcagaatataatggtacaatcaacggaactgtattgcacttaaatatactttgcacaggaagatactcctgcgcaaagttcatagaatgattatcaattttatatgagaagccgacataatcaacaaaatgagtatcgtaaaaatgtgaaagtaagaaggatgtgtggcatttcttggacaatatctatattgttgtaatgttagtgttctatatatgtcttgggaaaatccacctttgcttctatttactactgagtatcaatttttccaatacaaaacaaagctaatcacctatcttttaattaagctgcacaaatgcgtacgtaatacaatatgttttggttgaatataatgtttcttttcttgccaatgaacgttaacttcatatatatgtctaatcttcatctttgatattaatttaaaagcctcccgtggttgaggaagatgatgtggtgggctttgatgaggaggcacagaaggtaatcgaccgtcttcttgacagatcagatgaattagaggttattccagttgtaggaatgcctggtcttggcaaaaccacactagcaactaagattttcaagcatcggaaggttgaatacgagttctttactcgagtttgggtttatgtctcgcaatcatacaagacaagagaattatatctcaacatcattagcaaattcaccggaaaaacaaaacaataccaatatatgtgtgggaacgtatcaagattgctttcccgaacaacaaaaagtgcaatagagtattgttgaccactcgagatcacaaggtggctcatcattgcaacaatactccacatgatttaaaatttcttagcgatgaggaaagttggatgttgctagagaagaaagtttttcacaaggctaaatgtcctccggaattggaaagacctggacagagcatagccaggaagtgtaagggacttccccttgcaattgtggtgattgcaggagctctaatagggaaacgcaagacaacaagggagtgggagcaagtggatcagagtgttggtgaacacctcattaatagaaaccagccaaagaattgtaataaaattggtgcaaatgagttatgatcgtttgccttacgacttgaaagcatgctttttgtattgtggtgcatttcccagaggctttgagatccctgcttggaatttgatccgtttatggatcgccgaaggcttcatccaatacaaagggcccttatcccttgaacgtaaagcagaggattacttgaatgatctcgtcaacagaaacttagtgatgataattcaaaggacgtctgatggacaaatcaaaacatgtcgtgttcatgacatgttgcatgagttttgctggcaagaggccacaacagaagaaaatcttttccaagaggtaaaattaggtgttgggcaatttgctcgtgagatacagcaactatccacctaccgccgcttgtgcattcattcctcagttctggaattcatttctatgaagccctctggtgagcatgttaggtcattcctatgtttttcttcagaaaaaattgacatgcccccggttgacatcccaaacataccaaaagactttccattgctaagggtgttggatgctgaatccatcaaattcagttgcttttgcagggagtttttccaattgtattttctgaggtatattgctttctcatctgactttatcaagatccttcctaaacatattggggaactatggaacgtacaaaccctcattgttaacacacaacagagcaatcttgatattcaagcagacatatggaacatgccacggctgaggcatctgcacactaacacgtccgctaaattgcctacgcctgttgccccaaaaagtagcaaggttacctcggtaaatcaatgcctacaaactctctccacaattgcaccagaaagctgcacagaagaagttttttcaagggctccaaacttgaaaaaactgggcattcgtggtaaaatctttatgcttctggaaccaaataagtccgaattgttcaacaatgttaagaagctacaatgtcttgagaacttgaagctgataaatgttggtcaaagtgggaaacaattacgccttcctccaacatatatatttccgacaaatttgaggaagctaacattattagatacctggttggagtgggatgatatgtctgtattgggccagttagagtaccttgaagtcttgaagctgaaagacaatgcatttaagggagaatactgggaaccaaaagttggaggttttcgttccctactagtgttatggatcgaaaggtcagatttagcttcttggaatgcttcaagtgatcactttccaagacttaagcgtcttgttctcgtatcatgtgataaacttgaggaggtccccattggcttggctgatatacgcggcctccaagttatggagttgcgaaattcaaccaagcaaacagcaaaatctgcccgggatatacaggccaaaaaagacaagcaaactcaagaaggggctaaaacccaaaggttcaagctttctatattccctccttatctctga

SEQ ID NO: 29 - DNA, 5544 bp, Nicotiana tabacum
atggatctggtccatcaagatgaagatgtgactgctgaactggaggttcagactcctaagcccaagaaatccaagactttctccaagaagtctacttctatgtcaaagtctgctgaactatccaccctggcaaaaaggaccaggtccacagtgaaaaccatacaagcaaaagttactgaaggagaggcgtggagtagtgaagaggaagatgaatcagacagtgaaaaggacaagatggctaagtttggcaaaagaactattctgaaggtgctagatggaagggatactagcttagtgaaaggggtgcaaatctcttttgatatgaaggagttgggtggaattctaggtgtacatgatgaagggtacaataattacaaaaagcttaagtggcaaagcctagaaaattttcctactgcccttgccatcaccagaaaattcagtgatcatgagaaggaaagtgtgcccaagactgtgtacaagagtgaaatgaagtcaccccacaaggttttgtttgaatttgtcatcaaatatgttctgcctagggttatcaatggtaccaagtctcattctattccctatggtttcattcttacaactgtgctttcttgttttaaggtgcctttgaataagtgtgaggtggctacaagcaaagatcactttggggcgaaaactttgattgcttgtgactatgaggaaagtgaggcaaaggaagctaagatagcaaggatgaagacacggttggctgaggtagaatctgagagagatgctctcagaacaaaacttgcaagacaaaaggagaagaatgatggaatttttcaagacatgctgaaacttctccaagaaaataacccagcacctcgttcttccaagcctaaagttcctagcctagtgtggatggtgttgcgtgtggcagtgttggtggggagagataaggagaaagtagatggtggtgaaaggtgttccatgtctgcaatgtgtgcatatctaatagagccccgagggctcgggagtgattcagaggcggttcggggtgtttttgaccttaggaagtgttgcagaatttctgcagtcagtgcccagtcattttcttctatgcgatcacatagatccaggagcagcttttggacctcagcagtaggatttgatcgggagctgacttcagtccagagacaccgaggtagccttgctgacagggggcgaggccgtgccagaggccgaggcaggggcagagctcagccccgagcagcagttccagaggtggagcctcatgttgattatgatgaggaggttccagctccagcagctccggtgggcccagctcaggtcccagagggtttcattgccaccccagttcttcaggacgccctggttcgattggtgggccttatggagagagtcacccgaacaggtttgcttcctgtagcaccagccacttctcaggctggaggaggggctcagactcctgctacacgcactccggagcaggtagctccccagattcagactccagcggttcagccagttggggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatgtccttcagtgcaccaccagctcccatcagtgcaccgccgcttcagagtttccgaggtggtcattcaggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgttgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccttagagtggagagggagactcccctgttatttctatccagtatgggcagtcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtacagcgtggaggtgccaagcaggagccccgagggctcgggtgtttgtttcggaatggttttagacttagaaaaattgcagaactgctgtctgctggtgtccagtcttttgtgctatgcgatcgcatagctatatccaggagcagcttttggacctcagcagtaggatttgatcgggagctgacttcagtccagagacaccgaggtagccttgctgacagggggcgaggccgtgccagaggccgaggcaggggcagagctcagccccgagcagcagttccagaggtggagcctcatgttgattatgatgaggaggttccagctccagcagctccggtgggcccagctcaggtcccagagggtttcattgccaccccagttcttcaggacgccctggttcgattggtgggccttatggagagagtcacccgaacaggtttgcttcctgtagcaccagccacttctcaggctggaggaggggctcagactcctgctacacgcactccggagcaggtagctccccagattcagactccagcggttcagccagttggggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatgtccttcagtgcaccaccagctcccatcagtgcaccgccgcttcagagtttccgaggtggtcattcaggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgttgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccttagagtggagagggagactcccctgttatttctatccagtatgggcagtcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtacagcgtggaggtgccaagcaggtacttccttcttatgtccgttcgaggacgaacggttgttttagaggtggagaatgtgacgacccaaagggtcatcaccggttttctccctttttcgtgcttccgaggccttga

SEQ ID NO: 30 - DNA, 4017 bp, Nicotiana tabacum
atggagagagtcacccgaacaggtttgcttcctgtagcaccagccacttctcaggctggaggaggggctcagactcctgctacacgcactccggagcaggtagctccccagattcagactccagcggttcagccagttggggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatgtccttcagtgcaccaccagctcccatcagtgcaccgccgcttcagagtttccgaggtggtcattcaggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgttgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccttagagtggagagggagactcccctgttatttctatccagtatgggcagtcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtacagcgtggaggtgccaagcaggagccccgagggctcgggtgtttgtttcggaatggttttagacttagaaaaattgcagaactgctgtctgctggtgtccagtcttttgtgctatgcgatcgcatagctatatggcgaggacacgcgcttcctcatcgaccgcgcagcagcccgagcccccagcagcagctcctattaggggcagagggcgaggcgaggcccagaggccgaggcaggggcagagctcagccccgagcagcagttccagaggtggagcctcatgttgattatgatgaggaggttccagctccagcagctccggtgggcccagctcaggtcccagagggtttcattgccactccagttcttcaggacgctttggtccgattggttcaccaagctcttcacttctacttttgcggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatggtagaggccatcctcctaggccctttcagtcagctctccaggtatcacatggtatctcaggtggtcgtggttctcagacgcattatttggatcagcagtccttcagtgcaccaccagctcccatcagtgcaccgccgcttcagagtttccgaggtggtcattcagggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgctgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccgtttagagtggagagggactcctggtcattctacccgcagtgttatttctcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtgcagcgtggaggtgccaagcaggtacttccttcttatgtccgttcgaggacgaacggttgttttagaggtggagaatgtgacgacccaaagggtcatcaccggttttctcccttttttgtgcttccgaggccttga

SEQ ID NO: 31 - DNA, 1485 bp, Nicotiana tabacum
atggcgaggacacgcgcttccttatcgaccgagcagcagcccgagcccccagcagcagctcctattaggggcagagggcgaggccatgctagaggccgaggtaggggcagagctcagccccgagcagcagttccagaggtggagcctcatgttgattatgatgaggaggttccagctccagtaactttggtgggcctaactcaggtcccagagggttttattgccaccctagttcttcaggacgccctggttcaattggtgggccttatggagagagtcacccgaatatgttttcttcctgtagcaccagccacttctctggctggaggaggggctcagactccttctacacgcactccggagttcaccaagctcttcacttctacttttgccggtgcatttactgaggatccccaggattatctagaaagcttccacgaggttctgagaaacatgggtattattgagaccaatggggttgattttgctacatttcgcttgtctggatccgccaagacttggttcaacgatttagctcgccatgctctcatcatacttcccaccgagagagagagggtgagaaggtttattgatggtcttattctgccaattcgtcttcagatggccaaggagggcgggagcgagatcacatttcaggaggcggtcaatgtggcccgcatagttgagatggttatgtcatatggaggtggtcataggtcggataagaggccccgtcattcaggaagattctgtggtattgcgtctggaggtagagattcgtatggtagaggccatcctcctaggctcgttcagtcagctcaccagcctgcccagccagctagaggcgggggtagaggacatagaggtggaggtagaggtcatagaggtggagctcagaccgccagaggtactattttggtctgtgatagagatgcttcagtgctatttgaccctggatctacgtattcacatgtgtcgtcctattttgcaccctacttggttatacgtagtgaggccttgagtattcctgtgtatgtatctacactagtaggtgattctatagtggttgattgggttcatcgttcctgtgttgtggtgtttaggggacttgagacccgtgttgatttgttgctcttagatatggtggattttgacattatattagggatggattggttgtccccgtatcatgcgatcttggattgtcatgccaagattgtgactttagccttatcggattttccccatttagagtggagagggactcctggtcattctacccgtagtgttatttcgtatgtgaaggctcggtgtatggtcgagaaggggtgtttggcctactcagcttatgttcgtgattccagtgctgagattccctctattgattctgtgaccttgtcttgcttatattccggtcggcgagagacctcttgctttggacgttcaggatttggccaatcagttaatgaggttggatatttctga

SEQ ID NO: 32 - DNA, 3978 bp, Nicotiana tabacum
atggagagagtcacccgaacaggtttgcttcctgtagcaccagccacttctcaggctggaggaggggctcagactcctgctacacgcactccggagcaggtagctccccagattcagactccagcggttcagccagttggggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatgtccttcagtgcaccaccagctcccatcagtgcaccgccgcttcagagtttccgaggtggtcattcaggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgttgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccttagagtggagagggagactcccctgttatttctatccagtatgggcagtcttgcttatattccggtcggtgagagaccgcttgctttggacgttcaggctttggccaatcagttagtgaggttggatatttctgagcctagtagagtattagcttgcacggtcgctcgttcttcgttattggagcgtatccgtgatcggcagtttgatgatccccatttgtgtgtccttagagacacggtacagcgtggaggtgccaagcaggagccccgagggctcgggtgtttgtttcggaatggttttagacttagaaaaattgcagaactgctgtctgctggtgtccagtcttttgtgctatgcgatcgcatagctatatccaggagcagcttttggacctcagcagtaggatttgatcgggagctgacttcagtccagagacaccgaggtagccttgctgacatggcgaggacacgcgcttcctcatcgaccgcgcagcagcccgagcccccagcagcagctcctattaggggcagagggcgaggccgaggcccagaggccgaggcaggggcagagctcagccccgagcagcagttccagagttcttcaggacgccctggttcgattggtgggccttatggagagagtcacccgaacaggtttgcttcctgtagcaccagccacttctcaggctggaggaggggctcagactcctgctacacgcactccggagcaggtagctccccagattcagactccagcggttcagccagttgggtagttcagccgggtgccatagctcagaccggcgatggagcggctatgtccgccgatgctttgtggagactggataggttcaccaagctcttcacttctacttttgccggtgcatctactgaggatccccaggattatctagacagctgccacgaggttctcagaaacatgggtattgttgagaccaatggggttgattttgctacatttcgcttgtctggatccgccaagacttggtggagggattattgcttagcgagaccagccggatcgccatctttgacttgggagcagtttacagtgttgtttctagagaagtttctccccgttactcagagagaggcctatcggaggcagtttgagcgcctccagcagggttctatgactgttacccagtatgagaccaggttcatcgatttagctcgccatgctctcatcatacttcccaccgagagagagagggtgagaaggtttattgatggtcttattctgccgattcgtcttcagatggccaaggaggccgggagcgagatcacatttcaggaggcggccaatgtggcccgcagagttgagatggttctgtcacagggaggtggtcatgggtcggataagaggccccgtcattcaggcagattcagtggtacctcgtctggaggtagagattcgtatggtagaggccatcctcctaggccctttcagtcagctctccaggtatcacatggtatctcaggtggtcgtggttctcagacgcattatttggatcagcagtccttcagtgcaccaccagctcccatcagtgcaccgccgcttcagagtttccgaggtggtcattcagggcgacagggtcagcagtctcagcagccgagggcttgttacacttgtggtgatatgggtcacattgccaggttttgccctcgagcttcgggtagttctcagcagcagggtcctcgtcctatgattcaggcaccagttgctccacagcctgcccagccagctagaggcgggggtagaggacatagaggtggaggtagaggtcatagaggtggagctcagaccgccagaggtaggggtcagccagcagccgatcgtcccagggatgtgattcagggaggtggggcccagccccgatgttatgctttgccagccaggccagaggctgagtcatccgatgctgttattacaggtactattttggtctgtgatagagatgcttcagtgctatttgaccctggatctacgtattcatatgtgtcgtcctattttgcaccctacctggttatgcctagtgaggccttgagtattcctgtgtatgtatctacaccagtgggtgattctatagtggttgatcgggttcatcgttcctgtgttgtggtgtttaggggacttgagacccgtgttgatttgttgctcttagatatggtggatttcgacgttatattagggatggattggttgtccccgtatcatgcgatcttggattgtcatgccaagactgtgactttagccttaccggatttgccccgtttagagtggagagggactcctggtcattctacccgcagtgttatttctcttgcttatattccggtcggtgagagaccgcttgctttggacgttcaggctttggccaatcagttgtga

SEQ ID NO: 33 - DNA, 2121 bp, Nicotiana tabacum
  modified_base (364)..(405): a, c, t, g, unknown or other
  See specification as filed for detailed description of substitutions and preferred embodiments
atggcttatcctgcagtgaactctttaattcaaactttggagctattccaaaagacttatccagcattgatccatggtcaaactgcagagatgattgactctctccatgccagtgctgaatattttcaaaatattcttgagaacgctagccaccagaaacaggaatatgatacattcaaatattttgaggcagagataagatcagcgatgcaccaagctgaagatgtgcttgaatcaaatgtgaggcggattaactccttctccactgaaacctatgctcgttgccttggcccccctgatgatgaggatcatttcttcaaaaagggacattctctggtagctggttcttcttcaaaccttgctnnnnnnnnnnnnnnnnnnnnnnnnnnnnnnnnnnnnnnnnnngtcggtttggcgaattccttgagaaaactcactgatgcactacttggattagcttctgagcagaacgtcattcctattttgggaatgggtggatgtggcaataccacacttgctaaaaaggctcaagatgatcaatcaattagatcacattttgacatccaaacgtgggttactatatctcaagaatatcacttaaacgaagtgttgccaagccttgcacgtagccttacaggatacgagtttcagggaatgagtgatgaccagttaatggaccagtcatataaagcacttaagggtcggaagtatcttatcgtagttgatgatatttggagtacaaagatttgggatttgattgcgagaacccttcctgatgacaataatggaagtcgaatcattctgactacgaggctaaaagatgtggctgagtatgctaaccctgatatccctcctcttgaagtgctgccgttaggggtagatgagagttggaagttacttcagaataagttgttggggaaaagccacattaattgtcattctgaattagaagatatcgggaagaaaatagtacaaaaatgccagggactgcctctagcaattttggtggttgctgggcatctctctaggatttccccaaaaagggaaaactgggtaactgtatctgaaaatgtgaatgaagttgttacaagttatccgaatgaatgcatagcagtgcttgcgatcagttaccatcacctgcctattcacctcaaaccttgtttcctccatatgggagcattccctgaggattctgagattgatgcttggcggttaattcgtctgtgggttgcagagggttttctgaagagggataagctgagaagcctggaaaaagtggcagaggattgtttggaagatctggctagcagaaatttaataatggtcaaaagggggaaactcaatggccggatcaaaaatttgcctttgcatacacgcatttcaggggaaaactttaccaagtcagcaaaatttttgcgttgcttgtatcttttcaaggaacctcataaaacaataggaaaaccattggaattcaaagctttgagggtgttggctgccattcctagttttgttcatcacaatctggagtggcgtggaattttaactttacctaaccatatctggaatatgaagcagctgaggcatctccgtctacatggtagcacttatttgcccaacccatatgtggtagacgagttgggtctgcaacatctgcaggagctttccagtctctgtcttgctagctgtacaaaagagagattgaccctatctggaagttggcttccctgggaagacatggcaaatcttgccaagttaccaaatctccaactactcaaacttagatgtcatgcattcagaggtgaggtatggaaattaaaggaggaagatgagttcaagcagctaaagttccttctacttgatgacacagagacacaactctgggaggctaccaatgttaactttccaaatcttcaacgcctcgtattggagaaaatcaagattcttaggcgaattcctatagcctttgcagatacatacaccttggagtcaattgagttgtataaatgcggtctaattgtggattcagccagagaaattcaggaggaagtagctgccatggcgggaagtgattgtcttgctcttcgcatatatatatatgaaggtaacgactttcagaattaa

SEQ ID NO: 34 - DNA, 930 bp, Nicotiana tabacum
atggcgagaacacacgcttcctcatcaattgataagcagcccgagcccccagcagcagctcccacgaggggcagagggcgaggccgaggtaggggcagagctcagcctagagcagcagcaccagcggcggagcctcaggttgagtttgatgatgaggttacgacccaggaagttccggtgggcctagctcatgtctcagaggggttcattgctaccccagtactccaagatgctctgatggctccccagtttcagactctaacaactcagccagttggagcagttcagccggatgtggtagctcagaccggtgatagagcagctatgtctgtcgatgccttgtggagattggacaggttcaccaagctcttcactaccacttttagcggtgcatctttggaggatccccaggattatttggacagatgtcatgaggttctcaggaacatggggatattggagaccaatgggatcgactttgctactttttgcttatctggattcgccaagacttgtacgagaccaggtttattgatttggcccgtcatgatctacttatactccccattgagagagagagtgaggaggttcattgagggactcattcagcctattcgacttcagatggatgaggagacagggagtgagatttctttccaggaggtagccaatgtggctaggagagttgagatggttctatcgcagagaggtggtcaggagtctgataagaggcctcgtcattcaggcagattcagtggcgcctcatctggaggaaaggatttgtatggtagaggccaaccttctaggctttttcattcagcacttcaggtttctcacggtgcttcaggtggctgtggtcctcatatgcaatattctgatcagcagtcctacagtgcaccaccaactcctatcagtgcaccgtcgctttag

SEQ ID NO: 35 - DNA, 1335 bp, Nicotiana tabacum
atggtgaggacgcgagctaccggacgaggtggacgaccaccagtgccaccagctgagaccaccagaggccgtggacgcggtcgtggtcgtggcagaggcagagcagcgagggcagcacctgtagatccaccagctgccctagctccggatcaggctccagctatggatgctccagcagcaccagttcaggcaccagctgtgcccatcgtgattccgggtcttcaggaggccttggcacagatcttatcagtttgcactggcctggctcaggcagtttcagccactacagcagcagctacttcacaggccggaggcaatcagacccccgctgctcgcacacctgagcaggtagtgcagggacttcagacgccgggggcacctccagcccagccggttgcaccagctcaggagtttgttgtgccagttatgccggatgatgagcagcgtctcttgagaggtttggtagactccagcctccgtcattcagtggtgctgagggcgaggatgcccagggttttcttggataagtgtcagcggatgctccgtacagcagggattcttgagtctagtggtgtggcatttaccacctttcagtttactggggctgccttcacttggtgggaggcgtatgagaggcgtaggccggttggagcagcgccccttacttggcagcagttctccactctcttcttggagaagtatgtaccgcagtcccgcagagaggagctgcgtagacagtttgagtggttgcgacagggggatatgactgtgtcacagtatgagtcgaggttttctgagttggctcgtcatgccatttggatggttccgacagatcgtgagaggatcaggagatttgttgatggccttaactatcatctccgtattcttatgacccgagagagggtgttgggtgctacgttcgaggaggtggttgatatcgctcgcgagattgagacggttcgccgtcaggatcgagaggagagggaggccaagaggcctcgagggggcagttatagtggtgctccttcgaggggccagtttcagcatggtagaggtcgttctttcaggcctgctcagtcagcccgcccaggttatcgtggggcatcttcgggtcatggttatcatggatctcagcagggccagtcatcacttagtgcccttccagcccagagttcatctcgtgccccgtcagctcagggttcttctatgccgagtgcatcagctggtcactccggtgcgaggggttcccttcagtccccttctccagcacctgggagttgttttgagtgtggagagtttggacatatgtggaggcagtgtcctcgtcgttgctag

SEQ ID NO: 36 - DNA, 1134 bp, Nicotiana tabacum
atggggatagttgagaccaatggggtcgattttgccacttttcgcttgtctggatccgccaagacttggtggagggatttctgtttggctagaccagccggatcaccagctttgacttgggagcagtttactcagctatttctggagaagtttctccccatcactcagagagaggcctatcggaggcagtttgagcgtctccagcagggttctatgactgttacccagtatgagaccagattcatcgacttggctcgtcatgctcttcatacttcccaccgagagagagagggaggcggccaatgtggccaggagagtggagatggttctgtcgcagggaggtggtcatgggtcgacaagaggccccgtcattcaggcagattcagtggtacctcgtctggaggtagggattcatatggtagaggccatcctcctaggccttttcagtcagcacttcaggtttctcacggtgcttcaggtggccgtggttctcagatgcagtattctgatcagcagtcctacagtgcaccaccagctcctatcagtgcaccgccgctccagagttttcggggtggtcattcaggtcgcagggtcagtcagtttcctcagcagcactcaggtggatgttttgagtgtggtgatatggtcatatccctctcagcagcagggttcccgtgctatggttcaggcaccaggtgttccacagccgcccagccagctagaggtgggggtagagaggtgctagaggtggagcttagaggtggaggccagccagctgcaggccatcccagagatgtagttcagggtggtgggcccagccccgatgttatgctcttccagccaggcctgaggctgaggcttccgatgcagttatcacaggctttggccaatcagttcgtgaggttggatgtttctgagcccagtcgtgtgttagcttgcacggtcgctcgttcttctttattggagcgtatccgtgatcggcagtatgatgatccccatttgtgtgtccttagagacacggtgcagcacggaggtgccaagcaggttaccttaggtacttcagtccgttcgaggacgaacggttgttttagaggtggagaatgtgatgacccaaaaggtcatcacttgttttaa

SEQ ID NO: 37 - DNA, 1239 bp, Nicotiana tabacum
atggtgaagacttctaaaatggctccccaaaaagtcacttcttcttctcaaccgaccaccaaaattgatgaaaccactcctgatgtggtcgacctggagaggtacgctgctgatgtggttaccgatgaaccggctatcgaacctcccttaaaaatgttcattcccgagggttgtttggtcgccgacgactttaagctcggggctgcatcaggagagaagaagaagaagaagaaaagaaaggctttgggttccccgagctcagagaagaaaaaaccgaagagaagattggcctataagccaaaggatagctccagctctcgagcaccagactcagacttgctctactggctcagggaagagcatgaggaggatgatctttttacggcctacgaaccgacctcccccaaagagcgggcgatagccgaggaggagacaacaaaggcctgtctttctcaggttcgggagaccgatgtagaaacgagggctcagccttctcgagacgctggctctgctccacccagcatcaaagaaatttctgggtcaccttctttcaccgaatctatgttggacaaagctcgagcggagaaggagagatataacgaaggggcctatggtgtggacgacccccttcgttgcctttttgaaggtgtggactcaaccgccctaaaagacttctccggttgggttatttggagctgccgagactatctttggaggctttggtacttcatcataaaaattttctctggtaccagcctgaggttaaccagctcgaggctgaggtcaaggagcttgctgagaagagggacacatataagtttctcagcgagaaacataaggaagcggtcaagagtctttgaacaaagtcggacgcgggtccaactccgagtggcaaaagagaaggaaaatgcatgtgctcgacaaatcgatgacctccatgctcaactaggctcagctgctgctaaacgggatacctttaggaaggagctcgaatcagtgaagtctgtgtcagaaataactaggggtgatgctgaagagatggtggcccagtacagggccgatgtcgagggtttctacctgttagccgagattgaagatgcaaaaaggctcgaggccgaggccaagaagctggctgaccccaaggatggggagggctatgagggctccggtgaccccgaggatggagaagaccctgacaaccctactaacgaggtgggttctggtgaagatcgggcttag

SEQ ID NO: 38 - DNA, 1680 bp, Nicotiana tabacum
  modified_base (1504)..(1545): a, c, t, g, unknown or other
  See specification as filed for detailed description of substitutions and preferred embodiments
atggcgagaacacgcgcttcctcatctaccgctcagcagcccgagcccccagcagcagctcccactaggggcagagggcgaggccgtgctagaggccgaggtaggggcagagttcagccccgagcagcagcaccagtggcggagcctcaggttgattttgaggaggaggttccggccccagcagttccggtgggcccagctcaggtcccagaggggtttattgctaccccagttcttcaggacgctctggtccgattggtgggcctcatggagagtgtcacccgagcaggtttgcttcctgtagcaccagccacttctcaggctggaggaggggctcagactcctgctacacgcactccggagcaggtagctcctcagattcagactccagcggttcagccagttggagcagttcagccgggtgtagtagctcagaccggtgatggagcggctatgtctgccgatgctttgtggaggctggataggaacatgggtattgttgagaccaatggggtcgattttgctacatttcgcttgtctggatccgccaagacttggtggagggattattgcttagctaggccagccgggtcgccatctttgacttgggagcagtttacagtattgtttctggagaagtttctccccgttactcagagagaggcctatcggaggcagtttgagcgcctccagcagggttccatgacggtcacccagtatgagaccaggttcatcgacttagctcgccatgctcttgtcatacttcctaccgagagagagagggtgaggaggtttatcgacggtcttattcagccgattcgtcttcagatggccaaggaggccgggagtggtcgtggtcctccgattcagtattctgatcagcagtccttcagtgcaccaccagcacctatcagtgcaccgccgcttcagagttttcagggtcgtcagccccagcagccgagggcttgttttacttgtggcgacacgaggcacattgctaggtattgccctcgagcttcgagcagttctccgcatcagggttcccgtgctatggttcaggcaccagatgttccacagcccgcccagccagctagagctagaggtggaggtagaggtcctagaggtggagctcaggccgccagaggtggaggccagccagcagcaggccgtcccagagaggtagttcagggtggtggggcccagccccgatgttatgctctcccagccaggcccgaggctgaggcttcagatgcagttattacaggtacggttctggtttgtgatagagatgcttcagtgttatttgatccagggtctacatactcgtatgtgtcatcttattttgcaccgtatctggtcatgcctagtgattcgttgagtattcctgtttatgtgtctacaccggtgggtgattctattgtggtagatcgagtccatcgctcttgtgtagttgtgattgggggtcttgagactcgtgtggatttgttgcttctagacatggtcnnnnnnnnnnnnnnnnnnnnnnnnnnnnnnnnnnnnnnnnnncacgctatcttggactgtcatgccaagactgtgaccttagctttaccggtcttgcttatattccggtcggtgagaggccgcttgcttggatgttcaggctttggccaatcgatttgtgaggttggatatttctga

SEQ ID NO: 39 - DNA, 2001 bp, Nicotiana tabacum
  modified_base (1630)..(1671): a, c, t, g, unknown or other
  See specification as filed for detailed description of substitutions and preferred embodiments
atggcgagaacacgcgcttcctcatctaccgctcagcagcccgagcccccagcagcagctcccactaggggcagaggccgaggccgtgctagaggccgaggtaggggcagagttcagccccgagcagcagcaccagtggcggagcctcaggttgattttgaggaggaggttccggccccagcagttccggtgggcccagctcaggtcccagaggggtttattgctaccccagttcttcaggacgctctggtccgattggtgggcctcatggagagtgtcacccgagcaggtttgcttcctgtagcaccagccacttctcaggctggaggaggggctcagactcctgctacacgcactccggagcaggtagctcctcagattcagactccagcggttcagccagttggagcagttcagccgggtgtagtagctcagaccggtgatggagcggctatgtctgccgatgctttgtggaggctggataggttcaccaagctcttcactactactttcagcggtgcttcttctgaggatccccaggattttctatatagctgtcacgagagagaggcctatcggaggcagtttgagcgcctccagcagggttccatgacggtcacccagtatgagaccaggttcatcgacttagctcgccatgctcttgtcatacttcctaccgagagagagagggtgaggaggtttatcgacggtcttattcagccgattcgtcttcagatggccaaggaggccgggagtgagatcacttttcaggaggcggccaatgtggcccgcagagttgagatggttctgtcgcagggaggtggtcaggggtcggataagaggccccgtcattcaggcagattcagtggtacctcgtctggaggtagagattcatatggtagaggccatcctcctaggccctttcagtcagctcttcaggcttttcacggtgcttcaggtggccgtggtcctccgattcagtattctgatcagcagtccttcagtgcaccaccagcacctatcagtgcaccgccgcttcagagttttcagggtcgtcagccccagcagccgagggcttgttttacttgtggcgacacgaggcacattgctaggtattgccctcgagcttcgagcagttctccgcatcagggttcccgtgctatggttcaggcaccagatgttccacagcccgcccagccagctagaggtgggggtagaggtgctagaggtggaggtagaggtcctagaggtggagctcaggccgccagaggtggaggccagccagcagcaggccgtcccagagaggtagttcagggtggtggggcccagccccgatgttatgctctcccagccaggcccgaggctgaggcttcagatgcagttattacaggtacggttctggtttgtgatagagatgcttcagtgttatttgatccagggtctacatactcgtatgtgtcatcttattttgcaccgtatctggtcatgcctagtgattcgttgagtattcctgtttatgtgtctacaccggtgggtgattctattgtggtagatcgagtccatcgctcttgtgtagttgtgattgggggtcttgagactcgtgtggatttgttgcttctagacatggtcnnnnnnnnnnnnnnnnnnnnnnnnnnnnnnnnnnnnnnnnnncacgctatcttggactgtcatgccaagactgtgaccttagctttaccggccagtatgggcagtcttgcttatattccggtcggtgagaggccgcttgctttggatgttcaggctttggccaatcgatttgtgaggttggatatttctgagcctagtcgagtattagcttgcacggtcgctcgttcttcattattggagcgtatccgtgatcggcagtttgatgatccccatttgtgtgtccttagagacacggtgcagcgtggaggtgccaagcaggttaccttaggtacttccttcttctgtccgttcgaggacgaacggttgttttag

SEQ ID NO: 40 - DNA, 816 bp, Nicotiana tabacum
atggaaatcgacttgaacattcaagagttgctagtgatcgatgattcagatttgcttatgcaccaggtacaaggagagtgggccaccaagaattccaagatattgccatatctgcaccatgtgcaggaattaagaaagaggttcatgaagatagaatttcgacatgtgcccagaattcagaatgagtttgtcgatgcagtagccaccttgtcatctatgatacaacatccatataaaaattatattgatcccatcccagtgaagatccataatcagtcggcatattgcgctcatgttgaagaagaaatagatggaaagccttggttccatgacatcaagaagtatttgtcaaagggagaatatcttgagcacgcaaaccacactcagaaatgcacactccagagattttacaatcacttcttccacggcggaggaaatttgtacaggagaactcctgatttgggtttcctaagatgtgtcgatgcaaaggaagcttctaagctacttgaggatgtacatgccgggacttgtggcctgcacatgaatggtttcgtcttggctaagaagatacttagggtcggttacttttggatgaccatggaaacggattgcatccatgtgccaaggccaaatttatcagaacataatgtccagagctttcaactaaagggtcaaactaaggcaatttacaccagggtgctgacaggaggagcacccatacttgcaaaaattgatggagcaatttggccaaaaccaattaattcagacgcaatcaagagatacgatgcttggattatttacatttttctcatctaa

SEQ ID NO: 41 - DNA, 1188 bp, Nicotiana tabacum
atggtgaaacaacaagggaaaggctctaaacaaccaggccgaggagaatcctccctgggagggaaacagaaaatggtcaaactcactccccaagctaggcaaaacatcaagaacataaggaaggccataaaagtggctgacaaagacattgacatttcggggacccaagcatcagtgaacatttcttctaggtcgtctgagggctcaccagcgggtagtagggatgaatactctaccactcccacagcttcattatctgaagagggtgttgtaggagatgaggaagaagtaggtggtgacgatgaagtagaagaaggaggtgaaccacaagagtggtggccggtgagaaagttgatcccggagcggagtttcattgatagtgacttgctacctcacaaccccaacatgaggagacagtttaggatgagagttggctgggaccatttccttgataagtgtgaggattccaacgaacacttggtcaaagaattttacagcaatgtagcccacatcaaaaagggctccaaagtgaccaaggttcaaaattggaaggtgttgtttgatgggaagtatataaatgaatacctgagcttcaatgagaggacgagaccttatacatggcaaatttggaaatgggagaggagccggttggaccctaccactcatgacaacgcctttcctctccatcgggctgtattggtcacttctattatggtggggtaccccatcaatatggggaatgtgatgtcgaggattattactattgtgggtgccgagcatgatagaaacaatccattccccagcttcctgactgagtacttccgggacctgaaagtggatgagaggccctatgacatcaaggtcaaggagatagccccattttcctggtatagcatgaagggggataacaaccccaagagcaagaactacaaagctcatgcttctgccccaattgtccagtctaaagatccagttatggtagaggtccctgctgagcctacctctactcctgctgacatctctcccggaccttccacatccacagctattcctgctggtctatccacatcagcgggcccggagatcccatcttactgggcccatcatattactacccaccgtctaagccaggcacttctaaatttcaacaactggatgaagactgcctcatctaagttgtccatctag

SEQ ID NO: 42 - DNA, 1533 bp, Nicotiana tabacum
atggctgaaaaaacttccgatctctttgcctctatggagatgagcaggttctacaccactgacccatatatggaacctttcattttgactgagccttcctcaccctctaccactcttgctgctgcagtcacaccttccccaatttcccaatatcttcccaactcagaaacctttaaaactactattttgttctccccatcgtctgttgttcccaccaatcaaaccctaagtggagaacaagggtatgcaatagcagatactactggggcatcacatgaggaacctgatccctctccggaggacccagtcgaggtggaagagggaactccagaggaacccggttcacttgttaggcgatctttgaaaaagacaaagcctgtgtcaatagagaaagggtcaacatctaagtccaaaaagaaggaggtagtgagtgagttttctatgtctgatgaggatgtactagttaagtctaaggcaaaaggcaaagtcagtggagagaagtttgggaaacgcaagtcggaatcttttgacgaacctagttctatgaagaaaatgagaagtgaagtcagccttggctctgagcttttgaggcatcaaaaagttctattgggtcgtatgtttgacccaacaatctctgatatggctggaatgcgccaaattctggaaatggtcgagtttcaacgttgggtgcatctatttcacatggatgcacctaaggtgtatgaggaggaggtacaaagtttctttgctagcctctttccagttgatactgaccatgtctatgctttggtcaatggggtggacatcgtgtttgatgtaaaattgcttggagagattttaaaagttcctacagttagggtgttgagtgtacgagatgttttcatgttgcctcgagccgaaaggaggttagtgacttctaagtctgacctattcctaatggagcaacttgacggtttcaatcctatgattcttcctgctattatgatcgaacacatgcaaaaggtttccaccttcaaggacggtaatcatggacttccctatggattctttcttactccagtgttcaaattctttaaagttccactgggaatagctgaggaaattcatcggttgaaggccatgaatgttatcctggaagatcagcaagcccaaggggttcccatgtcgaatgatgaagtggcttgtttgacacaggagaatgctaatctcagggcgcaagttgagaacttgaaggcggaactgctcaacgagcaaaagtcggcaaacaccttaatagacctcgttctccaggcattttctgctgctaccaatccttttactcctagtgccctaaagtacccctttagtgaccagttttctggatatgtttcttatgtttttgtttcattgttgatgagtcaattggacacaactagaaatgaagtgactggcgtcactgtttctgccgtactgcactgtcctcccactcattctctaacaaaacaaagtactcacatcatttcaagtgatgtgatcaagatgtacccacaatga

SEQ ID NO: 43 - DNA, 930 bp, Nicotiana tabacum
atgcaatattctgatcagcagtcctacagtgcaccaccagctcctatcagtgcactgctgctccagagttttcggggtggttattcaggtcgccagggtcagtctcagtttcctcagccacaacacttaggtggatgttttgagtgtggtgagtatggttatattaggaggacttgtccgaggttagtgggtactcagtcgcagcagcagggtttccgcgctatggttggggcaccaggttttccacagaccacccagccagctagaggttctagatgtggaggtagaggatttagaggtggagctcagaccgctagagccaagcccgaggctgaggctttagatgtagttattacaggtacggttcttgtttgtgatagagatgctttagtgttatttgatccagggtctacgtactcgtatgtgtcatcttattttgcaccgtatctggacatgcctagtgattcattgagtgttcctgtatatgtgtctacaccggtgggtgattctattatggtagatcgagtccatcgctcttttatagttgtgattgagggtcttgagactcgtgtagatctgttgcttctggacatggtcgatttctatgttatattggggatggactggttatcaccttaccacgctatcttagactatcatgccaagactgtgaccttagccttatcgggtttacctcgtttagagtggagaggtactcctagtcattctacccgtagtatgggcaatcttgcttatattccgggcggtgagagaccgcttgctttggatgttcgggatttggccaatcaattcatgaggttggatgtctctgagcccagccatgtgctagcttgcacagccgcttgttcttctttattggagcgtatccgtaatcggcagtatgatgatccccatttgtgtgttccttag

SEQ ID NO: 44 - DNA, 654 bp, Nicotiana tabacum
atggttaagtttgggaagagaaccatcttgaaaggtaggctcctcaggaacttagaggaggaaggaatggtaatgcttctggagaagttacaggtgcaaggatggaaggacatggtctttcagatgatggaaggatacaatgactataagaagctcaaatggacaagcctagagaatctccctactgcccttgccagtactagaaaattttgtgacaatgaggaggaaattgagcccaaggctatttacaaaaatgagatgaagccacccaacaaagtgttgctccaatttgtaaacaaatgtgtgctgccaagggttctaaatggaactaagacttatgtcataccctatggttttattctcacgattgttcttgcacatttaaaggtacccatcaagaaatgggaagttggtacaaacaaggatcattttggggctaacactttgactgcttgtaactatgaggctcaaatcactcccaaaaaacctggttcatccaaaaaggtaccagtgaatagcaaagtgcgagttttggtgcaagaaagtagggcaaaggatgctgagcctgataggctaaagaagaggttggctgaaatggagaccgagagagatgctctcagagctgagcttgcaaaagagaatgagaagaattag

SEQ ID NO: 45 - DNA, 1470 bp, Nicotiana tabacum
atggtgaggaattactgcgggtggagcgagggggtaacactgcaggtgctttctccaaataagggtattacagactccactgatggagttttgagcgtatacctataccctttcgcatttggcccccctgctagggttgtgcttgatttttgcttgaagtatcgagttactctggcgcagatttatccatcgtttcggcgaatggtaatgataatgaggttcttcgtggagaaggttgggctcgaattcacgtttaatcacctcgttagactataccggccatttcattatcgaggcctgctaactctgaggtgccgtttgtccacgccctttgttgtcgatgatgaagaagacaaggaccgagagtgggccagttggtttattcaggctcaaactgctgacattatcccaacagggcttttgccatttcctgaagggtggaatcatgcaccaacttcgtggatgccgggcaaagtccttgaccttcccgtctgggtccataagttggcgacccattcgacttgcgacgagcgcaggtggcgagctgtatttcgtaccaaatggggagtgaaataccaagggcggttgtttgggatgagacagtgttcttccgaagaggagaaagagtcgtcagcctccaagccgagggaggatggtgataagggggatcggcacccgcggtattcccgggcggcgattcctccgagtgaatatgctctgcccgaggttggttctcctggggccggagaggcaggatcaacaggaatgtgttctggcttagaggaagtccatcggcttctcttcgaggcctgtgatgggcttatgtctaagctgctctgtcaaggggccaggctccagaaattcttgaacgatggcgagtcctttaggctccttagccaagagaatggggctaagttggcacgttggcgatatgaggcgtatcagagctcaaactatgagagttgtttgatagagcaggtcagagctgagataattaatgcccaggctaaagtggcgctaagccggaccaaggctgatcaggagatggcgattcatatgaaggatgttgctgatgcccaagctgagctaaagcgagccctcgaccgggagaagaggatcgaggagtatgttcgttgcagatctcggagagaggccggttttggtgtttggcgggatcctcgtaggtccggaactggtcggatagacctaggggctcttaagtgtaatcccttacgctttgttttctgctcgttaaggtcttttggaatatttttgcttgacccgtcttcggttctagaggaacttcgatttcaagtcgttgtcggcgatgttttgagcacctcaaaaggtcaaatgagtgagagggttaccaacacatcaatacgaggccgaggcgaagtctcggcgtccctttccttggaagcaagggtgtcctttggaatattccccagaccagtgtttccccggtga

SEQ ID NO: 46 - DNA, 918 bp, Nicotiana tabacum; identical to SEQ ID NO: 26

SEQ ID NO: 47 - DNA, 2718 bp, Nicotiana tabacum
atgggtagaattgaaatgatgttcgaacagatgatgaagaaaaatgcagattctgatgcacagttggctttccacaatacctcaatcagaaatttggaggttcagataggccaaatctctcagtccttgaatacacgccctaagggtgctctaccaagtgatatagtagtaaacccaaagggtgagaacaatcatgttatggcagtaactacaaggagtggacgaggcggtgatgtgaatgcctctaaacaaaagcaagttttgagtgatgatattgagttgcaagaagatgaagttcctttggttgtagaaaatgtgatagatgacaatatgaatgaagaagtgatgattgatattcaagatgccgaggtggaaactcaaaatgacgtgaacccgtctagggaacacgtaatagatatgtcggagctggtggtgcctaaagccaagtatcaatttgattcctactcggttttcaaaattttgtgtattgggcaacctaggccgacttccatgagattacaaatggcggatagaacgatgaagagatcattggatattatcgatgatgtccttatccgggtggacaaatttatcttgccagctgattttgtgatcttggactgtgaggtggattatgaagttcctatcatattggggagatctttccttgctaccgggaaggccttagttcatgtggaagtaggggacctcacctttcgggtgggtgatgaaaaagtggtctttcatgtttacaagtcaatgaaacagcccaacagtaccaaagtgtgctcttttatggacctcgtcacaatagtgataattgatgacaccagtgtaatgatcaatgtggaggactcattggaggccgtattgttgaatcttgatgtcaatgatgatgagggccgagtggagtgcgtgaatgctttacatgggatgggctcttactcttatgaacctaggaaactatctctggatctcgagaataggaagactccaccaacaaagccttcaattgaggagcctccggtgttggatttgaaaccacttccttcacaccttagtgcggcatatggtggaaaaattattcaagtctctgaagttttcaatgcggaccacactacattgtacaatggtgaaacaagaggcaagggttctaaacaaccaggcaggggagagtcctcccggggagggaaacagaagatgctaagattgactccccaagcccgacaaaacattaaaaacacaaggaagctcactaaagctgctgataggtccattgaccagtctgggagtgaatacgagccctcccgagatatatcttcagactcaatcccagagtacatccctgactggccggagagaaacagactaagagacactcttccacctttccccactgtccaagcgtcagtaaatgtatcttctggttcgtctgagggctcagctgaaggtagtggggatgaatactccacctctcccacaacttcattatccgaagagggtgtagtaggggaagaagaggtagtaggagaagggggtcagccccaggttggtagggtagaacgaactagaaatccggaggtgtggcaagaccactttgtgagtgaggtggcctaccataaattcaaagaatggtggcctgtgaggaaattaatttcggagagaatttttgtagatagaaaccttttgcctcacaaccccaatgtgagaaggcaatttagagatagagtgggctgggagtatttcttaaacaattgtgaggatgcaaacgagcacctagtcaaggaattctacaccaatgttgcccacatcaagaagggcaccaaagtgaccaaggtgtgcaatttgaaagtgttgtttgataggaaaacaataaatgactacttggacttcgatgagaaggatgagtcgctgtatttggaaaagatggaattaggtgaggaggtctgtccttggttggcacagtatctggcaaacccaggtatcacccccgattggttgaatgcgggagtgaaaattttgataagaagtttgaatttcgaggccaaggggtgggaaacatttgtgtgtagcagattggaccccactactcatgaaaactcactccctcttcaccgggcagtattggtagcatcaatcatggtagggtacccaattaacgtcgggaaggtgatgtctcgggtgattacacagggtgatgacaacccgaaaggcaagaactacaagggaacatccactgatccaactggcaagtctgaagagccagttgtggtagtggctcctactcatcttgcctccacctcaatggacatccaccctggtccatccattttagcagctctagagataccctctacctcggctcatccagtgactgcacaatgtctaagccagacccttcttagcatcaacagttggatgcagacagcttcctctaagttgtttgccctcactactgcagtagcatctcagtcgacacctccacctctacagtcatatggaaaagctctcaaagagcttgctagggaggccaagaagatgagaaagacgcgggcttccaaggagtccgtgaaggagttgagggttaaggttgataggatgaaggcagaaagacgctttggatttattgctacaagaccctgtgccaacatctcaccctcagctagagcagtcccagaggcctcccaagaggaagaggatgattccccgagcagatga

SEQ ID NO: 48 - DNA, 2421 bp, Nicotiana tabacum
atggctgatgtagcagtgaattttctggtagagaatttgatgcagttgttgagggacaatacagagctaatatttggagtgaaaggtgaggcagagaatctgcttcaagatttgagtgagttcaatgcgtttctgaagcaagcagacaagtcccgcagcgataacgaagttctaaaagaattggtgaagagtatcagaaaagtgacgaatgattctgaagacgctattgataagtttgtaattgaggcaaagcttcacaaggacaaaggggtaggcaggtttgtggacattgcgcattataaaagagtgaaagatgtagcccttgagattaaaggtatcagagatagggtgaaagaaatccgtctgaacaatgcacatggccttcaagctcttcaagatgatgatccatccaacagaggcgtggaagacagaaagcctcccgtggttgaggaagatgatgtggtgggctttgatgaggaggcacagaaggtaatcgaccgtcttcttgacagatcagatgaattagaggttattccagttgtaggaatgcctggtcttggcaaaaccacactagcaactaagattttcaagcatcggaagcaaattcaccggaaaaacaaaacaataccaatatatgtgtgggaacgtatcaagattgctttcccgaacaacaaaaagtgcaatagagtattgttgaccactcgagatcacaaggtggctcatcattgcaacaatactccacatgatttaaaatttcttagcgatgaggaaagttggatgttgctagagaagaaagtttttcacaaggctaaatgtcctccggaattggaaagacctggacagagcatagccaggaagtgtaagggacttccccttgcaattgtggtgattgcaggagctctaatagggaaacgcaagacaacaagggagtgggagcaagtggatcagagtgttggtgaacacctcattaatagaaaccagccaaagaattgtaataaaattggtgcaaatgaaggctttgagatccctgcttggaatttgatccgtttatggatcgccgaaggcttcatccaatacaaagggcccttatcccttgaacgtaaagcagaggattacttgaatgatctcgtcaacagaaacttagtgatgataattcaaaggacgtctgatggacaaatcaaaacatgtcgtgttcatgacatgttgcatgagttttgctggcaagaggccacaacagaagaaaatcttttccaagaggtaaaattaggtgttgggcaatttgctcgtgagatacagcaactatccacctaccgccgcttgtgcattcattcctcagttctggaattcatttctatgaagccctctggtgagcatgttaggtcattcctatgtttttcttcagaaaaaattgacatgcccccggttgacatcccaaacataccaaaagactttccattgctaagggtgttggatgctgaatccatcaaattcagttgcttttgcagggagtttttccaattgtattttctgaggtatattgctttctcatctgactttatcaagatccttcctaaacatattggggaactatggaacgtacaaaccctcattgttaacacacaacagagcaatcttgatattcaagcagacatatggaacatgccacggctgaggcatctgcacactaacacgtccgctaaattgcctacgcctgttgccccaaaaagtagcaaggttacctcggtaaatcaatgcctacaaactctctccacaattgcaccagaaagctgcacagaagaagttttttcaagggctccaaacttgaaaaaactgggcattcgtggtaaaatctttatgcttctggaaccaaataagtccgaattgttcaacaatgttaagaagctacaatgtcttgagaacttgaagctgataaatgttggtcaaagtgggaaacaattacgccttcctccaacatatatatttccgacaaatttgaggaagctaacattattagatacctggttggagtgggatgatatgtctgtattgggccagttagagtaccttgaagtcttgaagctgaaagacaatgcatttaagggagaatactgggaaccaaaagttggaggttttcgttccctactagtgttatggatcgaaaggtcagatttagcttcttggaatgcttcaagtgatcactttccaagacttaagcgtcttgttctcgtatcatgtgataaacttgaggaggtccccattggcttggctgatatacgcggcctccaagttatggagttgcgaaattcaaccaagcaaacagcaaaatctgcccgggatatacaggccaaaaaagacaagcaaactcaagaaggggctaaaacccaaaggttcaagctttctatattccctccttatctctga

SEQ ID NO: 49 - protein, 1847 aa, Nicotiana tabacum
MDLVHQDEDVTAELEVQTPKPKKSKTFSKKSTSMSKSAELSTLAKRTRSTVKTIQAKVTEGEAWSSEEEDESDSEKDKMAKFGKRTILKVLDGRDTSLVKGVQISFDMKELGGILGVHDEGYNNYKKLKWQSLENFPTALAITRKFSDHEKESVPKTVYKSEMKSPHKVLFEFVIKYVLPRVINGTKSHSIPYGFILTTVLSCFKVPLNKCEVATSKDHFGAKTLIACDYEESEAKEAKIARMKTRLAEVESERDALRTKLARQKEKNDGIFQDMLKLLQENNPAPRSSKPKVPSLVWMVLRVAVLVGRDKEKVDGGERCSMSAMCAYLIEPRGLGSDSEAVRGVFDLRKCCRISAVSAQSFSSMRSHRSRSSFWTSAVGFDRELTSVQRHRGSLADRGRGRARGRGRGRAQPRAAVPEVEPHVDYDEEVPAPAAPVGPAQVPEGFIATPVLQDALVRLVGLMERVTRTGLLPVAPATSQAGGGAQTPATRTPEQVAPQIQTPAVQPVGVVQPGAIAQTGDGAAMSADALWRLDRFTKLFTSTFAGASTEDPQDYLDSCHEVLRNMGIVETNGVDFATFRLSGSAKTWWRDYCLARPAGSPSLTWEQFTVLFLEKFLPVTQREAYRRQFERLQQGSMTVTQYETRFIDLARHALIILPTERERVRRFIDGLILPIRLQMAKEAGSEITFQEAANVARRVEMVLSQGGGHGSDKRPRHSGRFSGTSSGGRDSYVLQCTTSSHQCTAASEFPRWSFRRQGQQSQQPRACYTCGDMGHIARFCPRASGSSQQQGPRPMIQAPVAPQPAQPARGGGRGHRGGGRGHRGGAQTARGRGQPAADRPRDVIQGGGAQPRCYALPARPEAESSDVVITGTILVCDRDASVLFDPGSTYSYVSSYFAPYLVMPSEALSIPVYVSTPVGDSIVVDRVHRSCVVVFRGLETRVDLLLLDMVDFDVILGMDWLSPYHAILDCHAKTVTLALPDLPLRVERETPLLFLSSMGSLAYIPVGERPLALDVQALANQLVRLDISEPSRVLACTVARSSLLERIRDRQFDDPHLCVLRDTVQRGGAKQEPRGLGCLFRNGFRLRKIAELLSAGVQSFVLCDRIAISRSSFWTSAVGFDRELTSVQRHRGSLADRGRGRARGRGRGRAQPRAAVPEVEPHVDYDEEVPAPAAPVGPAQVPEGFIATPVLQDALVRLVGLMERVTRTGLLPVAPATSQAGGGAQTPATRTPEQVAPQIQTPAVQPVGVVQPGAIAQTGDGAAMSADALWRLDRFTKLFTSTFAGASTEDPQDYLDSCHEVLRNMGIVETNGVDFATFRLSGSAKTWWRDYCLARPAGSPSLTWEQFTVLFLEKFLPVTQREAYRRQFERLQQGSMTVTQYETRFIDLARHALIILPTERERVRRFIDGLILPIRLQMAKEAGSEITFQEAANVARRVEMVLSQGGGHGSDKRPRHSGRFSGTSSGGRDSYVLQCTTSSHQCTAASEFPRWSFRRQGQQSQQPRACYTCGDMGHIARFCPRASGSSQQQGPRPMIQAPVAPQPAQPARGGGRGHRGGGRGHRGGAQTARGRGQPAADRPRDVIQGGGAQPRCYALPARPEAESSDVVITGTILVCDRDASVLFDPGSTYSYVSSYFAPYLVMPSEALSIPVYVSTPVGDSIVVDRVHRSCVVVFRGLETRVDLLLLDMVDFDVILGMDWLSPYHAILDCHAKTVTLALPDLPLRVERETPLLFLSSMGSLAYIPVGERPLALDVQALANQLVRLDISEPSRVLACTVARSSLLERIRDRQFDDPHLCVLRDTVQRGGAKQVLPSYVRSRTNGCFRGGECDDPKGHHRFSPFFVLPRP

SEQ ID NO: 50 - protein, 1338 aa, Nicotiana tabacum
MERVTRTGLLPVAPATSQAGGGAQTPATRTPEQVAPQIQTPAVQPVGVVQPGAIAQTGDGAAMSADALWRLDRFTKLFTSTFAGASTEDPQDYLDSCHEVLRNMGIVETNGVDFATFRLSGSAKTWWRDYCLARPAGSPSLTWEQFTVLFLEKFLPVTQREAYRRQFERLQQGSMTVTQYETRFIDLARHALIILPTERERVRRFIDGLILPIRLQMAKEAGSEITFQEAANVARRVEMVLSQGGGHGSDKRPRHSGRFSGTSSGGRDSYVLQCTTSSHQCTAASEFPRWSFRRQGQQSQQPRACYTCGDMGHIARFCPRASGSSQQQGPRPMIQAPVAPQPAQPARGGGRGHRGGGRGHRGGAQTARGRGQPAADRPRDVIQGGGAQPRCYALPARPEAESSDVVITGTILVCDRDASVLFDPGSTYSYVSSYFAPYLVMPSEALSIPVYVSTPVGDSIVVDRVHRSCVVVFRGLETRVDLLLLDMVDFDVILGMDWLSPYHAILDCHAKTVTLALPDLPLRVERETPLLFLSSMGSLAYIPVGERPLALDVQALANQLVRLDISEPSRVLACTVARSSLLERIRDRQFDDPHLCVLRDTVQRGGAKQEPRGLGCLFRNGFRLRKIAELLSAGVQSFVLCDRIAIWRGHALPHRPRSSPSPQQQLLLGAEGEARPRGRGRGRAQPRAAVPEVEPHVDYDEEVPAPAAPVGPAQVPEGFIATPVLQDALVRLVHQALHFYFCGASTEDPQDYLDSCHEVLRNMGIVETNGVDFATFRLSGSAKTWWRDYCLARPAGSPSLTWEQFTVLFLEKFLPVTQREAYRRQFERLQQGSMTVTQYETRFIDLARHALIILPTERERVRRFIDGLILPIRLQMAKEAGSEITFQEAANVARRVEMVLSQGGGHGSDKRPRHSGRFSGTSSGGRDSYGRGHPPRPFQSALQVSHGISGGRGSQTHYLDQQSFSAPPAPISAPPLQSFRGGHSGRQGQQSQQPRACYTCGDMGHIARFCPRASGSSQQQGPRPMIQAPVAPQPAQPARGGGRGHRGGGRGHRGGAQTARGRGQPAADRPRDVIQGGGAQPRCYALPARPEAESSDAVITGTILVCDRDASVLFDPGSTYSYVSSYFAPYLVMPSEALSIPVYVSTPVGDSIVVDRVHRSCVVVFRGLETRVDLLLLDMVDFDVILGMDWLSPYHAILDCHAKTVTLALPDLPRLEWRGTPGHSTRSVISLAYIPVGERPLALDVQALANQLVRLDISEPSRVLACTVARSSLLERIRDRQFDDPHLCVLRDTVQRGGAKQVLPSYVRSRTNGCFRGGECDDPKGHHRFSPFFVLPRP

SEQ ID NO: 51 - protein, 494 aa, Nicotiana tabacum
MARTRASLSTEQQPEPPAAAPIRGRGRGHARGRGRGRAQPRAAVPEVEPHVDYDEEVPAPVTLVGLTQVPEGFIATLVLQDALVQLVGLMERVTRICFLPVAPATSLAGGGAQTPSTRTPEFTKLFTSTFAGAFTEDPQDYLESFHEVLRNMGIIETNGVDFATFRLSGSAKTWFNDLARHALIILPTERERVRRFIDGLILPIRLQMAKEGGSEITFQEAVNVARIVEMVMSYGGGHRSDKRPRHSGRFCGIASGGRDSYGRGHPPRLVQSAHQPAQPARGGGRGHRGGGRGHRGGAQTARGTILVCDRDASVLFDPGSTYSHVSSYFAPYLVIRSEALSIPVYVSTLVGDSIVVDWVHRSCVVVFRGLETRVDLLLLDMVDFDIILGMDWLSPYHAILDCHAKIVTLALSDFPHLEWRGTPGHSTRSVISYVKARCMVEKGCLAYSAYVRDSSAEIPSIDSVTLSCLYSGRRETSCFGRSGFGQSVNEVGYF

SEQ ID NO: 52 - protein, 1325 aa, Nicotiana tabacum
MERVTRTGLLPVAPATSQAGGGAQTPATRTPEQVAPQIQTPAVQPVGVVQPGAIAQTGDGAAMSADALWRLDRFTKLFTSTFAGASTEDPQDYLDSCHEVLRNMGIVETNGVDFATFRLSGSAKTWWRDYCLARPAGSPSLTWEQFTVLFLEKFLPVTQREAYRRQFERLQQGSMTVTQYETRFIDLARHALIILPTERERVRRFIDGLILPIRLQMAKEAGSEITFQEAANVARRVEMVLSQGGGHGSDKRPRHSGRFSGTSSGGRDSYVLQCTTSSHQCTAASEFPRWSFRRQGQQSQQPRACYTCGDMGHIARFCPRASGSSQQQGPRPMIQAPVAPQPAQPARGGGRGHRGGGRGHRGGAQTARGRGQPAADRPRDVIQGGGAQPRCYALPARPEAESSDVVITGTILVCDRDASVLFDPGSTYSYVSSYFAPYLVMPSEALSIPVYVSTPVGDSIVVDRVHRSCVVVFRGLETRVDLLLLDMVDFDVILGMDWLSPYHAILDCHAKTVTLALPDLPLRVERETPLLFLSSMGSLAYIPVGERPLALDVQALANQLVRLDISEPSRVLACTVARSSLLERIRDRQFDDPHLCVLRDTVQRGGAKQEPRGLGCLFRNGFRLRKIAELLSAGVQSFVLCDRIAISRSSFWTSAVGFDRELTSVQRHRGSLADMARTRASSSTAQQPEPPAAAPIRGRGRGRGPEAEAGAELSPEQQFQSSSGRPGSIGGPYGESHPNRFASCSTSHFSGWRRGSDSCYTHSGAGSSPDSDSSGSASWVVQPGAIAQTGDGAAMSADALWRLDRFTKLFTSTFAGASTEDPQDYLDSCHEVLRNMGIVETNGVDFATFRLSGSAKTWWRDYCLARPAGSPSLTWEQFTVLFLEKFLPVTQREAYRRQFERLQQGSMTVTQYETRFIDLARHALIILPTERERVRRFIDGLILPIRLQMAKEAGSEITFQEAANVARRVEMVLSQGGGHGSDKRPRHSGRFSGTSSGGRDSYGRGHPPRPFQSALQVSHGISGGRGSQTHYLDQQSFSAPPAPISAPPLQSFRGGHSGRQGQQSQQPRACYTCGDMGHIARFCPRASGSSQQQGPRPMIQAPVAPQPAQPARGGGRGHRGGGRGHRGGAQTARGRGQPAADRPRDVIQGGGAQPRCYALPARPEAESSDAVITGTILVCDRDASVLFDPGSTYSYVSSYFAPYLVMPSEALSIPVYVSTPVGDSIVVDRVHRSCVVVFRGLETRVDLLLLDMVDFDVILGMDWLSPYHAILDCHAKTVTLALPDLPRLEWRGTPGHSTRSVISLAYIPVGERPLALDVQALANQL

SEQ ID NO: 53 - protein, 706 aa, Nicotiana tabacum
  MOD_RES (122)..(135): Any amino acid
  See specification as filed for detailed description of substitutions and preferred embodiments
MAYPAVNSLIQTLELFQKTYPALIHGQTAEMIDSLHASAEYFQNILENASHQKQEYDTFKYFEAEIRSAMHQAEDVLESNVRRINSFSTETYARCLGPPDDEDHFFKKGHSLVAGSSSNLAXXXXXXXXXXXXXXVGLANSLRKLTDALLGLASEQNVIPILGMGGCGNTTLAKKAQDDQSIRSHFDIQTWVTISQEYHLNEVLPSLARSLTGYEFQGMSDDQLMDQSYKALKGRKYLIVVDDIWSTKIWDLIARTLPDDNNGSRIILTTRLKDVAEYANPDIPPLEVLPLGVDESWKLLQNKLLGKSHINCHSELEDIGKKIVQKCQGLPLAILVVAGHLSRISPKRENWVTVSENVNEVVTSYPNECIAVLAISYHHLPIHLKPCFLHMGAFPEDSEIDAWRLIRLWVAEGFLKRDKLRSLEKVAEDCLEDLASRNLIMVKRGKLNGRIKNLPLHTRISGENFTKSAKFLRCLYLFKEPHKTIGKPLEFKALRVLAAIPSFVHHNLEWRGILTLPNHIWNMKQLRHLRLHGSTYLPNPYVVDELGLQHLQELSSLCLASCTKERLTLSGSWLPWEDMANLAKLPNLQLLKLRCHAFRGEVWKLKEEDEFKQLKFLLLDDTETQLWEATNVNFPNLQRLVLEKIKILRRIPIAFADTYTLESIELYKCGLIVDSAREIQEEVAAMAGSDCLALRIYIYEGNDFQN

SEQ ID NO: 54 - protein, 309 aa, Nicotiana tabacum
MARTHASSSIDKQPEPPAAAPTRGRGRGRGRGRAQPRAAAPAAEPQVEFDDEVTTQEVPVGLAHVSEGFIATPVLQDALMAPQFQTLTTQPVGAVQPDVVAQTGDRAAMSVDALWRLDRFTKLFTTTFSGASLEDPQDYLDRCHEVLRNMGILETNGIDFATFCLSGFAKTCTRPGLLIWPVMIYLYSPLRERVRRFIEGLIQPIRLQMDEETGSEISFQEVANVARRVEMVLSQRGGQESDKRPRHSGRFSGASSGGKDLYGRGQPSRLFHSALQVSHGASGGCGPHMQYSDQQSYSAPPTPISAPSL

SEQ ID NO: 55 - protein, 444 aa, Nicotiana tabacum
MVRTRATGRGGRPPVPPAETTRGRGRGRGRGRGRAARAAPVDPPAALAPDQAPAMDAPAAPVQAPAVPIVIPGLQEALAQILSVCTGLAQAVSATTAAATSQAGGNQTPAARTPEQVVQGLQTPGAPPAQPVAPAQEFVVPVMPDDEQRLLRGLVDSSLRHSVVLRARMPRVFLDKCQRMLRTAGILESSGVAFTTFQFTGAAFTWWEAYERRRPVGAAPLTWQQFSTLFLEKYVPQSRREELRRQFEWLRQGDMTVSQYESRFSELARHAIWMVPTDRERIRRFVDGLNYHLRILMTRERVLGATFEEVVDIAREIETVRRQDREEREAKRPRGGSYSGAPSRGQFQHGRGRSFRPAQSARPGYRGASSGHGYHGSQQGQSSLSALPAQSSSRAPSAQGSSMPSASAGHSGARGSLQSPSPAPGSCFECGEFGHMWRQCPRRC

SEQ ID NO: 56 - protein, 377 aa, Nicotiana tabacum
MGIVETNGVDFATFRLSGSAKTWWRDFCLARPAGSPALTWEQFTQLFLEKFLPITQREAYRRQFERLQQGSMTVTQYETRFIDLARHALHTSHREREGGGQCGQESGDGSVAGRWSWVDKRPRHSGRFSGTSSGGRDSYGRGHPPRPFQSALQVSHGASGGRGSQMQYSDQQSYSAPPAPISAPPLQSFRGGHSGRRVSQFPQQHSGGCFECGDMVISLSAAGFPCYGSGTRCSTAAQPARGGGREVLEVELRGGGQPAAGHPRDVVQGGGPSPDVMLFQPGLRLRLPMQLSQALANQFVRLDVSEPSRVLACTVARSSLLERIRDRQYDDPHLCVLRDTVQHGGAKQVTLGTSVRSRTNGCFRGGECDDPKGHHLF

SEQ ID NO: 57 - protein, 412 aa, Nicotiana tabacum
MVKTSKMAPQKVTSSSQPTTKIDETTPDVVDLERYAADVVTDEPAIEPPLKMFIPEGCLVADDFKLGAASGEKKKKKKRKALGSPSSEKKKPKRRLAYKPKDSSSSRAPDSDLLYWLREEHEEDDLFTAYEPTSPKERAIAEEETTKACLSQVRETDVETRAQPSRDAGSAPPSIKEISGSPSFTESMLDKARAEKERYNEGAYGVDDPLRCLFEGVDSTALKDFSGWVIWSCRDYLWRLWYFIIKIFSGTSLRLTSSRLRSRSLLRRGTHISFSARNIRKRSRVFEQSRTRVQLRVAKEKENACARQIDDLHAQLGSAAAKRDTFRKELESVKSVSEITRGDAEEMVAQYRADVEGFYLLAEIEDAKRLEAEAKKLADPKDGEGYEGSGDPEDGEDPDNPTNEVGSGEDRA

SEQ ID NO: 58 - protein, 559 aa, Nicotiana tabacum
  MOD_RES (502)..(515): Any amino acid
  See specification as filed for detailed description of substitutions and preferred embodiments
MARTRASSSTAQQPEPPAAAPTRGRGRGRARGRGRGRVQPRAAAPVAEPQVDFEEEVPAPAVPVGPAQVPEGFIATPVLQDALVRLVGLMESVTRAGLLPVAPATSQAGGGAQTPATRTPEQVAPQIQTPAVQPVGAVQPGVVAQTGDGAAMSADALWRLDRNMGIVETNGVDFATFRLSGSAKTWWRDYCLARPAGSPSLTWEQFTVLFLEKFLPVTQREAYRRQFERLQQGSMTVTQYETRFIDLARHALVILPTERERVRRFIDGLIQPIRLQMAKEAGSGRGPPIQYSDQQSFSAPPAPISAPPLQSFQGRQPQQPRACFTCGDTRHIARYCPRASSSSPHQGSRAMVQAPDVPQPAQPARARGGGRGPRGGAQAARGGGQPAAGRPREVVQGGGAQPRCYALPARPEAEASDAVITGTVLVCDRDASVLFDPGSTYSYVSSYFAPYLVMPSDSLSIPVYVSTPVGDSIVVDRVHRSCVVVIGGLETRVDLLLLDMVXXXXXXXXXXXXXXHAILDCHAKTVTLALPVLLIFRSVRGRLLGCSGFGQSICEVGYF

SEQ ID NO: 59 - protein, 666 aa, Nicotiana tabacum
  MOD_RES (544)..(557): Any amino acid
  See specification as filed for detailed description of substitutions and preferred embodiments
MARTRASSSTAQQPEPPAAAPTRGRGRGRARGRGRGRVQPRAAAPVAEPQVDFEEEVPAPAVPVGPAQVPEGFIATPVLQDALVRLVGLMESVTRAGLLPVAPATSQAGGGAQTPATRTPEQVAPQIQTPAVQPVGAVQPGVVAQTGDGAAMSADALWRLDRFTKLFTTTFSGASSEDPQDFLYSCHEREAYRRQFERLQQGSMTVTQYETRFIDLARHALVILPTERERVRRFIDGLIQPIRLQMAKEAGSEITFQEAANVARRVEMVLSQGGGQGSDKRPRHSGRFSGTSSGGRDSYGRGHPPRPFQSALQAFHGASGGRGPPIQYSDQQSFSAPPAPISAPPLQSFQGRQPQQPRACFTCGDTRHIARYCPRASSSSPHQGSRAMVQAPDVPQPAQPARGGGRGARGGGRGPRGGAQAARGGGQPAAGRPREVVQGGGAQPRCYALPARPEAEASDAVITGTVLVCDRDASVLFDPGSTYSYVSSYFAPYLVMPSDSLSIPVYVSTPVGDSIVVDRVHRSCVVVIGGLETRVDLLLLDMVXXXXXXXXXXXXXXHAILDCHAKTVTLALPASMGSLAYIPVGERPLALDVQALANRFVRLDISEPSRVLACTVARSSLLERIRDRQFDDPHLCVLRDTVQRGGAKQVTLGTSFFCPFEDERLF

SEQ ID NO: 60 - protein, 271 aa, Nicotiana tabacum
MEIDLNIQELLVIDDSDLLMHQVQGEWATKNSKILPYLHHVQELRKRFMKIEFRHVPRIQNEFVDAVATLSSMIQHPYKNYIDPIPVKIHNQSAYCAHVEEEIDGKPWFHDIKKYLSKGEYLEHANHTQKCTLQRFYNHFFHGGGNLYRRTPDLGFLRCVDAKEASKLLEDVHAGTCGLHMNGFVLAKKILRVGYFWMTMETDCIHVPRPNLSEHNVQSFQLKGQTKAIYTRVLTGGAPILAKIDGAIWPKPINSDAIKRYDAWIIYIFLI

SEQ ID NO: 61 - protein, 395 aa, Nicotiana tabacum
MVKQQGKGSKQPGRGESSLGGKQKMVKLTPQARQNIKNIRKAIKVADKDIDISGTQASVNISSRSSEGSPAGSRDEYSTTPTASLSEEGVVGDEEEVGGDDEVEEGGEPQEWWPVRKLIPERSFIDSDLLPHNPNMRRQFRMRVGWDHFLDKCEDSNEHLVKEFYSNVAHIKKGSKVTKVQNWKVLFDGKYINEYLSFNERTRPYTWQIWKWERSRLDPTTHDNAFPLHRAVLVTSIMVGYPINMGNVMSRIITIVGAEHDRNNPFPSFLTEYFRDLKVDERPYDIKVKEIAPFSWYSMKGDNNPKSKNYKAHASAPIVQSKDPVMVEVPAEPTSTPADISPGPSTSTAIPAGLSTSAGPEIPSYWAHHITTHRLSQALLNFNNWMKTASSKLSI

SEQ ID NO: 62 - protein, 510 aa, Nicotiana tabacum
MAEKTSDLFASMEMSRFYTTDPYMEPFILTEPSSPSTTLAAAVTPSPISQYLPNSETFKTTILFSPSSVVPTNQTLSGEQGYAIADTTGASHEEPDPSPEDPVEVEEGTPEEPGSLVRRSLKKTKPVSIEKGSTSKSKKKEVVSEFSMSDEDVLVKSKAKGKVSGEKFGKRKSESFDEPSSMKKMRSEVSLGSELLRHQKVLLGRMFDPTISDMAGMRQILEMVEFQRWVHLFHMDAPKVYEEEVQSFFASLFPVDTDHVYALVNGVDIVFDVKLLGEILKVPTVRVLSVRDVFMLPRAERRLVTSKSDLFLMEQLDGFNPMILPAIMIEHMQKVSTFKDGNHGLPYGFFLTPVFKFFKVPLGIAEEIHRLKAMNVILEDQQAQGVPMSNDEVACLTQENANLRAQVENLKAELLNEQKSANTLIDLVLQAFSAATNPFTPSALKYPFSDQFSGYVSYVFVSLLMSQLDTTRNEVTGVTVSAVLHCPPTHSLTKQSTHIISSDVIKMYPQ

SEQ ID NO: 63 - protein, 309 aa, Nicotiana tabacum
MQYSDQQSYSAPPAPISALLLQSFRGGYSGRQGQSQFPQPQHLGGCFECGEYGYIRRTCPRLVGTQSQQQGFRAMVGAPGFPQTTQPARGSRCGGRGFRGGAQTARAKPEAEALDVVITGTVLVCDRDALVLFDPGSTYSYVSSYFAPYLDMPSDSLSVPVYVSTPVGDSIMVDRVHRSFIVVIEGLETRVDLLLLDMVDFYVILGMDWLSPYHAILDYHAKTVTLALSGLPRLEWRGTPSHSTRSMGNLAYIPGGERPLALDVRDLANQFMRLDVSEPSHVLACTAACSSLLERIRNRQYDDPHLCVP

SEQ ID NO: 64 - protein, 217 aa, Nicotiana tabacum
MVKFGKRTILKGRLLRNLEEEGMVMLLEKLQVQGWKDMVFQMMEGYNDYKKLKWTSLENLPTALASTRKFCDNEEEIEPKAIYKNEMKPPNKVLLQFVNKCVLPRVLNGTKTYVIPYGFILTIVLAHLKVPIKKWEVGTNKDHFGANTLTACNYEAQITPKKPGSSKKVPVNSKVRVLVQESRAKDAEPDRLKKRLAEMETERDALRAELAKENEKN

SEQ ID NO: 65 - protein, 489 aa, Nicotiana tabacum
MVRNYCGWSEGVTLQVLSPNKGITDSTDGVLSVYLYPFAFGPPARVVLDFCLKYRVTLAQIYPSFRRMVMIMRFFVEKVGLEFTFNHLVRLYRPFHYRGLLTLRCRLSTPFVVDDEEDKDREWASWFIQAQTADIIPTGLLPFPEGWNHAPTSWMPGKVLDLPVWVHKLATHSTCDERRWRAVFRTKWGVKYQGRLFGMRQCSSEEEKESSASKPREDGDKGDRHPRYSRAAIPPSEYALPEVGSPGAGEAGSTGMCSGLEEVHRLLFEACDGLMSKLLCQGARLQKFLNDGESFRLLSQENGAKLARWRYEAYQSSNYESCLIEQVRAEIINAQAKVALSRTKADQEMAIHMKDVADAQAELKRALDREKRIEEYVRCRSRREAGFGVWRDPRRSGTGRIDLGALKCNPLRFVFCSLRSFGIFLLDPSSVLEELRFQVVVGDVLSTSKGQMSERVTNTSIRGRGEVSASLSLEARVSFGIFPRPVFPR

SEQ ID NO: 66 - protein, 305 aa, Nicotiana tabacum
MRRSRRTSNLFPLDPEIERSLHRERKELEARYKTERELGILVQPQPIVMAGNGGRSVIEARRPNLANMTQAIVKPDITDYFELKQYTVQLIQSTRQYVGLSHEDPQRHIQNFLEITDTYNYPNVSKDYVRLTLFPFSLLGEAKEWLQKEPANSIHTWDDLSKKFLIKFFPTKKTKPLRSQILGFQQRDGETLRQAWERYKKLLRDCPHHCQTDELLGHTFVDGLDETSKMNLDSACGRSCMARLYSEIQLLLNNFTVNDHNWQGEGEPRRAMKQKAAGVLELDDFSAMRADIAKLANQMNRMTMN

SEQ ID NO: 67 - protein, 905 aa, Nicotiana tabacum
MGRIEMMFEQMMKKNADSDAQLAFHNTSIRNLEVQIGQISQSLNTRPKGALPSDIVVNPKGENNHVMAVTTRSGRGGDVNASKQKQVLSDDIELQEDEVPLVVENVIDDNMNEEVMIDIQDAEVETQNDVNPSREHVIDMSELVVPKAKYQFDSYSVFKILCIGQPRPTSMRLQMADRTMKRSLDIIDDVLIRVDKFILPADFVILDCEVDYEVPIILGRSFLATGKALVHVEVGDLTFRVGDEKVVFHVYKSMKQPNSTKVCSFMDLVTIVIIDDTSVMINVEDSLEAVLLNLDVNDDEGRVECVNALHGMGSYSYEPRKLSLDLENRKTPPTKPSIEEPPVLDLKPLPSHLSAAYGGKIIQVSEVFNADHTTLYNGETRGKGSKQPGRGESSRGGKQKMLRLTPQARQNIKNTRKLTKAADRSIDQSGSEYEPSRDISSDSIPEYIPDWPERNRLRDTLPPFPTVQASVNVSSGSSEGSAEGSGDEYSTSPTTSLSEEGVVGEEEVVGEGGQPQVGRVERTRNPEVWQDHFVSEVAYHKFKEWWPVRKLISERIFVDRNLLPHNPNVRRQFRDRVGWEYFLNNCEDANEHLVKEFYTNVAHIKKGTKVTKVCNLKVLFDRKTINDYLDFDEKDESLYLEKMELGEEVCPWLAQYLANPGITPDWLNAGVKILIRSLNFEAKGWETFVCSRLDPTTHENSLPLHRAVLVASIMVGYPINVGKVMSRVITQGDDNPKGKNYKGTSTDPTGKSEEPVVVVAPTHLASTSMDIHPGPSILAALEIPSTSAHPVTAQCLSQTLLSINSWMQTASSKLFALTTAVASQSTPPPLQSYGKALKELAREAKKMRKTRASKESVKELRVKVDRMKAERRFGFIATRPCANISPSARAVPEASQEEEDDSPSR

SEQ ID NO: 68 - protein, 806 aa, Nicotiana tabacum
MADVAVNFLVENLMQLLRDNTELIFGVKGEAENLLQDLSEFNAFLKQADKSRSDNEVLKELVKSIRKVTNDSEDAIDKFVIEAKLHKDKGVGRFVDIAHYKRVKDVALEIKGIRDRVKEIRLNNAHGLQALQDDDPSNRGVEDRKPPVVEEDDVVGFDEEAQKVIDRLLDRSDELEVIPVVGMPGLGKTTLATKIFKHRKQIHRKNKTIPIYVWERIKIAFPNNKKCNRVLLTTRDHKVAHHCNNTPHDLKFLSDEESWMLLEKKVFHKAKCPPELERPGQSIARKCKGLPLAIVVIAGALIGKRKTTREWEQVDQSVGEHLINRNQPKNCNKIGANEGFEIPAWNLIRLWIAEGFIQYKGPLSLERKAEDYLNDLVNRNLVMIIQRTSDGQIKTCRVHDMLHEFCWQEATTEENLFQEVKLGVGQFAREIQQLSTYRRLCIHSSVLEFISMKPSGEHVRSFLCFSSEKIDMPPVDIPNIPKDFPLLRVLDAESIKFSCFCREFFQLYFLRYIAFSSDFIKILPKHIGELWNVQTLIVNTQQSNLDIQADIWNMPRLRHLHTNTSAKLPTPVAPKSSKVTSVNQCLQTLSTIAPESCTEEVFSRAPNLKKLGIRGKIFMLLEPNKSELFNNVKKLQCLENLKLINVGQSGKQLRLPPTYIFPTNLRKLTLLDTWLEWDDMSVLGQLEYLEVLKLKDNAFKGEYWEPKVGGFRSLLVLWIERSDLASWNASSDHFPRLKRLVLVSCDKLEEVPIGLADIRGLQVMELRNSTKQTAKSARDIQAKKDKQTQEGAKTQRFKLSIFPPYL

SEQ ID NO: 69 - DNA, 3831 bp, Artificial Sequence
  Description of Artificial Sequence: Synthetic polynucleotide
  misc_feature (1)..(522): pCSVM promoter
  misc_feature (529)..(1221): g100614_Scaffold0002504 RNAi construct
  misc_feature (1228)..(1512): NOS terminator I
  misc_feature (1513)..(2741): ACTII Promoter
  misc_feature (2742)..(3616): NPT II Kanamycin Resistance
  misc_feature (3617)..(3831): NOS terminator II
aagcttccagaaggtaattatccaagatgtagcatcaagaatccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtggatccatgtccacaaacctgcctacccctttgtccttgtgaagctttgcctcaattacaaacttatcaatagcgtcttcagaatcattcgtcacttttctgatactcttcaccaattcttttagaacttcgttatcgctgcgggacttgtctgcttgcttcagaaacgcattgaactcactcaaatcttgaagcagattctctgcctcacctttcactccaaatattagctctgtattgtccctcaacaactgcatcaaattctctaccagaaaataataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccattttctggtagagaatttgatgcagttgttgagggacaatacagagctaatatttggagtgaaaggtgaggcagagaatctgcttcaagatttgagtgagttcaatgcgtttctgaagcaagcagacaagtcccgcagcgataacgaagttctaaaagaattggtgaagagtatcagaaaagtgacgaatgattctgaagacgctattgataagtttgtaattgaggcaaagcttcacaaggacaaaggggtaggcaggtttgtggacattctagactcgacgaactgacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactatgataaattatcgcgcgcggtgtcatctatgttactagatcgggaattcctcgagcaactatttttatgtatgcaagagtcagcatatgtataattgattcagaatcgttttgacgagttcggatgtagtagtagccattatttaatgtacatactaatcgtgaatagtgaatatgatgaaacattgtatcttattgtataaatatccataaacacatcatgaaagacactttctttcacggtctgaattaattatgatacaattctaatagaaaacgaattaaattacgttgaattgtatgaaatctaattgaacaagccaaccacgacgacgactaacgttgcctggattgactcggtttaagttaaccactaaaaaaacggagctgtcatgtaacacgcggatcgagcaggtcacagtcatgaagccatcaaagcaaaagaactaatccaagggctgagatgattaattagtttaaaaattagttaacacgagggaaaaggctgtctgacagccaggtcacgttatctttacctgtggtcgaaatgattcgtgtctgtcgattttaattatttttttgaaaggccgaaaataaagttgtaagagataaacccgcctatataaattcatatattttcctctccgctttgaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaaggtaataggaactttctggatctactttatttgctggatctcgatcttgttttctcaatttccttgagatctggaattcgtttaatttggatctgtgaacctccactaaatcttttggttttactagaatcgatctaagttgaccgatcagttagctcgattatagctaccagaatttggcttgaccttgatggagagatccatgttcatgttacctgggaaatgatttgtatatgtgaattgaaatctgaactgttgaagttagattgaatctgaacactgtcaatgttagattgaatctgaacactgtttaaggttagatgaagtttgtgtatagattcttcgaaactttaggatttgtagtgtcgtacgttgaacagaaagctatttctgattcaatcagggtttatttgactgtattgaactctttttgtgtgtttgcagctcataaaaggtaccaaacaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttttgagcgggactctggcgatcgccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggactagt

SEQ ID NO: 70 - DNA, 3831 bp, Artificial Sequence
  Description of Artificial Sequence: Synthetic polynucleotide
  misc_feature (1)..(522): pCSVM promoter
  misc_feature (529)..(1221): g100631_Scaffold0002504 RNAi construct
  misc_feature (1228)..(1512): NOS terminator I
  misc_feature (1513)..(2741): ACTII Promoter
  misc_feature (2742)..(3616): NPT II Kanamycin Resistance
  misc_feature (3617)..(3831): NOS terminator II
aagcttccagaaggtaattatccaagatgtagcatcaagaatccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtggatccttgattgatcatcttgagcctttttagcaagtgtggtattgccacatccacccattcccaaaataggaatgacgttctgctcagaagctaatccaagtagtgcatcagtgagttttctcaaggaattcgccaaaccgactgtatcatcatcatcatcatcatcacctagaagggaagtaggagcaaggtttgaagaagaaccagctaccagagaatgtccctttttgaagaaatgatcctcatcatcaggggggccaaggcaacgagcattaataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccaatgctcgttgccttggcccccctgatgatgaggatcatttcttcaaaaagggacattctctggtagctggttcttcttcaaaccttgctcctacttcccttctaggtgatgatgatgatgatgatgatacagtcggtttggcgaattccttgagaaaactcactgatgcactacttggattagcttctgagcagaacgtcattcctattttgggaatgggtggatgtggcaataccacacttgctaaaaaggctcaagatgatcaatcaatctagactcgacgaactgacgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactatgataaattatcgcgcgcggtgtcatctatgttactagatcgggaattcctcgagcaactatttttatgtatgcaagagtcagcatatgtataattgattcagaatcgttttgacgagttcggatgtagtagtagccattatttaatgtacatactaatcgtgaatagtgaatatgatgaaacattgtatcttattgtataaatatccataaacacatcatgaaagacactttctttcacggtctgaattaattatgatacaattctaatagaaaacgaattaaattacgttgaattgtatgaaatctaattgaacaagccaaccacgacgacgactaacgttgcctggattgactcggtttaagttaaccactaaaaaaacggagctgtcatgtaacacgcggatcgagcaggtcacagtcatgaagccatcaaagcaaaagaactaatccaagggctgagatgattaattagtttaaaaattagttaacacgagggaaaaggctgtctgacagccaggtcacgttatctttacctgtggtcgaaatgattcgtgtctgtcgattttaattatttttttgaaaggccgaaaataaagttgtaagagataaacccgcctatataaattcatatattttcctctccgctttgaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaaggtaataggaactttctggatctactttatttgctggatctcgatcttgttttctcaatttccttgagatctggaattcgtttaatttggatctgtgaacctccactaaatcttttggttttactagaatcgatctaagttgaccgatcagttagctcgattatagctaccagaatttggcttgaccttgatggagagatccatgttcatgttacctgggaaatgatttgtatatgtgaattgaaatctgaactgttgaagttagattgaatctgaacactgtcaatgttagattgaatctgaacactgtttaaggttagatgaagtttgtgtatagattcttcgaaactttaggatttgtagtgtcgtacgttgaacagaaagctatttctgattcaatcagggtttatttgactgtattgaactctttttgtgtgtttgcagctcataaaaggtaccaaacaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttttgagcgggactctggcgatcgccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggactagt

SEQ ID NO: 71 - DNA, 72 bp, Nicotiana tabacum
aaaaaaaaaaaaaaaaaaaaaaaaaaaaaaaaaaaaaaaaaaaaaaaaaaaaaaaaaaaaaaaaaaaacttt

SEQ ID NO: 72 - DNA, 66 bp, Nicotiana tabacum
atgccatgtggtttatattattggcacgtgagttgtccgtgcgagtccagatatttatactatagc

SEQ ID NO: 73 - DNA, 133550 bp, Nicotiana tabacum
aaatttctaagattatttatttatacattaaatgaattttaaattgggtagatttatcagttcatttcgtatcagcttttgattttaatagagccccaatattgacgggtatattccacatatcaaaacattgttaaaaagagggtctttatacattttacttttgattatgattttaaaaatatataccattatgctttaggtttgaactccactaggtcaagggtaaaaatgagacgattttctaaaataaccgtatgaatagtcccaaagtataatgaatggtaaaattaaaatatttcctataataatatggtaactttttacccttttctaacatttattagttttactaaaaatattcaaattatttcttaacaatgattttgaaaagtattcagttaaaatagtaaggtctagccagttttcggactggtcattcaaaaatagtcagcgtttgtcaagtcattaaaaaatagccactatgtttgctgcaacagagatcgattcagcataatatactggagttcggtgcacctgtatatgaacttctagcatattatgctggaccggtatactttgttggctccagtataatatactggagactggagcaccggtgctccaaactccagtatattatgctggaccagtataatatactggaactccagtatattatgctgcagtatttttccggattttgaacaatgttttcatttagatttatctttacatgaaaaatggctaaattttaattacttttgaaactgtgactatttttaaatgaccacttgtaaatctagctatttttgaatttcttccgaatttaaagtattgacaacgtaaccccctcttattctcattcacaactatgtcgaagttgtttttttactcgtctgtcatcatcacatatatttggtggtaatgtgatcttctggtcattacagaatttgggagaaatgaaatatttggaactctcttttatatctttcacattggaaacccaatttttaaatatcatttagattgggaactacaaactttcttccgttttaagggaaattactagtctaaaagaagaaaaaaggatgagaagaaattcactttcaatttaaaataggtcgttgaagcctttattgaaaaagagagagatacagaaaatgaaagaatactaatatatttcaatgttcagaattgtaggatttaaaagctatttatacaagcaaaggagtctcaattatctcctgattactagcctactaattgctagacaaatatccctgaaattgggcagctaatttgctctacaatttgactgttaggcataatgggagatccctgagattgggctcttaaataaggtatagtcaacaccctcccgcaaactaatgctatgtatcacaaagcatgagtttggatagaagataattgtgtcgacttcttggcatagcctttgtgaacaaatctgctagttgatctttaattagatgatatataccttaggttaatgctccgatcttcaaccagttctctgatgtagttgccgtctacgtctatgtgctttgtattttcatgatgaacgaggttggttgctattcgaattgcattggtattgtctacatacaatatggttgatccttcgatcttgatgtcaagttctgataatagccttcgtagccaaatgatttcaaagcatgcaacaaacatacttctatattctgcctctgtggatgacttcgatgttcaggattgtttcttacacttccatgagatcatgcacgagacaagcatcatgtaccagcatgtagtagatcatcttgaatcagggcatccagcccaatctgcatcagcatatcccaccatgtccagcgatgaatatgatggaaataagagacttcgattcacaataccccttatgtatctaataaccctgagcaaagctgagtagtggatcttaaaagtcttagtgatgaattaacttaacacgtgtactgcataagagatatcatgacgactcatggtaagatatataagtgacccaaccaaacgtctatacaaagtttgatctccaaaatgttctccttcctcttttttgtatttcgtattcacttccattggagtatgaaccttcttatcatctgtgagattagttaactgaagatcttctgcatacttttgcggactcaatcgtatgacttctaatagttaactttagctttcctaggtccttcatcttgaacaaggagtctaatagttttttcagatgagagattccaacttcatcattttctgtgataatcacatcatctatgtaaataaggagaatagtaatatctgagctggaccgacgtaggaataatgaataatctgagatgctctgagtaaaaccagcacctaggatttttgtccgaaatttttcaaaccaagagcgaggagtctgctttaatccatacaaagatttttttaagacgacacacctaatttgcgctagaatgtttataacctggtagtggattcatatagaccacttcttgcaagtctccgtgcatgaaaacattcttgacgtccagttgatgtaactttcaactttttattgacgcgaaagcaagcaatatacatattgtcgtcatcttagctaccggagcaaatattttatcatagccaattccatatttctatttgtacccttgagccaccaatcttgccttgtatcgatatagggatccatcagctttcatcttgattgagtacacccatctacttacaataattattgcatttttcggtctctccaccatatccccgtgtatcatttttctcaaggacaaccaattcttcatgcattgcatcctcccagcatttctgaccacttgcctgcatataagaacttggcacaaccatagaatttaatatagttagcaaggcgtatggtctgccatattcacctggtgagtattcatatcgatctggagggagaacgtgacgaagtaagtgtctaatggcattttgacgaggaggagaaggttggttattaagatttaacggaataatatgtgtctcatgttattgaggtaaaggattagcgtttaccaaggtagaatcattatcaaaaaaggatcagagtcatcagtagtaccagttgtagtagcgagcaagttctacaatggaccagtggctaggttgttatggccaacaaaatcatgagtgaattttttttgcaaaaaggacttagtagaagattgtgagtctttactagcataagtaaaagaattttcaaagaagataacgtgtcgagaaattctcaatgaatggcgtattggatcataacacaaatatcctttttgaatgtcattgtaccccacaaaaatacacttaccagctttagaggataatttatgacgttcatgatcttgaagaagaacaaaatatatacaaccaaatactttaagatgagagtagttcgggcaatttttaaaaaggaataaattaaaataggggcaattttgtttaatgacggaagatgattgcctaatatttttggaacatttgatgtatcaagaagagctaatgcaatttcaacaacatttttatttttacattccaccacaccattttgttcaagtattgtggacctccaaatcttaaattttcgttcttgaaaagttttgcaaaaatcttgatttcgtccatttaaatccgaaataaatgatgaatataaccatagaatcatgaagtataattactttgggatatagaacacttacccagttccatatggttgcggtacttgctatgagttactatcacctgcctattcacttgaaaccttgtttcctccatttaggaacattccccgaggatcatgagattgatccaattgtgggttgcagaggggattctaaagagtaataagttaagaagcctggaagaagtagcagaggattgtttggaagatctggcttgtcgaaatttagtaatggtcacaaggaggaagctcaatggtcagtcaaaagatgcggtatgcatgatctgttgcgcgatttgagcgtgagtgaagctggaaaagaaaagtttttgaatgtgattaggaatattaatcgagctcctaatgatctgtacctccgaggacagagtggtcaacggcaacataacagtataagttctctctgtcttttcagttttacgcaaagcatgaaaacaaaaataaaaatgactaccaccttgtaacttttttttttcggtttgacctactccgttataaatagtaattactcctaattgtcattagtaattgtaattagagacttttggatagagaaaaagagtgtataaaaacctctcacattctcatctgtttaaattaactaaacagatgagagagagagtaatattattagtcatttatttagaaattttgggctgcaatgagaaaaaaacaaatatattattttctagtctaagagatgtcatatcatctattgtaactttaaagaataatatatataaacagatggattttttgtgatttttgaatacttcttctttgtcctccggctccttgtacattttcaagcaacctcttggagcagctggaaaaactgcagaattaagagtattggtttccattcctaggcctattttcaagtaccgccatcgcttaacatcagattcagctttcttgagatacctttagattcgtagaagcaattatctcactgaatcacttgcatatttgtgtaattaatctgcaaacctttatttttaagcatgataaattaaagtgtgatgcagttaattataactttacctgactatatatatctggaatatgaagcagttgaggtacatccatattttgtgctttgaagccaacgactccaacaatcaatcaactcttattgtagtttaaagtacactatccttatgggttaacaccacaatgaaaagaacaacatacagtttcaaccccaaaataaaacagaaaacacatcaaacaaatgaaatacagaaagaaacccaagaatcataaaactgtggttcagtcgttccacttatgacaatgcaataggcttcactgtgagagcagtgagccaaataaagctgaaggaagaaaaagccagcagccaacatcatgcaattatttcagacctgtaccaatagcaacgctcactggttagttttttcctttaataaaaacctatattgctattgtaggccagaatggaaaaaaaataaaaccctaccaaggagaatgttacctactgaatttttatcaaagcataaggttaatcactaaatgcaaccaaaaatcccaagggaaaacgagtagccaatagagaaaatatgcataagattattgccacatgacttagagtgtaattaaactgcatccaactatttgacactgacgattagtcgattactattccaaatgatgttcaaaattgtgatctgtcactcctattagtatatggaagtcagagaaccattgaaataaaaaagaaaacagaaaaggattgcagaagttaggtttccagcacaaaatgcaaggagataactttgtagcatctatatttctggtcaatgtttgttaaatgataacggacaggattttgagataaagaaactggctgattgaattgtttaaattcatagttactaaatattcttatctgcatgttactggcgagtattttagcaagttatacccctccttggaaaaggggagatagcagagaattgcacccaagttaaacatttcctttggattatgaaacacaaatcaaacagtagtgagggaagatttaactaacctttcaaagaagctgtacgccgcgttgatcagagataaggagggaatatagaaagcttgaacctttgggttttagccccttcttgagtttgcttgtcttttttggcctgtatatcccgggcagattttgctgtttgcttggttgaatttcgcaactccataacttggaggccgcgtatatcagccaagccaatggggacctcctcaagtttatcacatgatacgagaacaagacgcttaagtcttggaaagtgatcacttgaagcattccaagaagctaaatctgacctttcgatccataacactagtagggaacgaaaacctccaacttttggttcccagtattctcccttaaatgcattgtctttcagcttcaagacttcaaggtactctaactggcccaatacagacatatcatcccactccaaccaggtatctaataatgttagcttcctcaaatttgtcggaaatatatatgttggaggaaggcgtaattgtttcccactttgaccaacatttatcagcttcaagttctcaagacattgtagcttcttaacattgttgaacaattcggacttatttggttccagaagcataaagattttaccacgaatgcccagttttttcaagtttggagcccttgaaaaaacttcttctgtgcagctttctggtgcaattgtggagagagtttgtaggcattgatttaccgaggtaaccttgctactttttggggcaacaggcgtaggcaatttagcggacgtgttagtgtgcagatgcctcagccgtggcatgttccatatgtctgcttgaatatcaagattgctctgttgtgtgttaacaatgagggtttgtacgttccatagttccccaatatgtttaggaaggatcttgataaagtcagatgagaaagcaatatacctcagaaaatacaattggaaaaactccctgcaaaagcaactgaatttgatggattcagcatccaacacccttagcaatggaaagtcttttggtatgtttgggatgtcaaccgggggcatgtcaattttttctgaagaaaaacataggaatgacctaacatgctcaccagagggcttcatagaaatgaattccagaactgaggaatgaatgcacaagcggcggtaggtggatagttgctgtatctcacgagcaaattgcccaacacctaattttacctcttggaaaagattttcttctgttgtggcctcttgccagcaaaactcatgcaacatgtcatgaacacgacatgttttgatttgtccatcagacgtcctttgaattatcatcactaagtttctgttgacgagatcattcaagtaatcctctgctttacgttcaagggataagggccctttgtattggatgaagccttcggcgatccataaacggatcaaattccaagcagggatctcaaagcctctgggaaatgcaccacaatacaaaaagcatgctttcaagtcgtaaggcaaacgatcataactcatttgcaccaattttattacaattctttggctggtttctattaatgaggtgttcaccaacactctgatccacttgctcccactcccttgttgtcttgcgtttccctattagagctcctgcaatcaccacaattgcaaggggaagtcccttacacttcctggctatgctctgtccaggtctttccaattccggaggacatttagccttgtgaaaaactttcttctctagcaacatccaactttcctcatcgctaagaaattttaaatcatgtggagtattgttgcaatgatgagccaccttgtgatctcgagtggtcaacaatactctattgcactttttgttgttcgggaaagcaatcttgatacgttcccacacatatattggtattgttttgtttttccggtgaatttgctaatgatgttgagatataattctcttgtcttgtatgattgcgagacataaacccaaactcgagtaaagaactcgtattcaaccttccgatgcttgaaaatcttagttgctagtgtggttttgccaagaccaggcattcctacaactggaataacctctaattcatctgatctgtcaagaagacggtcgattaccttctgtgcctcctcatcaaagcccaccacatcatcttcctcaaccacgggaggcttttaaattaatatcaaagatgaagattagacatatatatgaagttaacgttcattggcaagaaaagaaacattatattcaaccaaaacatattgtattacgtacgcatttgtgcagcttaattaaaagataggtgattagctttgttttgtattggaaaaattgatactcagtagtaaatagaagcaaaggtggattttcccaagacatatatagaacactaacattacaacaatatagatattgtccaagaaatgccacacatccttcttactttcacatttttacgatactcattttgttgattatgtcggcttctcatataaaattgataatcattctatgaactttgcgcaggagtatcttcctgtgcaaagtatatttaagtgcaatacagttccgttgattgtaccattatattctgctggaggctcaatggagacatctgaattggttatatttaagcagcatattgtcatctaatcttactcaccttcattcttattaaggagtctaaacctgttaaatatatatatatatatatatatatatatatatatatatatataaatgcaatgctgggtttagggctgtgcatttggatcggatatccgagaatccgaacccatccactctctttagacttattttttcttagtttatatcgaagtctctctctaacttctcttcaaattgctcttttcgcttctcttttttttttttttttttttaatatccctcccaatttaggaggatctatagtgtttccacccttctcctccagcatgactcgaacccaggacctaacggtcgtgggtagaggtgcttttatcaactgagcaagcctcacttgttagttcgcttctcttaagtcttatctttgtgtctctcattctcagtatctccttcctatcgacggacaacgacgatggaaatccgataacgcttttctttttattggtatgccgcttcgcgagcaaggagcgagctaagtaaatcttacctgaaaatgagcgagattcgattctttttcctttgtagtttttgttttgtcatttctttttccttccctctgttaaacagctcagcgacttgggaaagagcttgcccaccgcatactgattgatccgataaagcaaagcaacctggcccacagctctgagttggggcttgattcccagccgagataacatttgtttggaattttagtttattttattttgctatggagctttgttttgtctattgctataaaagacatttgttgcctttcaatttaagccttataaagtgtagtagccgattagattgttagtagccttaataaggcatactatctgattcgaaaatccgaaatatttacccgattcaaactttaaaatccaatccgatccaatttaatttggattggattcggattgcattttataaaaatcggaatccgaatttacaattcgaaatgtgttaaattcgatctgatccgatccgacccgactgatgcatagccctagctgggttactgcattcgttgtctcattgacttgtggtgttgagttacatgctaaaattttacatgataccaacaacaaacatggcaggcaggggcggagctaaagtgttccgagcgggttcggcgcaaattaagggcaaaaaatgaatgattgaaggcatatataatataggtacctttctgtcttccacgcctctgttggatggatcatcatcttgaagagcttgaaggccatgtgcattgttcagacggatttctttcaccctatctctgatacctttaatctcaagggctacatctttcactcttttataatgcgcaatgtccacaaacctgcctacccctttgtccttgtgaagctttgcctcaattacaaacttatcaatagcgtcttcagaatcattcgtcacttttctgatactcttcaccaattcttttagaacttcgttatcgctgcgggacttgtctgcttgcttcagaaacgcattgaactcactcaaatcttgaagcagattctctgcctcacctttcactccaaatattagctctgtattgtccctcaacaactgcatcaaattctctaccagaaaattcactgctacatcagccatcttctttttttccttttttttttgttgttgcaaacaatgtaaaattttagcacaaaagagagactgtcattctttaataagtcttcttttgattcttggagttccaaaaatcaccataaaataaaagcaataattgcatctctgtcttaattaagctggttgacaatatcgaccatgcaagtctataattatattattatttcgcttagtgcatgtgagctcttttgattccacattagtcttgaagttttgtgttttatatgatactccatatcgatgaattagtcccaagcagaaaaaatgaatatatcaaatatatcgaggttgagcaacaaaaaaaaacataaacgactatctacatttatttattactagtatctatgaactgcgttgcacgttaataattatatgtgatggtttaaacatttatttatatgaaggaacaacaaaatttaattaatgaaagaaattgtcacgccccaaccttgggaggcgtggctggcacctggtgtcgcattggcccgagcgaatcactctgtaactttttcattccttttataactatcatgggccaacatagctacaactcgtaatgcataactataagtgggcaacactgtatcactgaatcatatttattaaaacatgaatacatatgggcccgtcaaggcctctgacatactgtaccaactgaacctctgtctacaaagcctctaagattatttgacataaaatgggacagggtaccgacctacccataagtctgtacaaaaactctgacacgatgacttatagactcgcctgcactctgaatgaggtgaagtcttaccaatccttcgctgaatgccaatctcgtctactatgagggctcgccaaaccgattatctatacttgtaagtctggatagctttgtaaatcataaaatatttataatggcatgcatataaatgtcatataatgcataggtctgtacgtacataaaatcatcaagcctctgagggcatcccatcatatcatctcggtcactatgggcaaatcatcaacgtataccagctgatcaggtggtggtgcgtatataacgtcataaccttttcccatatcctatatatatatatcagttggtatacgttgatgatttgcccacagtggccaagatgatatgatatatatatacgtatataacgccatctagtgccattgtgggcagaatcatcaacgtataccagctgatcaggtggtggtgcatatataacgtcatatgagtcatgggtaaatgcacatgcatagtgaagtaagtcaatacgatctcttgtaatgttatgagactataggtgtttaatgggtgggccgggccgggctgggtaggggaatttagtacccgtacgggttatggttcagatcggttatgggttggggcataccggatttaatgggttggggttcatccaggtaaaaattgaaccgtaagggttacaggttcatggggccgggccggaccgggttattgttatttttactttttttttgtattttgaatttttgtataattattgtaagctatattaatataaagtaaaaatataaagaatataatgaagatgggaaaaaattgcacttataaattgcaagtgctacatttatttcaaaattacaaaattgaagtttgcatttaacaagtaaattaacaaaaaaaatagtaaaactaaattttcatgcataataatacatcaaattaatctaacaaactaaaacattaagcataaatacgtctaataattttaaaataacacaaattgtctcaaatcaacttaaatacgaattttcggaggacgctcaagacaattctttatatgcctccttaaactgtctgtgccagattttgaacgaagatttaagacttgaccacaattcttgcactttactttctgaacttcttcattttcttctaccacctcaaagtgtttcaaaacatatgagcgcactctagaagtacgaggcatgatttaacttgagattgagaattgagagatgagtaaagaaatgaggaagatggggtgtatttatagtttttcaaagggggttaatttttttttaaaaaaacccaaaaattgggctaaatgtcaattttagccattgggcaacgaccatattgtgaaatggaccattgccaacggtcagaatctgaggcccaagcttaaaaaagaaattgttaccgttaaatcggtctgggtcggtctgggccgggccggttaaccagatgaacagtattgttcattgaccgggtttgaccggtccggttaaccggtggttcaaaagtgaacggtacaaactgccttactcctataacccagcctcacccggcccccttctaccggtccgggccggttccggttttcaccggtctgagacggtccggaatcgggctgatccggcccgttagacacctttatgtgagactcatatataaataatatggtagtaggacatattgggaattagaaatataggcaaccttaatacttataagaatagaatcatttcaaacttttgagcaatatcacttactagttcttttttattttttaataagtaatcacttagtactagttttcttggtttaatagagaagacttttttttaatcggcaatgcaaaatgtagtgagagttttataatttttcttgttaagttaatttttttttattttacatgacaatgaggcatcttagtaaatattcttatgcgtcttttttaaaacttaagtacttcaagttaactgaatctaacagataatgccataaaaccaagaaaattgggatggttcaggaaaaatctaatattagttatatgcaatatataaaccaaaaagtcagcatcttctcgaaacaacagtgacaccccttgttttcgatagagcagtgacgcccctagttaaatgcaactttaaccaacttacgtatttttaaaactcatacacagatgatagaatagtaaaacttacgggagttcaaaaagataccaatgtgtcatgccaatgatcatgtaattataacgacccgactagttgttttgctttttaaaatcacgttcccctaaatgaaacttcttgcgcttgctttaactaatttacgacctgtgggaatggttggttcgtgatttagaagagtttgggttggaataggctcatttgattccttaagattttcttaaaaggctaagtttgaccttgatcaacatttttagcaaacgaacccgaatacgtgttttggcggccccggagggtccggaggaaaatatgggacctgggcgtatgcccggaatcgaatttcgatgtccctagcctgagtaatgaatttttattagaaattgttaaactgaaattctaaggatttaaagaaactaaataatgattgatcacattggtatcgggatcgtatattggttccagagcccagtacaagtccaatacatttaagacttgcctgcaaaatttggtgtcaatccgaatagtataagtacgtttcggcacgttagaagtgaattgaagaacttgaagttcataagtttgatccaattggttttaaggggtgattcttagatttagtgttttttcgggtgttaaggaggttcacgcgggtctgtttcatgatttcaaacttgtcggtatgttcgggcagggcccgggagccccgagcgtcaatcggacgaggctcgagtgaagttggaaaatttgagaagagctaaagcttcatgttgctgtcataaccgtacctgcggttggttagccgcaggtgcgagaccgcagaagcggtcgttctctcgcaaatgcgaccaaggcaggccaggcccaaaatcgcagaagcggcttcaagaccgcaggagcggtcccagcccacttggccaattccgtagatgcggccttcctctcgcagaagcgggaccgcagatgtgaaaatcactgaagcagtgagcttcatttattacgggctctaagtcattttggccatttttactcacccattgggctatttttgagctcttgagagaggaccttcacctagcatcttcaggtaagtttacactacttatttctagtttaatacttgagtcttaggtagattaacacacaaagattaaggtaaaattatggggttagagcaaaacctagggttttgataaaaattagatttaacaacgaattttgttatgaaatgcgtttgaaatcatatattattaatcgttaggttataaagaacaactttcttcgaaaaattttgaaatccgggaacgtgggcccggggttgaattttaggaaacttgtgtttaaggttggaaaattgcttaaatagttagaatgcaatcttttgagcttgtattgactagttcctacctcatttatctagttttggatcgttcggctccaaattgagggtttgagctcgttcttgatattggaagtacgcttggagcgagttgagtctcctatctaaccttgtaagagggaattgtccccgtaggtgatataatcaaataatttgccattaaatgcgggggctacgtacgcactaggtgacgaaagtccgtgtgtagctactattatgctaagtctgagtaatctaggacccaaaaatatgctttatgtgttattcttgaaactttatgtttaatttggattgtttaaatcatggtgattatggtaaatgagactagtaagaggaacattatctttcttggcctttttaaagagaagttgatatttctatgagtaattgctcctcggttatatattcctatctgcttgttgttgtttttaattacatttgaccgcgtcgcatgtttgattcgcgagcggggtaatagatacatctatggtttgcgccattcgaccctcggcagtgcacaatttacttttacgttggatcgggccgtacgtcctcgacactacttgcgcatgctttactcagtatttttctatgaattgagctttattatttgccctggaatgaaagtggacaactttgatattatctaggagaggacctgttatttcttgctataaactgctaattatttattatatccatgctcagtataattcatttctcatattatttgaccttagtaagtgtcaagtcgacctctcgtctctacttcttcgatattagacaggatacttactgggttcatattgtttatgtactcatactacacttttgtacttaattgtacaggatctgaggtaggtacatctggttaccagtccggtgcgcattcttgatccgtgtccgagattttcatagtgagctgctcccttcctgtgccattcagcagcatgatggagtctctctttattttggttgtctattctatttcagacagtaggatagatttattcttttgtatattctactagttgcccgtaaacttgtgacaccaggttttggcacacacattagtagactattcttttgggaattgtataactattattgtacattgttaattatcacatgctttttaactgcaaatttagaaaacttctgtacttgttttagtaaagagaaaatgaggacttgttaacacttccgcgttggcttgcctgacaagggtgttgggagccatcatgaactatagtagaattgggtcgtgacaacatggtatcagagcactaggttcatgtaggtctcacaagtcatgggaaaacctaatagagtcttgcggatcggtacaaagacgtatgtattcatcttcgagagtctatagggtgttaggaaaactactctttacctatttcctatcgtgcagtggttggtatactaaatttccctcttctattctctcacagatggtgaggacacgtacgactaattttttagacccgggaggagctgctccctccgttgctagaggtcaaggcagaggccgggggagagcaccggctcaaggtaggggacgagggcgtaccaaagctgtctcggtagcaccactagcagatcctacaggagatcctatcattgaggagcagggcgaggtgcccgcagcagagcctaccccggtggactttatgatagcaccgggtttccaagagatcattggccgtatgctgctgttcatggacaccatgactcaggctagtttatttccagtagatccacctatatcataggcaggagggggagaacatgccctactactcaggctcctagccacacagctgcaatgtatcagacttcgggtgcactacctgcggatgaggctcagccagttgctgtagtagtgcccgagcccagactagctgcggatggtgacccgcagaagttattggatagatggactagacttcaccatcctgtcttcgggggtgagcgtcatgaggtttcctaggatttcattgataggtgtagggacaaactgcacaacatgaggatattggagtcgtatggggtagacttcactacttttcagctggagggcagggcccgcagatggtggcagtcttatgttcttggcaggccagcaggttctcctcccctcacttagggtcagttcacacagttatttttggatagggatatttcaccctttgagagggaagagctgcggtatcagtttgagcatcttgaacagagtcagatgtccgtgaccgactatgaggcgagatattctgagttgtctcgccatgctctcatgatacttcccacagattcagagagagtgcggaggtttgttgcggggttgcacctcggtattcgagctagcatggcccgagaggtggagatgggtactgagtatcagctagtggtagagattgctcgtaggattgagggttatcgccagaggggtagagagcagtttcagtaggagaagagggaccgattttctagagagtttagaggttccccagctaggggtagggggcactccgggaggggtcagcccagcatacccccgtattcagcaccaccaccacctccccgaggttctctagtgagaccttattttagtgcgataccggagagtccttaccgtccaccagctattcagggttcctccaccgggtattctagtcatcagggttcttccagtgcttacttcaatgccatgccagagagttcatatcgcccaccagccattcagagttcttctagtggatattcggctcagtaggctcagacttcaaggcaacaggctatggtgccgaggggttactacgagtgtggagatccgagtcacatgaagaggacctgccccaaactttggggcaaggtagtacagtagggtcagcagcctataatttcagcaccggttgctcagcctcccagaggcgggggacagacgggtagaggccatcctagaggtgggggccaggcagagtgaggtcagccagctactgctcagtcaggtggaggctagccagtcggcgctccagccagattctatgcccttccggctaggccagatgtattagcctcagatactgtcaacacaggtattattttcgtctgcggtagagatgcttcggtattatttgatccagggtccacctattcatatgtatcatctctgtttgctcatttcctagttattcctcctgcgcctttgagcactcccgttcatgtgtccactcctgtgggtagttctatggttgtgaatcggatctatcggtcttgtgtagtcacattctgtggttttgagactagagcggatctcctgttgctttatatgatcgatcatcctgggcatggattggttatctccatatcacgccgtcctagattgccatgccaaaactgttacattatcaatgctagggttgccaaggttggagtggaagggttccacagttgatatgtctagtcgggttatctctttcctgaaggcttgtcatatggtcgagaaggggtgtttggcttatttggattatgttcgggataccaccgcagagtctccaacgattgatttagtcccagtagttcgggatattgccgatgtgtttccttctaatcttcctggcatgccaccagatcgtgatattgatttttgtattgatttggctccaggcacccaacctatatccatcccaccataccgtatggttccgaaggagttgaaagagaagcttgaggagtcgttagttaaggggtttgtttgacctagtgtatcaccttgggtgcaccagtgttatttgtgaagatgaaggatgagactatgcggatgcgcattgattaccgccagttgaacaaagtcactatcaagaacaaatatccattgcctcgtatcgacgatttgtttgaacagtttcagggtgcttaggtgttctctaagatcgacttgaggtcaggtaccatcagttgaagatctgggactcggatattctgaagactgcatttcggactagatataactattatgagtttctggtgatgtcctttggcttgactaatgccccaacaacatttatggacttgatgaacagggtgttcaaaccttatattgattcctttgtcatcgtcttcattgacgacatcttgatatactcacgtagcttggaggagcacgagtaacatttgagagtagtgctccagaccttgcgagagcaaaagctatatgctaagttctccaagtgtgagtttttggctagagtcagtggcattctttgggcatgttgtgtcaggagagggtattaaggtggatcccaaaaatattgaggcagtttagagttggccacatcctacttcagtgaccgagatcaggagtttcctatggttaacaggatattacagatgatttgtgcatggcttttcatctattccatcacctctgactagattgacccaggagggtgctcctttccgttggtatgatgattatgaggcgagctttcaggagctcaagacagctttgactacgacaccagttcttgtgttgccttccggttcagggatgtatacggcatattgcgactcttcaggtgttggattgggatgtgtattgatgcaggaagggcaagttattgcatatcttcacgtaagctaaagatccatgagaagaattatcttgtgcacgatttgaagttggccgcgattgttcatgctcttaagatatagaggcattatctatatggggtgtcatatgaggtttatactgatcatcgcggcttacagcatttattctagcagagggatctcaatttgaggcagcatagatggcttgagttactgaaggattatgacatcaccattctttatcatccgggcaaggaaaatgtggtcgcgtttgcaaaggaagagagagtatgggtagcttggcattcattccagcagaggagaggccactagctttggacattcagtccttggctaatagacttgtgaggttggatatttcagagcccaaccgagttcttgcgtgtgttgttggtcagtcttcattattggggcagatcaaggcccgacagttcgatgatcctcatttggcggttctcagagagacaatgcttcagggtagtgccaaagagttttctattggtgaggatggtgttttgcgactccagggtcacttatgtgttcctaatgttgatggtctgatggagaggatactagaggaggcacacagttcatggtattccattcatccgagtgagacgaagatgtatcatgacttgagacaacattattggtggcggaggatgaagaaggacacaatggagtatgtggctaagtgtttgaattgccagcaggttaagtatgagcactagaggccgggtggcctacttcagcagatgcctataccacaatggaagtgggagcacattactatggacttcgtagttgggttgccccagactttgcggaagtttgatgtagtatgggtcattgttgacaggttgaccaaatcggtgcactttattccggttatgactacttacacttcagagagattgcctcagatttacattcgggagatagtcaggttgcacggagtgcctgtttccatcgtattagatattggccctcagttcacttcccatttttggagagccattcagagtgagttggggacccatatagagcttagcacaacattccatcctcagaccgacgatcaatcggagcgaacagttcaaattttggagtacatgcttagagcatgtgtgattgactttggaggatagtgggatcagttcttgcctttggcagagtttgcttacaacaacagccaccagtccagcatcgagatggctctatttgaggctttatatggtcggcggtgtcgttctcctattgggtggtttgagcctggtgaggctaaatatacggtaaagatttggtgcaagatgccttggacaaggtaaagttgattcaggagaggcttcgcacagctcagtccaaacagaagagttacgtggatcagaaggcgcgtgatgtatcattcatggtttgtgagaaggtcctcttgaaagtatcgccaatgaagggtgttatgaggttcgggaagaaggtcaagctgagcccaaggtttattggcccatttgaggtgttgatgtgagttggggaggttgcttacgagcttgctttacccccagcttattgggagttcattcagtttttcacttgtctatgcttcggaggtatcatgccgacttgtcccatgtgttagacttcagtactattcagctagatgagagtatgagttatgaggaggagccagttgccattactgataggcaggatagccagttaagatccaagaggatttcagcggtgaaggtccagtggaagggccaacagtcgaggaggcaacctgggagtccgagaaggacatgcagcagatatccacatttattcagcacctcaggtacttttctatgtccgttcgaggacgaacgtttgtttaagaggtggagaatgtaacgacccaactggtcgttttgctttttagaaccccgttcccctaaatgaaacttctcgtacttgctttaactaatttacgacttgtggggatggttggttcgggacttggaagagtttgggttggaatatgctcatttgattccttaatattttcttaaaaggctaagtttgaccttggtcaacatttttagtaaacggacccagattcgtattttggcggtcctggacggtccataggaaaatatgggacatgggcgtatgctcggaatcaaattctaaggtccctagcccgagtaatgaatttttattagaaattattaaactaaaattctaaggatttaaaaaaactaaataatgattgatcacattggtatcaggctcgtatgttggttccagagcctagtataggtccaatataacatttaagacttgcccgcaaaatttggtgtcaatccgagtagtataagtacgtttcggcacgttagaagtgaattgaagaacttgaagttcataagtttgatccaattggttttaaggggtgattcttagatttagcgttgttacgggcgttccggagattcgagcgggtccgtttcatgatttcaaatttgtcggtatgtttgggcagggcccgggatccccgagcgtcaatcggacgaggctcgagtgaagttggaaaatttaagaagagttgaagcttcaggttgctgtcataaccgcacctgcgattggtcagccgcaggtgcgagaccgcagaagcggtcattctctcacagatgcggccaaggcaggccaggcccaaaattgcagaagcagctgcgtagaattggcttcaagtccataggagcggtcctagcccacttggccaattccacagatccggcgatcctctcatagtagcaggaccgcagatgcagaaatcactgaagtagtgagcttcattattacgggctctaagtcattttggccatttttcactcacccattgggcgattttggagctcttgagagaggaccttcacctagcatcttgaggtaagtttaccctacttatttctagcttaatacttgagtcttgggtagattaacacacaaagattaaggtaaaatcatggagttagagcaaaacctaggattttgataaaagttagatttaaccatgaagtttgttatgaaatgcattagaaatcatatattattggtccttaggttataaagaacaactttcttcgaaaaatttcggaatccgggcacgtggacccggggtcagattttaggaaacttgtgtttaaggttgtgaaattgcttaaatcgttagaatgcgatcttgtaagcttgtattgactagttcctacctcgtttatctagttttggatcgttcggctccaaattgagagtttgagctcgttcttgatattggaagtacgcttggagcgaggcgagtctcctatctaaccttgtaagagggaattgtccccataggtgatattatcaaataatttgccactaaatgcgggggctacatacgcactaggtgacgagagttcgtgtgtagctactattatgctatgtgatgacccaaaagatcatcacttgttttaaaagtaaattttgtattccaaggccttaaaaacatctttctgcatcacctcaatttgcgtgcgcagttcggacgcgtggcgagaaagccaatatgttaaaatatgtgaaaaataatgaattttgactttaaaatgaatttaagttgacttcggtcaacattttgggtgaacggaccctggcccgtgatttgacggttccagagggtccgtagaaaaatatttacttgggtgtatgcctggaatcgaattccgaggtcccaagcctaagaaatgaatttttaaagaaaattgttttctgaaattatttataggttttggaaatgaaatgtgtttaaaatttgatgctatcgggcccgtgttatggttctggagcccggtacatgtcttatatgtggtttaagtcgagtctgtaaaatttggtaagaaacagacttgaaatgatatgaatcggaccttatttgaggaaattggaaaatttgttgttcttaagaaatttcatgattttgatgctaaattcatagttgttgttgttatttgagtaatttgaatgcactagcaagtccgtatgatgtttttaggttggtggacatgtttggattggagtcccgaggactcgggtgagatttggataggccatagagtagaattagacttggaaaaattgcaggtttcagctgttctatgggggatcggggcatcggggcataaattcttaaaacgaccgaccgggttgtcacatccttctacactaaaacattcgttcgtcctcgaacgagcatagagacatatttgaagtagtgaaaaggtgagggtaacggctgcgcatatcctgcctggtctcccaggtcgcctcctcgaccggctgaccccgccactgaacgttcacggatgcaatattctttgacctcacctttctaaccttcctatccaatattgccattggctcctcaacataggatagatccttgtccaactggactgaactaaaattcaacacatgcgacagattaccgtgatacctctagagtatcgaaacatgaaataccagatgaattcctgcaaagctgggaggtatagcaagctcataagcaacctccccaacatgcctcaatatctcaaaagggccaataaaccttggactcaactttcctttcttcccaaatctcataatgcccttcataggcgaaactcgaagcagaactcgctctctaaccatataagaaacatcacgaacctttcgtccgtgtaactcttctgtctagactaggctgtacgtagtctatcttgaatcaccttgaacttctccaaagcatcctgaaccaagtctgtgcccaataatttggcctcacctggctcaagccaacccaccggggatctacaccgtctaccatataaaacatcatacagtgctatctgaaatgctggactaatagctgttgttgtaagaaaactccgccaatggcaagaattaatcccaagaccctccaaactcaatcacacacgcacagagcatatccgcaagaatctgaatagtgtgctcggactgtccatccgtctgaggttgaaatgttgtaatcaactctacccgagtacccaactcatgctgaacggccctccagaaccgtaatgtgaactgagtacctctatctaaaatgatgaacactagaataccatgtagacgaacaatctcccgaatatagatctctgccaaccgctctgaggaataagtagtacacataggaataaagtgagcggacttgatcagccgatccataaatcacccaaatagcatcgaactttctcaaagtccgtgggagcccaactacaaagtccatggtgatccgctctcacttccactccgaaatctctatctgctgaagtaacccaccaggtctttggagatcacacttcacctactaacagttgaggcaccgagctacaaatccaactatatctttcttcatccatctccaccagtaatgctgcctcaaatcctgatacatcttcgtggcagtcggatgaatgaaatactgcgagctatgggcctcctctagaagcaactctcgaagcccatcaacattgggtacacaaatccgaccctgcatcctcaataccctataatcaccaatagtcatatctctggcatcactgttctggaccttatccttgaggacaagcaaatgagggtcatcatactgctgctccctgatacgatcaaataaggaagaccgagaaactacgcaagctagaacctgactgggatccgaaagatccaatctcacaaactggctggctaagacttgaacatccatcgccataggcctctccgatgctggtaaataagccaaactccccaaactctctgcccggtgactaaaagcatcggccaccacattgtccttgcccgggtgatacaaaatagtgatgtcatagtctttcagcaactctaaccacctcatttggtgcgaatttagatccttttgctcgaacaagtgctgcaagctctgatgatcagtataaatctcacaaggcacaccgtataaagaatggcgccagatcttcagggtgtgaacaatggccgctaactcaaggtcgtgaacagggtagttcttctcatgtatcttcaactgtctggacgtgtaggcaatcaccctaccgtcctatatcaacaccgctctgaggccaatcctcaaggcatcacaatagactgtataagaccctgaacctgtaggcaatataaaaaatggggctgtagtcaaagctgtcttgagcttttgaaagctcgcctcacactcctctgtccactggaacggagcacccttctgggtcaacctggtcatagggctgcaattgatgaaaatgcctccacaaaacaacgttagtaacccgccaggccaaggaaactgaagatctcggtagctaaggatggtctgggcaactctgcacggcctctatcttcttcggatccatttgaataccctcactcgataccacatggcctaagaatgcaactgaatccaaccaaaactcacatttctagaacttagcatataacttcttctctcttagagtctgaagcacaaccctcaggtgctgctcatgatcttcccgactccgggaatataccagaatatcatcaataaagacaatgatgaataagtcaagatacggccggaacacactgtgcatcaaatgcataaaggctgttggggaattggtcagcccaaatgacataacaaggaactcataatgaccataccgagtcctgaaagcagtcttcgggatatatggctcccgaatcttcaactgatggtaacctgagcgcaaatcaatcttagagccctgaagctggtcaaatagatcatcaatacgaggcaaaggataacagttcttcactgtaaccttttaactggcgataatcaatacacatacgcatagaaccatcctttttcttcacaaacaagacaggagcaccccaaggtgatacactgggccgaataaaacccttatcaagaaattcctgtaactgatccttcaactccttcaacttagaaggagccatacaatatggaggaatagaaatggtctgagtgcttggcaatagatcaatgccaaaatcaatatctctatcaggcagcatgcccgaaaggtcagctggaaacacatcgggaaaatccagttctactggaactgaatcaactaaaggggtatcaatactgatatctctcacataagctaaatatgcgtcacacccttctcaaccatacgctgtgctttaagaaaagaaataactctactgggagtgtgatctaaagtacccctccactcaacacgcggtacgcctggcatagctagcatcacggttttggcgtgacaatcaagaatagcataatggggcgacaaccagtccatgcccaagaaaatatcaaagtcaaccatgctgagtaacaataaataggctttggtctcaaaactactaaaagaaaccaaacacgaccgataaacgtggtccacaataagagaatctcccataggagtagaaacataaacaggagaactcaaagaatcccgagatacacccaaatgcggatcaaataagaagacacataagagtaagtagagactagattgaatagaaccgatgcatctctatgacaaaccagtataatacttgtgatgacagaatcagaggcaacaacctcggtactggtaggaagggaatagtatctggcctggcctcccccctagggcgacctctacctccccgacctccacttctagctggctgagcaggtggggtaactggagctgtaaccatatcctgagaactctgtggggcacactgtggctaagaagtctgtggaggtgcacccctcccaagtctggggaaatccctcaccatatgacgtgtgtcaccacactcaaaacaagctctgggaggacgtggtggctgtgactagctcgggccaggtcttggactaaccccggaaagcaccccgcacagaaggcgtgctagataccgatggtgcataataaggctcttgaggtctaggaggagctggaatactactggctactggaagagctgaaagaacagggcgactcatataacccctacaatgacgacctggagctggggcacgggcactagagaaatggcccgactttcgagacctcttggcctccctctcctctctctctctctctccctggcatgcataccctcaatcctcctagcaatgcccgcacctgctgataagaaatatccatctccaactcacgagccatgctaacctgatgatgggaataaagccctcaataaaccggtaaaccctctcgcgaacagtagaaaccaaggctggtgcatgactagccaaactagtgtaacagactgcataatatgagatagtcatagtaccctggcgtaaatgctcaaactctgcgcgccatgcgtccctgaggctctgaggaacatacactctcaagaacagatctgaaaactgagtctaagtcagtgaagcagcctcatccagactgtgtaactcataaatgcgccaccactcataagtggctccttgaagctggaagatagtgaagaaaacctcgctcgatccggatatacccatggtacagagaatgcggtaactctcatctagaaatcctagagcatcctccgatgctagaccgttgaatataagaggcttgtacctcttgaacctctcaagccttagttgctcctcctcggaagccgctgccctgccctcgggctgaactggcactgcaagcggtacaagaataatctcagggacctgctcaacatgcactcactgctcaggggtacgagcggcgggagtctgtgctcctcccccggcctgagatgtagctgcagcaaggggaagcaaccctgcctgagccatagtggtgtacatgcttatgaattgtgctagagtctcctgaagagctggagtagttgtagcagtaggcgtgtcaggtgcctggactccggctggaactgttggtggtacctcggcggcagctcgcataagtgctctggctgcaccacgtgcgcgtcctcggcctctaccccagccccggtctctgacggttgcaatagggggcacgggtgcctgataatctcgggtagcatgtgtcctcaccatctatgagagaataaagacagaagtttagaattgtgatgtcaaaatatcgcacgacaaggaaatcaaataaagtggaattttcctaacagttacatagcctctcgtagataattacagatgttttcgtaccgatcagcgaaactttaatagaccggcttgtgatccatgactcctatgaacctatagctctgataacaacttgtcatgaccccggttcaccctccgtgaaccatcgagacagcacctagtcctctacgactagctaagcctaacaaatgctgaacataaacgaaacttgcggaagaaataatcaaaagccaaaataactgaatgaaaacaatagttaaaatgccgctcggcatatacaacacaacattctcagaatcaagtacactatcccaagaaccgaaaactcacggaaccacaagcctttggatatctacaatgtctaactccagaatatctaacaaggaaaaaaaatacagaagggcaaatgttaaaagctagtatagaaagggactcctcggtctatggacgtggcagatgtaccccgaagtctctagagcagtcacctcgccttacaggtggtaggactgagttgcagtatttggatctgcacatgaaaaacatgcgtagaagcaacatgagtacaccacagcggtactcagtaggtgccaagcctaacctcgatcgggtagtaacgaggaaggtcagggccctactgaggttaaataaagtataaattttgacagtgtagaacagaacaatataaataaatacaacagtaaaagtaacacaggatataaaaagggacaacaacaactattacagacacaaggcaaaacacggaaagaaatgcgacttagcaccaaaataacaaccagggatctaccaggataccatcctgtagccccatatatacatatccgatggatcttccaggatagtccaactcatagtgcgcggggatctaccggaatcctgttccgtagtcccaaatgtaaatacccaatacggggggaatctaccgggtgcattcctgtagttccatataattgtgcagggggatataccggcatcccacatcggtagtcccaaaataaaaagacaagggggaactattagaatcccacatccgtagtcccaaaataaacatacaagggggagctaccggaatcccacatccgtagtcccaaataaatatgcagcagcaacagcaaaatatacagaaatgacaaaatttcatattaaggcaacaaatgattctagcctagtatgctgcacataattcaagtaaggtaggttgagcaaataaaacaattaagtcacttagacatgctttcctaagctaacaacaggcataataatgcaagtaataaaaacaggaaaggaacatactagtgattacttaatgaaaaccggatttccaataattagcacaagtacgcactcgtcacctcacgtacaagacatttcaattaccaaatataccaatcctaaggggaaggtcccccccacaaggttagacatgccatttacctcgaactggctcaataatcaatctgaaaccacgctcttgccacgagtactcgactccaaatgacccaaatctattcaattcaatttcataacgtaaataacacttcaagtaactaattctacaaagaaattctaagctaatacgcgaaattaggtaaaataactaaaacaccccttgggcccacgtctcgaaatcgggtaaaatttatattttcaaaatcctcacactctcccgagttcatgcataccaaaattatccaaatctaaggtcaaattcccaatcaaaagtcgaattctaggtctaagaactttcttctaactttttcctaattttcatctccaatccgaaattaaatgatgaattcacgtttgtattaatgagttacaagaaaaaaggagttaagaatcgttacccaatcgatatctctgaaaatccctcaaaatttcgctcaaatccgagctcccaagcttaagttttgataaaaatggctaaaccctcgattttgaacttaaacattctgcccaggcgcgttcttcttcgcgaacgcgaggctacggtcgagagtgaaatgcactaaagttccacacaccagtctccctcttcgcaaacgcgatgcctgagccgcgaacccgatgatcatttctcttcccctacgcgaatgcgagactgccttcgcgaatgcataggcacaaagtccctcagcctcgcgaacgcgtaagctccttcgcgaatgcgaagcgttaattcctcaacatccccagctcctcttcacgaatgtgagaccccacttgcaaacgcgaagaaggaaaccagaactgactgctgcaacatttttctgcaattctctaagttcaaaaatgacccgttgagcatccgaaagacacccgaggcccccgggacctcaaccaaacatgccaaccaatcctaaaacatcattaaaacttgttccaaccttcagaacggtcaaaacaacatcaaaacacctatttttcatcggattcaagcctaaaaattccaaaaactctaaaaatacgctttcgatcaaaaggtctatcaaacctcgtccgaatgacctgaaattttgcacacacgtcacattaaacactacggagctactccaacttttggaatttcattccgaccctcggatcaaaatctcattatcgaaccggaaacttcaaaaattcaactttcggcatttcaagcctaaattcttaaaacgaccggccgggtcgtcacatcctcccctcttgactaaatcccatgatttatttcctcctttttttattgcaggtgtgggaaattaatttaaagtatcttcaaacttcaaagcaataccagtgcaaaaaaccatcagtacagacgacacaaaaatttggcacgcaaatcatacaacatggagagaagatcgtggccaaaaatcatttcaagcatttagcaaacgagaattcaaaaatatatacaatatctatgcaattatccttctttggatttagttcagctaatttatggggaaaggtaaaaagtaataaaggaaccacatcttgattatcctgtgcatcagaatatctatgctatatcctttttccacttgcatatagtaccaaactttttacacttgcatatggtaccaaaaaaaggaataaaaaaaattaaaaataaaataaaattggtcatactgattagaagcataaatcatcttgaagaaaacaagaaatacttcacatctttatctaggttgattaattacttctttgaaatttggaaaacaaaccagctattgagaaagtatacttcataatttatggtcgtatcatttgaaagcaaacaatgattagtatgactactagaagaggtattttcgagtattcatgatctacttgatgtttgctaccgacttaccattttcaagtattttatatgaatgatccataagctacaactggtaagttgttacctatagtgacacttttcaggtaatataaatgttgaatttatgtattagtactatatatgtgttgttacctatatgttgtacttttgataaatttattcactaattgtttggttgaattgaatgaaggaaagtcatggcgttaaatcaaatccaataggtaggatataccccgaaaacaacaatatttttgcgagaggttcaataaatattatgataattattttatgatccatttaaactctaatacaatttagaagaaatattctaattacaaatggttgtatttcatatagatgctacaaataattgataaagcttttacactgatttgagatttgtacacttatttaagaaagcaaatttgatttgctaagttgcaaattaactgtgtacaactttcttggcatgtgattgaaattaaggcttgagaatgaatctcaatattgtttagcctattatgtcattgattgagggtaagacatcgggatcaagtcctgatgctccataatgataagagttgggtttgagtcccaatttattatggcctaacatgcctttatattggtaagacattgggtttgagtcccaatgtaccatattgatgatataatgatgactaaagaaaaaaaatatttttcatgaaaaggcatgaagattgtcccacttgattagcttcattcttgaagtgaatgtggtagcagtgcatataactctaaatgaagacaagtggttgaacaatgaacgtgagcgttccaaataataataatcatcacaatgattataaaaggagaacaacaagggttctcaaaatagtccttcaaaatgtgaagacaatgtttaccatcaaattggtatgaagcacatcgctgattatgatccattccttgaagagaatgtgacttgtgataagcattgagaatgcagattcattcctaaaggtgaatgtagtaatatgtgataaaagtaatgaataaagacatgcaaggcatgattggatgaataccacacaactcacctttgagggaggtttgagagaaataaagagaataaatattattgtgtggttacatgaatatgtcattggtctcgtacatgtgataccccaaaatattttggcattccttataaaagttattaaaggtaaaattaaagaaaaaaatggcgttgcttataatgattttgaccaagacaatttattatgatataattttcttcgtgaaggaatcatttatcatatgaatggtgtggcaaaagatcttgtagtacaaaaattgttaagagctccgaaaaactaattttttactatctggatgaataaaattattcatgacattgatattgtaaagtttcaaaagaaactttttgagtttcaaatgtataagtcaaagtagttggcatattgagactataaatgaaaggaagattgaatatcttcatatttctataattataccaggtaaatatgaaaggttactcgattttctttctatttgtactacacaaatataagcatgatgctggaatcatatgccacaagctagaggtttactaaaacaaatattagttggcatgaccagttgaccatcccggttcaattatgatgcggaaaattaattgaaaattacattggcatatattgaagtaatagaagattcttcaagaattcccttacgctgcttattctcatgatataccagttaaaagttgggattgaatcccttgatttctagaacgaataaaaggtgataaatatatgggcccagtcacctgccatgtggatcgttttctattatatgattttaataggtgcatctattctatggtgacatgtgcatttgttatcaacttgcagtttggcttttgcaagattgcttgctcaaattattagagcacagctccagaatgtaaattatgatgatttatcttgataatactggtttaaatccatgttggtttagcggaatgcctccaattatagctaaattattggttatgagaacaaaactcccaaaaatgaaatttgatatgagatgtattatgtaatatacaccagaacttgtacgcatctagccatgttatgaaaatttctctctttcacaatcgattcagggtcaggaaccaaataatttctatatagaaatatgaatgtgctatatgatttaattatgccaccacaatgcacaaagatgggttcccaaagaaggttgggaaatatgttggtgatcccaaaattagggggagaaaatggatagctgagaaagtgatatgtgaaatgaattattatgaatacatatagatcctcgtacaagaaaatatgaacttgaagttcaagtgataattaatttataaattattgccagacgcatttgctgaccaaagctaaatgtcatatttcagctgctaatactccaaatagaataacgtccatgagggacatagtctatggcacgcatgaagcgtaacagaccaatcagttccaaagataaaactccttgaagaaggagaggggaaaatgttcgagatggtcataataaggaggcaagtgatctagaagagcaccacgatataacacttcgtaagacctcatgtgagaggctcagttacctgaaaacaatgagataaagagatctcaataagttatgtctttattaggtaataatggaaccgacgtaaagtgatcgtcgacgatattgttaatataatgaagcactcaatattattaatattgacgaggatcttcagctcaaatctgtcatgaaatttggatagataaatgattggccaaaataaaataaaataaaaaatacgcaatcaagattgatttcacctgaaaaatgtgaagttggacggatagtccaaacacctgaaagtataaagccagtgaaggtataaatgtgttcttgtaagaagaaagacaagtcgatagacataaagacgacttgtgtcacaagaagatttataaatatcctggcatttcaggttttaatctggcaatatatgaaaaacttgatatgcgtataatggaaattattgaaggatttaaattgttctgaagcatattatggtttccaagtttattaaataaagcttcaataatccttatacgcattgaaacaatcagcgcgcatatggtataatcgcccaagagagtacttgttgaaagaatggtacaagaataattcaatttgtccttgtgtctttataaaaggatctggatttgaatttgttataatcgtcgtgtatgttgatgattcaaatatcattagaactcccaaggagcttcctgaagcagtagactgtttaaagaaagaatttgaaatgaatgattttttaaagacaaaaaataaaattttgtcttggcctacagattgagtatatgaaagatgaaatttttgtccatcaatcagcatacactgaaaagattttaaagtgattctatgtggataaagcacatccatagagtaccctgatgattgtgaggtcactccatagagtacacaccctctagagttccttgtaggagtagagctttatctcgctaagacattaactgaaaaagttttgtcacgccttcaagaaactagtgttcaagattgggatgtgaatgatcaaggatgtgaattggtgctctcatcagggggagttgatatgcgttgtactcttttttccttacaaggttttggcccactgggttttccttgcaaggtttttaacggggcaaccaaaatgcgtatttctaaacctgtgtactctttttccttcactataattttttttctatagggttttttcctagtaaggttttaacgaggcacattatctatgaacatccaagggggagtgttatgataaatatcatattatggtggatgtctactcttcctccatgatcttcatctcaaatgcttaatgacatattcaatgacataatttgtatgttcaatgacatattccctgacatattttcttcactatttatgcctatataaaggccttgtaatagataggaaaatacacacaattgaagaagaaaatctcttccttctctctatctctatttcttgttcacgttttactaaattgcttttatttcataacaaagagaacttatttgcttacttaagaatgaatatgttaggaatgaatatttaactctttcttaaaagtggataaatgactcactttataagatttgccaaatccttacatttctaaacttgccacatctattattaattaatgaccaacttaagcttttgtggaatgggggtgaggtttgctgcacccctgatgtgatgatcgccttctcgaagtaggctctgtaaggcagcattgacaacgttgagcttgtctgtcaagtcgtttatggtttgctgcatggcagtcagtctgtctgcctcatgttgctgatgggctaaatcgtcggcacgctcctgttggaggtcctcaaatttgccatgaatattggcagtttcgatggctgccgtttgtcggtcctcgtcggagtcacgactgatgtttgcaatgtcattttcggcctgccgcattcgtcggagtcataatcatatatggttggcttgctgccgcgttaaggatgagcaagcttatccaaaatattgaattaattacccaattattcacacaattaagaattatcccaaattacttaaagtactattcacttttaatacactttatatatcatacaataacatataatatactttattatcatggtcatgtggtgccatacaaaataaatacatacacttattattttattaaaacatacgtgtaaaaaatgcataaattttctcaacttctaatttttttaatctcacataaagagtacaaattttcgtatccttaattcttaaaatggtaaaaaaaaaataaccttcttttcttgtaagaaaataattcatatctttacaaaaaaaggaatcccataaacttttctcatattaggtgtataatttaaaacatattcgaaagtagtaatattaataactatataaagtcatatttttcaaactatttttttcatcacaaaaatattttactcaaaataccatatcaaatacatatataacggtatcaagtttgttaaagttacagggtgtaacataaattttatgtataataatacaacaatcatctaaatagtgaaaaatattattacattagcataatacataaattcaaaataaaaagacatcatcagaacttacacaaatgatcaatttagttatgttagttagataattatatattatagtttaaacatatttaatatgattgattattttttcaccaaacagttcattgatatccaatatatctgtagaactccgagcaaacatgcgttgcacgatattcccgtcaatcgtataaatttttaaggttagttagtgttatttttattttattatatttattttatgaggaacaaaatattagaatcatatcctcttaataatttttaatttaaaaatgatgttctaagtatacatttccaattttgttacttcccaaatggaaaatcatggtaagacaaataattcaatattagggattgagccgtgagcatttgttgtaaaagtattaaaaaatattagtcatttttagtgtaggaagttaaattcttgtgcgaacacgtttggttgcacgttattcaatcaaagttctacaacaattataggaaataagaagttttatttatcaaagggtaagactttataatatttctattcacaataaaaatagaatatgatgaaaattatgctcctcctaaaacaaatttgcaactttttcttttaatatatatatatatatatatatatatatatatatatatatatatatatatatatatatatatatatatatatatatatatataagtgggcataggcaagatgatttggcatacctctgtggccaagaaacacatttatctttttttttttcctcttatttttcttcttcttcttcttcttcttcttctatttttatgtgccttatttgataacattaaatgactcaataattactgcttcactctaaattctctttattgcgcatctatctcttccttttcttttccccacctctttagtttcttcctaataattataacgtttgaaggtagtaacaacccaacaaaatgctagaggctgtagacacaaggttctgtcagcttcccaacaagcttagtcaaaactcatcatgttccataaggtaattctaaatttcatattttcgccaatacgggaaattttgcaactgcagatgttattataccaaacaaactttcaaactgtgaatgctctcggaatagttccaggtatctttcttgaaaatttcatatatataagatacagatatttaattttttaccgtgaataaatttggaacattatttagtatcatacaaactaaatagtctttagatgaaagtaacacaaatttaatcagttgctcaccaccaacttattttttcattctttttttcgttcttttggaatcttcttttcttgcaggttctttatctgtttgtaattgtaggcttagaacaatactaccttggatgtaaatccatttatcataattttttattttttggtaattcattgatgttttatttttgcctgacaataaatgttcccaagtgttgtttgttctatttatttctcttatatggtggatgccattttatttatcatgtttttgctttttggtaattcattgatgcgttgtgtttgacaggtaattatgatttttaattgatgttgttctttattgtttcattcttctttgggatcttagaagtgaatttctaatttgatttctaatggtataaattttcttgaagtgatagcacgtttttatttattataaatttttatatcaattattttctatttctttttatgtaataattaatacttcccattccctctattttggaatatatataactatattataactgcagtcaaatgattttgtgggccattacaaagttatttttaggtttatgattcggtcttttttttttttttaacttatgggagatttgtttttacacattagagatctatgttttacacataagagatttatcttttacaaataaaaaatctaaaaaaaataattttttaatttcaactgaaaaaaaccgtgaaggcccatctcatgtattttattaaaaagtgtaagcagaaacttagcttgaatgtggtggagatggaactaagaggtaaatgtgccgttatgttcttttggttaaattggaagtgactgaaaagtgatgtgagaaaaattcttggatttactactaattagttgcttctgggaagattgtgaaggaaattaaatgtgtacaagcaggcattgtccgtaatatgttttttttccggactttttagtaggcatttggacataaaaattataaaattcaaaaaaatggtgaatttttttttaaagtgaaaatagtatttgaaatttagaattgtgtttggatataaatttcaatttgggttgtttttgaagttttatgagtgatttgagtgaaaattttgaaaaacaaccttttgcaatttttcaaattttcgaaaatttcctaaatgcatcttcaagtgaaaattaaaatttttatgaacaaacgctgatttcgaaaaaaaagtgatttttttttgaagaaatcttccatcaaattttatgtccaaacgggtacttagtttcgttgcttttcgttttattttcttttatttatttgaatagaagacaagttcatcaaacaaaagttctaatatctaataaaatttaaaaacatcaagtccttagatcatgtattatgaaatatataagactaagagaatcatgtattaatctctctccacaaaaaaatatatgatttttcccttaaaagtttttttttcatttttaagaatatttgataataaaaaatgtagttttctaagctctaattttacaagaacatttatcttgtgatttttttcatcaatatataaaattagttttttagttaaacagctgaaaaattctatctttaattcttaataaatttataaataaaatcctttcgaaatgggctgctatttctgaaatcgcgcgaaacgcgcggcaaattccctagtatatatataaagttggggatagaataagtgatgtggcaccctccattgaccagcattactatttatcttttttgttattttttttagcattttccttaaatttttccattttttaaaatgttctactaagaaaaactgaacacgcttcttttccgttacaagaaaacggtcacatctttaattcacttaattagcctcttcttaattcctcccacctgccggtatttagtacccatttgctacagttttccccttctttaaaattgccaagaaatggttatgaagaagcaaagagcatattaagaaaatggagaggaattggatagtggtcaacgttcctgtgtgatcttaagcgtttcttacagatctgaaaatccataacatgaaaatgaattcttgaaatgactgtattatttttgggtttttgtacttctttttcaccggacatttttagccattcagattaattttcttgtaagtaagccatttgttttgctctttcactttttctctttcaacatatagttttcaatcgtttcaggtggaacattgaaatatctacaagtatagccaaatcaatatccattctttctcatgataatcttatattaatggcaattattcttggtatgtttatcacgactaacagttggaaactcttacactaagaactctgtcctttttcgtttattgtaaaatatttgttgtcaaaactcattaatttgttcacaaactgcaggattgttcaacaatcattgctcatggaataacaatggttttcctctctattcatcattggttctgcagtcatggctgttgttcaactattgctattgaactttgaagtgttctttttcatattgcaattcaaaagtaatatctccaacgaagttcatcactatatataccaagaactggagaaaccacggttgatgctttaaggagaggacttcctctgttagttattataaatttatactttaattcagttaaatttatataatttaccagatttactaaattcttgacataaataaaaccttctttgacaagactttaacgtaatagatagctctatagtctaaactaaacgtgggtgatcttaatgtctttggtcttttgattttggtggtctttgaattttacgtacaccattggaggtggagattaacataactgcatatggatgacactttggtgatgatcaactaacaagatacgtaatcgcaagtataagtatgtgcatatatagaagctttgaccattccaaacatttgtgtgataaatacaggtgtagagaacgatgtggtcaatgctttatagcaaagttcaagaatttgatatttttacgtggggaggctttctgttaattgaaaattttcaattttaaatattatctcttgggattagtgatgttcataatcatatgttagagaataatcatttgtctatttttcatatgtaataaaaattagtcgtgaaatttgtaatatgaggagctttgaaatattttgttgactctatctcacctaaatttacaacaagatcacatcataagttcacctttttatgaccgcacgaagcgcggacagactaactaattctattataatgatgatagcattagtggctaactttttttatttctaaatgtctacagtaataatattattagaaattaatttaattgttatagtgatcacaaagaataagctatgatatttaaaaaatatattccttccatttccataagtttttttctcatcatggtagtctttttcatacgcattaggaagaatttcaaatattctttcaacataaatttatatttacctgcaaaagataatcaatcaactttaagatggttatttctgttctttcttatcctcttctcttattttgtaagatatccatattgattcactttcttttttatggataattatactatataatttgcttatactgtttaatttttacttaaaaggtacgatggaaaaaaacaaaaaggttaacattctaatttaattaaaacaaatactataaaatccagaaaaattaaagaatttgatcttaatcgaaactaaaacatgaagagacaagtcattttgacggtattataaatagatattacataaaagtatagtaaataaataaacacaagagaaaatcttagattctattttaatgagcatgactcattcgttctttctaaactctagatcgtatgtttaacacttttaatttcttcccgccttatagagtaactatgtttacatgtaaaatagaaaataaaagtatgtcatatttacaaattataattaaaacgttaaactcaccttaaaatctgcaagataaaataaaagagtacaatgttgcagatgaaaactcagtattttagcaccacaagaatttgctttctgcaacataagttttagcagtattatcaattgcataattttcctaactcgtaagcacaaaactatatggtagttgctttcatttgatctttgcacctaatcttcatgagtctgttcacagtttttacgatataaaagtaatttttgtttactgaatataaaggaaagagaattcaacgacctatctctaaaccttccatttagttttttttaactaaataatcacgtcgctaaacaaaataaagaatacctacatattttcaaatattatactgatttactaaagtagtaaacataacaatgacttacctgttgcaacttaaaatttagaatagaccaaattaagatattacttaaaaagcaaaaaatataaaaaatgaaaaggacaacatctgtcttttgtgttttaacttttaaataaattttatactctttatgcatagatatatgacatattacatctttttttctatttgttattttttacttttagttgcttaaaagatcacaccagaagaactctcttgctatatatgaagccataaacctaccgtagttttatgactttgaatgtataatagttccttccaatttggagttttgtctttcttcgtttggtttatttaggattcctaagtgtagtcttatgtcctaaaattaataggattacaatattaatgtcaagaatttcagtaatgttcttttattgtgagttattatatttaatattataattttttttttgtaaaccgacattgtattcatactttataataatatagatataaatagacaaatataaatcgatagttttcgatcaaagtgttttttcaccaccaaatttttagaatatgcgacggaccaatccgacgcaaaaccataaaaatagcatcctcgacggatttgtgacggatcagaacctaattgcaaattcctaaatagttcagtgacacctgcattaatagaagtgtacaaggtgccattggcaaggcagttagttacagctacacgaaaaaattttctccttagtttctctatttcactaattcattttgaattatttttctcctttttttttgaaatagtaaacataaaatatggaggtttttttctttccctcaaacctacccctgaaagaaaacatgaaagaattgtgaaaattttcttttccttgtattgataatgtatcacgacccaaaacccagacccggtcgtaatggcgcctctcgtgaagacaaggccagccgacactttccattatccgattattaacaattaagcatttaagataccgtctaaacatgaagaaataaaccaaagtttaagcaattgatagtataatatgtgaaatacagcccaaacacagcccgataccggggtgtcactagtaatgagcatctaaacaattcagaatactacaaatcaaactacagagtttaatacagaaactaagaacataaagaagtatgatagggaagctccgggctgcgaacgccaatagctacctagagactcctcggatccgcctgagccagaatgatcaacactcgggagcgggaccagataagcctgaatttgcacacaaggtgcagggagtaaagtgagtactccaactcagtgagtaataatcataaataaagactgaaagcaggaaatcacgtaaggcacaaaagcatgctataatgaagcagtgaaaatcctttttaaaacagtaaaccagtgaaagataggtaaaaatcatgtaactcaaatttacttcctgaaaagcctttttcaacaattaagcaggtaattgatagtcaattatgaaaataaacacataaaggttaacccctcgggcacagtatcaacaaatccgtccctcgggcaacatctaagaagatgacagtatctgagaacaatactagcccctcgtgctcaatctcgtatcacaatgggtacccgcgctcactgggggtgtacagactcctggaggggccccttacggcccaaacgcaatatcaagccacctcgtggcatcatcactaggccctcggcctcatatcaatcaacccacctcgtggcgtacatatctcaagccctcggcctcataatcagtatcaaatgtttcctcacaacataggccctcgaccttactcagtcaaaaatcctcacaagccactcgagcaatagtaaaacagtgtttctcagtccaaacatcatttaaaatatcatttaagtataaaaactgagtaaaacatggctgagtatgaaaacaatggaaaataacatgactgagttcaagcataaagtcaaaacagtgaggaaatatcaataaaaatcaccgaagggttcaaatagttagcacgaagcccaaatatggcattcagcccaaatagtgatgatagaaaatagatttcagtcaaataggcggtaaaatcatcaatcaggacggaccaagtcacaatccccaatagtgcttgataactagggattttgatacattttatactccttcatgcttaagttttgattagaaatgtgtacaaatagtcccaaaaggctcacaagttgcgcttgattgcaggtttgatcaacaaggtaaaaagatgtcaaagatcagctcaaaaaggagtgaaacttgcacaagtaccaagacaagacaagctcaggcaaaacaaggccaatgcggccgcacaacattctgtgcggtccgcacaagtgaggttcagaaaggctgctattcaggcaaaaaaggcaatgcagacgcacaaggttttgtgcggtccgcactgggatcaatgcggccgcactcgatttagtgcggtcagcagagagaaggttcagagagttgccaattccaagtttgaagcctaatgcggtccgcgcttcatttcatgcggaccgcaccagaagccatcgcaaccacactcgattctgtgcggtccgcattgcccaagttcagagagccgtttattcaagtccagagccctagtgcggccgcatgtgattttgtgcggtctgcactaaccccgtaggggtatttttgtccaaattttttagcttagcataaatagcttctttttccatttttaggtcatcagatagttttatacactggctgcgctcgtgacttcgttatttttagctgttttgagtaattttagctttatttcaacattgaatcttcaagtttaatttagcaattaatgaatgtgaatttttcttcatctatttctttgtccttctctaattatgagtagctagacccataagctaggattgtggctcaaccctagtgtggataattgacggatcttttattttgatgcttgattgtctatgggtgtttgatatttggactaatttcatgtttaattgctgaattagtggttgcaaacactagtttgtgtttagttgactttgactcttcttgagaaagagagcctaagtctctgaaattggtccaacaaggaattggggcgtactcaagagattgatagccccaattaaagggttaaacatagagatagtaatacccaacttgaaccttgattgcttgtacaaatttgcatacccaattggtcatgagaaagtcaattcggaaaaaatcactcgaactactgagaggtgtagagtgagtagaatcgtgcaatggttatatcatactccccaaatgtgacaatcatatcttatactcaagtacccgtcaattgaccacctaggcgaaagtcactaccttagtgccttttaatcatttgaacaactcgcaatagtttaatcctagcttattttagtttaattgatcattgtagttctatacaattagaagtaaaacaaaactcaaaatgtttagaagtgcaattaagagcaaatacataactccactttagatagacacccgactccaacttctagctccatgtggaaatcgatcccgaccttaatcgggtaaaagctgcttcgacctttctcgctactcaatagtagtgtagggttagcttcgatcactttttggcgcgttgccggggagctaacgttttggctatctatctaaatagttttgtgtattgttcttctttccttctttgttactaatttgtttgtgtcacaacttcaggtacaaatggcagcaaaaacgcaatgccctcttggaaatgtgattgggggaggaggtagatgttcgagatgatgaggtgcctctgtacctcaaggacaacgtagaggccgccaggccaatgctaatgaatgaaatattccagaccctcctccgccacctccaagagtggctcctagagtgcttccgaaccaaggctatgcaagtgctattgtcccacccgaatcgggcgggcaattttcaaataaccaatgtgtatgacttgctgagcagtgggtatttcacgggcgctgcaaatcaaaatgcttacaaacatctcaaggggttcgtggatactgttggggagcaagcaaactaatgtgtccgaggatgccttggttgagactcttcccatttcacttagagggaaggcattggattggcttgagcgacttcccaaccattccatcactacttgggatgagttggcggaaagttcattgcaaaattttctcaccggggcatatggtgcattgagagatgagatcttggttcaagcaagacccacgaacctttgcatgagatttgggagcgttatagaacaatggtgaaggaatgccccaacaatgatatgaaggcgatgatccaacaatttctaccggggcattaacacaacaaaccaatgcatagtgaaccaacttgtggggcaacttcatgaagctgtcttatgatgaggcttgtgacattcttgacgagatggctgacattcttggcaaagtagagccaatgtgccccagggtgaccccacggttactcatttgcacaaggagttacatgatcatgggcaggctatagctgagttgacaactataatgaaccaactagcaaaggcacagttgcaacaagttcaaaatcctcgccaagtgaatgctatggaggggttaacatgcttgtcaacaaaagaagacaaagaggcaacaaaaccaagggaattcagagcaatttgacaatgattgtggtggatttcaaatgatggttatgatgaacaaatgaagaggtgcaatatgtaataattatcaaggccaaagggcaattcttccaaccaacaacaatggagacccaaggcaattggggcaatcacaacaacaaggcaatggtaattggggaacaacaaccaaaacaacaactgggcgaatcagaacaacaatcaaaactcaaggaaattggaatggtaatacaaacaattggggtggtaaacaatcaaggtggatggaacaatggaaaccaaggaaacggggcaaggctttcaaaggccccaatgtaccaacaaccgaacaatccccccatttccatccaaggtcctagttcttctagcaatgatatgggtagaattgaaatgatgttcgaacagatgatgaagaagaatgcggattctgatgtcagttgcttcccacaatacctcatcgaaattggaggttcagttaggccaaatctcacagtcttgaatactcgccctaagggtgctctaccaagtatataggtagtaacccgaagggtgggaacaatcatgttatggcgtaactacaagagtggagaggcggtgatgtgaatgcctccaaacaaaagcaaattttgagtgatgatgttgagttgcaagaagatgaagttcctttggttgaaaatgtgattgatgaaatatgaatgaagaagtgaggattgatattcaagatgcgaggtggaaactcaaaatgatgtgaacccgtctagggaacactaatagacatgccggagccggttgtgcctaaagccaaggtcctttgccaaggccacctccccttatcctcaaaggctcgaagcagaaaatgagaatcagtttaaaaagttcattgacatgatgaagagcttatccattaatgtgcctttggtggaggctcttgaacaaatgcgggctatgctaaattcatgaaggacttggtgacaaagaagggtctatggattgtgaaactataaagatgactcaccaagttagtgcaatagtgcattcaatggcccgaagcttgaagatcccggtgctttcaccattccttgcaccattgggagtgcggattttgcaaggctctatgtgatttggggctagtatcaatttgatgccctactcgttttcaaactttgggtattgggcaacctaggccgacttccatgagattacaaatggcggatagaacgatgaagagaccattgggtattattgatgatgtgcttgtccgggtggacaaatttatcttgccagctgactttgtgatcttggattgtgaggtggattatgaagttcctatcatattgggagacctttccttgctacgggaaggccttagttgatgtggaagcaggggaactcaccttccgggtgggtgatgaaaaagtggtctttcatgtgtgcaatcaatgaagcagcccaacagtaccgagtgtgctcttttgtggacctcgtcacaagtgatattgatgacaccagtgcaatgatcaatgtggaggacctcattggaggccgtattgttgaatcttgatgtcaatgatgatgaggccgagtggagtgcgtgaatgctttacatggaatgggctcttactcttatgagcctaggaaattatctttggctcgagaataggaagactccaccaacaaaaccttcaattgaggagcctccggtgttggagttgaaaccactgcctccacacctcaggtatgagttcttaggctcaattctactttgccagttattctttctcttgtcttactaacatgcaggttgatgccacattggcggtgcttcaaaagggaaaaaggcaattggatggactttagctgatattcggggataagcccgcattctgtatgcacaagattattctggaagatgatgcaaagccctccttggagcatcaaaggaggttgaacgaggcaatgcaagaagttgtgaaaaaggaggtgatcagggttagtgtaccccatctctgatagctcttggacttcaccggtgcaatgtgtaccgaagaagggtggcatgaccgtggttgcaaattacaaaatgagttgattcctaccagaaccatccggttggagggtatgcatggactaccgcaagttgaataaagtgacccgcaaggatcactttcctttgccttttcttgatcagatgttagaccgacttgctgggtgccttctattttcttggatgggtattctgggtacaaccaaatcttgattgctccggaagatcaggagaagaccacattcacttgtccataggcactttttttctaggatgccttttgggttgtgtaatgcaccggctacatttacggtgtatgatggccattttcaccgatatggtggaagacattttggaggtgttcatggacgactttatgttgtggggattcatttgatgatgcttgaagaatcttgatagatttggcccgttgtgaagaaaccaatcttgttctcaattgggagaaatgccactttatggtggaagaggcatagttcttgggcataaaatttcaaagcatggtattgaggtagacaaagcaaaaattgatatgatttcaaggctccctcccctacatctgtcaagggagttgaagttttcttgggcatgggggttctcggagatttatcaaagacttttcgaaggtagtgaatcccttgtgcaagttgttggaaaaagatgcaagttcgtgtttgatgaaaatgtatgcaagcctttgaacttctcaagcataagttgaccaccactcctatcattaccgcacctaattagagcttgccctttgagctcatgtgtgatgcgagcgacgttgtggttggagcggttttgggtcaacgagtgaacaaaatgtttcatccggtgtactatacgagcaagacaatgcatgatgctcaagtgaactacacggtgactaagcaagagcttttgtctattgtgttcgcaatggaaaaatttcggccgtatctcatgggtgctaaggttattattcataccgatcatgccgcactccgatacttgatgacgaagaaggattccaaagctagactgatgcgatgggtcttgttacttcaagctttgaggaggaggggaggcctcgtgatggcctagaaagcaattattcatttcccgacgaacaactcctttcggtgtcgatgaatggaatgctatagtttgcagatgttgctaatttccttgtgactggtataatcccgtgtgagctctcttctaaccaaaagaagaagctcaagcgagatagtttggatttctattggtatgagacatacttgttcaagatttgcacggatggtgtgatccgaaggtgtgtcccagaggaagagaaattgagtatcttggaggtttgtcattcctctccctatggtggccataatggcggggcgaggacgacttccacagttcttagttgtggattttattggccaactttgtacaaagatgcaagtgaactcgtaaagaggtgtgacgaatgtcaaagagggggcggaatttcgaagaaagatgagatgcctctcaataccatccttgaggtggatatttttgatgtatgaggcattgattttatgggtccgtttgttagctcatgtgggaacacatacatttttgtggcggtggactatgtttcaaagtgggttgaagccgtggcttttcccaactatgaggcgcagagtgttgttgcatttctcaagaagagcagttttacaaggtttggtactcttcgtgcaatcataagtgatggggggtctcatttttgcaatagagcttttgacatttttcttgcaaagtatggtgtcaatcacaaagtttctactccctatcatcctcaagcaagtggtcaagttgaagtctacaacatggaaatcaaaaagatattgtcaacgacggtcaatgcttataggatcgattggtcaaagaagttggatgatgctctatgggcttataagattcttacaagactccgattggtatgtttccatatcggttggtgtttgggaaagcttgccatctaccggttgagttagagcacaaggccatgtgggccttatggaagctaaatcttgaatgggatattgcagccaatctctgtgtggagcagcttaatgaactcgatgaatttcgattccatgcctactccagttcttccttgtacaaggacaagatgaagtaccttcatgataaatatgctcgtagtaaggatttcaaagtgggtgatttggttctcttgttcaactcttggttacgtctgtttccggaaaagcttaagtcgaaatggagtggaccttttgaagtggtatgtgtgatcccgtttggtgcacttgatttaaagaacaaaaatggggaagttttcagagtgaatgggcatagggtcaagcactacttcggcaaaactgatgatagccacatggtggcacttcttcatctcaaatgatttgatggtaacttgcgtcgtgctgcgacgttaaatcagacgctttttgggaggcaacccatgtgtttttcttcttgtttttctttgattttcattgtaatataggatttatttttaggttgaccggttgtgagatgttacatgtttgtgtttatgcagtgcggcatatggtggaaaaattattcaagtctctgaagttttcaatgcggaccacactacattgtgtgcggccgcaaataactcagtgtggggggcacaaaatcagtgcagaccgcattgataaaggatgaaaatactagctctctgaagtttgccaccgcggccgccttgtattttgtgcggtccacggtgcctcaatgcggaccacattaccattttgtgcggtccgtggtgcaattgttcagagagtgggtagtctgaacaccacctctatgcagacagtattagcatttttgtgcggtccgcattggcctctatgcgaccgctttatattttgtgcggtccgcactgtgcaacatctgctactgtctgcatctttttattttctacaattgtgaacttaatttcttctactgatactaacaagtctaatggatgttgtttgcagacaatggtgaaacaagaggcaagggttctaaacaaccaggcaggggagagtcctcccggggagggaaacagaagatgctaagattgactccccaagcccgacaaaacattaaaaacacaaggaagctcactaaagctgctgataggtccattgaccagtctgggagtgaatacgagccctcccgagatatatcttcagactcaatcccagagtacatccctgactggccggagagaaacagactaagagacactcttccacctttccccactgtccaagcgtcagtaaatgtatcttctggttcgtctgagggctcagctgaaggtagtggggatgaatactccacctctcccacaacttcattatccgaagagggtgtagtaggggaagaagaggtagtaggagaagggggtcagccccaggttggtagggtagaacgaactagaaatccggaggtgtggcaagaccactttgtgagtgaggtggcctaccataaattcaaagaatggtggcctgtgaggaaattaatttcggagagaatttttgtagatagaaaccttttgcctcacaaccccaatgtgagaaggcaatttagagatagagtgggctgggagtatttcttaaacaattgtgaggatgcaaacgagcacctagtcaaggaattctacaccaatgttgcccacatcaagaagggcaccaaagtgaccaaggtgtgcaatttgaaagtgttgtttgataggaaaacaataaatgactacttggacttcgatgagaaggatgagtcgctgtatttggaaaagatggaattaggtgaggaggtctgtccttggttggcacagtatctggcaaacccaggtatcacccccgattggttgaatgcgggagtgaaaattttgataagaagtttgaatttcgaggccaaggggtgggaaacatttgtgtgtagcagattggaccccactactcatgaaaactcactccctcttcaccgggcagtattggtagcatcaatcatggtagggtacccaattaacgtcgggaaggtgatgtctcgggtgattacacaggtagttagtgaaggtgatagaactaacccttccctagcttcttgaccatgtactttagggaccgcaaagttgaaaagcggccatttgatatcaaggtaaaagcaaaggccccgttctcatggtataacatacagggtgatgacaacccgaaaggcaagaactacaagggaacatccactgatccaactggcaagtctgaagagccagttgtggtagtggctcctactcatcttgcctccacctcaatggacatccaccctggtccatccattttagcagctctagagataccctctacctcggctcatccagtgactgcacaatgtctaagccagacccttcttagcatcaacagttggatgcagacagcttcctctaagttgtttgccctcactactgcagtagcatctcagtcgacacctccacctctacaggtcctacagtctatgaggatgccctcaaggatattctggacaactagaaaaaaattcttgacactcaaaaatttcttacggacgctgtggagtcatatggaaaagctctcaaagagcttgctagggaggccaagaagatgagaaagacgcgggcttccaaggagtccgtgaaggagttgagggttaaggttgataggatgaaggcagaaagacgctttggatttattgctacaagaccctgtgccaacatctcaccctcagctagagcagtcccagaggcctcccaagaggaagaggatgattccccgagcagatgatgcagtcatccagttggcagacctaccggagacctcctctagtcagtcgtaggatgcagcccaggagcctgtctaggtctaggcctaggtcccagcagtagagcagtaggccatagggaaccagtctgaggttcccgagcatattaaggatccagggaccactcaggatcccatgcagacagacgggccatagagagtctctatatccttttcccttttattcttggtgcttattttgtttagttggcattgaggacaatgccaactttcatttgagggggtagtctctacttttattgatttggatgaatgtatatattcgacagattttaagatttctttctttttatctttggtatgtatataattttagtacttcattacattttttcattttttcgtactttttactttgggtctgtatataaagtttatgttacattgtatatattcatcccctctattgtatattcgattaaattccctcatgtaaatatttattttactttctgcatttttcttttctgtagcttcttatttatgttcgtagcttcttgttttgaatgtttgcaataagcctttggttttcttaatgccacgattctttccaaaggtggagtttgtgtgaaccgagtagctcttcccatttatggatggcgtgacaaccttcttaagggtttgagtccgtttttcgttttgcttttagtagttagtggtaagggtgcctcaagcaaagcgtcacttgggcctagcgcatttgacctcatggtcaaaaacaaattgttgtgtttagggtggtgaaagtcgtgaccttgagactcttgtgttgaccgataatcatcaagtggtgtttcgggactattgtgtgctcgaatcttatctaaggtcgttgtgggccccgactctgtgtctttagcgatcccatagcttgtgtggtgagaaattgcattgcaagtccaagtcccgagccattggtctagaacttgccctgaatgtttgttagaaatcctaagtgaattttgacttgagacatgattataggctctccttgatccaaatgatagcttgaacacttccatacctaccaatgataaatccctagtcaacccttttgagccttgacctttttccttcaagaaccatgatacaagcctttacccgttctaaaagatacctctcttggcacccatctttccttagcacatggcaaaagtataagtttgggggagagacgaggatgcaacaaagtggtaaaaaggtacaaaatgaagaaaaggaaaggcaatgaaaagaaaaaaacaaaaagacaaaagaatgttcaatgtagaatgaataaaaagggattcaagaaaagcaaagaatgaaaggtgtggaaagttgagaaaggagaaaagatttgaaatgtataagaaagagtgacagtgtgtctctctaaccccttagaaagaagtgaaagactcaaaaagtcaagtgaatgtggccaaatgaaacaaaagaagtgcttaagggaagatggaacctacttagaccaaacattcctaccctgaaccaaaagccttcactatgtctccacaaaagccctatatgatcttagttgaatgaacttacattagtggtgactcacataaggggcaagcatatggtacttagagccggacttgtgacttttccttgagagagatgagtgatttccattaacctcgttctgagtgccactattctaaaggtgaggtttcttagggagagttgaggatgtgtgagtttgggttccacaatgaccaaagtaatagaaagagttctttgatgtgttgagtcaactcttgatgctcttgtgttgcacttaatccatggtatttaaaagagtaaatgttgttaatgattcatttgtattgagggcaattgttagtcccaattgatgctagataaggtcactttaggataactgaattctcttggattttctcttaaggggtgagtcttattttgttcgcttgaggacaagcaaaagcttaagtttgggggagttgataactagggattttgatacatttaatactccttcatgcttaagttttgattagaaatgtgtacaaatagtcccaaaagactcacaagttgtgcttgattgcaggtttgatcaacaaggtgacaagatgtcaaagatcagctcaaaaaggagtgaaacttgcacaagtaccaagacaaaacaagcttaggcaaaatagggccagtgcagccgcacaccattctgtgtggtctgcacaagtgaggttcagagaggctgctattcaggcaaaaaaggcaatgcagacgtacgaggttttgtgcggtccgcactaggattaatgcggccgcatttgatttagtgcggtccgcagagagaaggttcagagagttcccagttccaagtttgaagcctaatacggtccgcgctccatttcatgcggaccgtactagaagccaccacagccgcaatcgattatgtgcggtctgcattgcccaacttcagagagccgtttattaaagtccaaagccctagtgtggctgcatgtgattttgtgcggtccgcactaaccccgcaggggtatttttgtccaaaatattcagcttagtataaatagcttcttttcccattttaggtcatcggataattttgtacactggctgcgctcgtgacttcgttatttttagctattttgagtaattttagctttatttcaacattgaatcttcaagtttaatttagcaattaattaatatgagtttttcttcatctatttctttgttttcttctctaattatgagtagctagacccataagctagggttgcggcttaaccctagtgtgggtaattgatgggtcttgtgttttgatgcttgattgtctaggggtgtttgatatttggactaatttcatgtttaattgctgaattagtggttgcaaacactagtttgtgtttagttgactttggcttttcttgagaaagagagtccgagtctctgaaattggtccaacaaggaattggggcgtactcaaaagattgatagccccaattaaagggttaaacctagagataataatacctaacttgaaccttgattgcttttacaaatttacatacccaattggtcttgagaaagtcaatttggacaaaatcactcgaactaccgagaggtgtatagtgagtagaatcttgcaatggttgtatcatactccccaaatgtgacaatcatatcttatactcaagtacccgtcaattaaccacctaggcgaaagtcactaccctagtgccttttaatcatttgaacaactcacaatagcttaatcctagattattttagtttaattgatcattgtagttctatacaattagaagtaaaacaaaacccaaaatgtttagaagtttagttaagagcaaatactcaactccactttagatagacacctgactccaacttctagattcctatggaaatcatcccgaccttaatcaggtaaaagctgcttcgacctctctcgctactcaatagtagtgcatggttgtcttcgatcagtgctcgaccccacattcgtcaccaggtgtgtgtctcacctcaatatagcaccacgatgtgcgaatccgggatttcaacccctcagaacatcatttacaatcattactcacctcgaatcagtcaaatctctagctcgcgactcctttgctcctcgaatcggcctctactcgcatcgaatctatccaaaatcagaacgaggacgtcaaaatatgctaagggaatgaagcccgagcgaaaataatcaatttacaacataaatcccgaaattaccaaaacttgacccccgtgcccacatcttggaattcgataatttttacatcaatagattccttatctccccacgagttcatacatataaaaagttctgaaatccaaccttaaatggtccttcaaatccccaatcaaaagtctaaatttccaagccctagtttttcaatttttggcttaatttccatgatttactaggtggaattaacattagaatagatgttgcgaccattttcctttcaagatttctgaaatcagttttgagttgttgattgtcatgcaacaatttcttcaacaaatcatttgtactttcttctacctgttgggtggcctttgaggttgattgaaatttccttggggtctatattgattctgatttaattgatttccatcctaagagaaattaggatgatttctccaatttgcattgtaagtgttcccatattgtgcctgttggttcatcggacctctgctttgttgtctcacataataaatagattcaggattcattggccacatgtcacttgtatgattgtcaccacacatttcacaacaaatcgacatttgttgaacatgttgcaattgttgtgtctagttcattgtcattctattcatttgatttgccaattttgctatatctgctctcatggctgaaaaatcatcaagttcaagtacccctgctgctttctgtttcattgctctccttggttctccctcaccttgccaattatgatcattaacagtgaagttgtttagcaaaagttgtatttcactatatagtctcgccatgcaactacgtccacaagctgaatcaagattcatctttgaagtctcatctaatccatcaacaaaagtatggcccaatatcatcagtttgacaatgatgtggacagtctcggagtagtttcttgtatctttcccaagcttggcgaagagtctcaccatcccgttgttgaaacccaagaatctggctccgcaaaggctttgtctttttagtggggaaaaacttgattaaaaatttctttgataaatcatcccaagtatggattgaattagcaggctccttctgcaaccattctttagcttcccccaacaatgaaaaaggaaacaaggttagcctgacatagtccttggaaacatttggaaagttgtaagtatccgtgatttccaaaaaattctgaatgtgcctctgcgggtcttcatgagatagacctacatattgcctagtggactgaattagctgtaccgtgtactgtttaagctcaaagtaatcagtgatatcaggcttaacaatagcctgagtcatattagcaagatttggccttcgagcttctatcaccgaacgccctccattacctgccatcactattggctgtggttgaactaaaatgcccaactctctttctgttttgtatctagcttccaactccttcctctctctatgaagtgatctttcaatttcaggatcaagagggaagagattgcttgttcttctactcctccgcattcaagagaagagcctgcgtggcacaaacaatgtgaactgaaaattaatacttaaaccaatggctgataaaagcttaacttagtcaagtagctaatttccaagtccccggcaatggcgccagaaacttgttgcgaccaaagcactcacgcaagtgtacgcgatcttcaagtaatatagtaataagtagagtatcgttcccatgagggcttatgattaacttaacgactgatgcaaacttaaacaattatcgattcaagctaattcatcacaaaatacataaataaccaatttacaatttaactagtagacaaacaataatacaacgcaaagttactacgccacttatgagtttttcttttaacaattaataaatgagatatcccggggttatgggcttgatagagatcatgctacgtttttagcttaaaaatgatttattgaattatccgggttattgattatagggttaataatacccagaagaatctatcgatttcttatgcgcctattcaagttaaatcaatacctatatttctatggtattaatattaactcaaatgcatttacaaatcctatttctcaaccaaacaaggcaattaagtatagttctatcttaattgcgaatctttcacccgatgcccaggatccagatcttgctctatttgattctatatgcaatcaacaatttcctttttcaagtttaactcaagattcgtaaatagtatttcattgttagctacgtagtaaaataattaacagcagaatcaaataaacaacccttaacgataatttcaagatcatcaatctaagtttcaaacaacataatcatctaacacccataaccctaaaatatttgggtttttagccactcataattatacaaacatcaaataaatagatactagaagaaagtttagaaaaacacttttaatccttgatccaaagtattgtctcctcttgattttgatcctccaagatggatctcctcgtctctttctctctcaaaacaggtctggtccatcaataatggatgcttttctctttttaatcgtgtgtgaaggggttttgacaattatgcctttttagaccgaaatagagtaattctgcaattttttcacgtccgcagcgccccccgcagcgtgtacatggattggacagaggcaaaatgcattttaacggagaaatacaatgcagtgcagattcttgcactgccacggcgcctcccacggtgcgacagtgcaaaattttgtgatgcttcattttttcatttgttttgctatccgggcttgctttgcgacccctgaactcgatcctgacttgatttatttagcttttactcagacttcaaagccccaaatcaattaaattcatcccaaatttatttcttaagtcggattaagctcaaacttttgtaaaatgcaataattaaagtgttgttacaacgactaaaatacgagtttttagcctatgatcaatcgagttttaattccaataatcttacctccaagtgattcccttgaatcactcttcaattcccttcaaaaagctctgaaaacgaccaacaatggaagaaataaatcccacattcgcggacaagacgaccttttaaaccttctgcccaggactaatttccttcatcgcgatcgcgggacatccttcgcgatcgcgaagtacaaatcctcagctcccagaattaactgtatgcgaatgcgtaacatcccataagaacgcgatgatcaagctcccaacactatgtgatcgcggactggctaccacattcgcaatgaacaacttcaatccaaaacccttggtccacttaactctacgcgaacgcgacccattccccgcgttcgcgatcaaaaatgccttcaccctatgcgatcacatccccatcttcgcgaacgcactgagtaaactggactgctcccactacaactctacgcgatcgcgagactccttacacgatcgcgaagagtaaaagctctgcaacggctaaaccataatctgcaacatctccaaggcatgaaattgtccgattgatcatccgaaactcacccaaggccctcgggacctcaaccaaaggcaccaacatatcccaaaaccttattcaaacttgtaccaatctttaaaacatgtcaaacaatatcaaatcaaccaaatcactttggattcaagcctaagtttctaaaatattccgaattctgcttttggtcaaaaacccaagcaaaccacgtccgaatgacctgaaattttgcacacacatccgaaacgacacaacagaactattgcaactctcagaattccattccgacccctatatcaaaatctcgcctactaatcggaaatccccaaaatatcaacttcgccaattcaagcctaaatctactccgaacctccaaaactcattccgatcgcgctcctaagtcccaaatcacctcccgaagctatccgaactatgggaattcacatacgatccgtataacacataagtcaacaatccagttgacttttccaacttaagcttcctcaaaagagactaagtgtctcaaaccttaccaaaatcattccggattcgatccaactaacccgataccacataacacggatacacaaagcataaagtagaagaaataggggaaatggagcggtaactcatgagatgactggccgggtcgtcacatcctccccaacttaaacaaacattcatcctcgaacgagtaaagaaacatacctgaagcctcaaacatgtaaggatatctgctctgcatctcccgctcggtctcccaggcagcctcctccacagaccgacctctccactgcactttcactaaagctatatccttcgaccttaactttcgaacctgacgacccaaaatagctactatctctacatcataggtcaaatcatcatccaattgagccgtgctgaaatccaaaacatgagacagatccccaatatacttctggagcatagaaacataaaataccgaatgcacactcgacaagctgggtggcaaagcaagctcataggccgcttccccaatcctccaaagcacctcaaaaggcctaatgaaccgcagactcaattttcctttctttccaaatctcataacacccttcatgggcgaaacttttaacagaaccttctcactaaccatgtaggacacatctcgaaccttcctgttagcataactcttttgcctcgactgtgctgtacgaagcctctcttgaatcaccttcaccttctacaaagcaacctgcaccaaatctatccccaatagcctagcctcaccgggctcgaaccaaccaactagagatctacaccgcctcccatacaaagcctcatatggagccatctaaatactcgactggtagctgttgttataagcaaactctgcaagcggtggaaactaatcccatgaccctccaaaatcaatgacacaatcatgcaacatgtcctccaatatctaaatagtgcgctcggactgcccgtctgtctgagggtgaaaagttgtgcttaactcaacctgagtacccaactcttgctgcacagacctccaaaactgcgatgtaaactgagtgccctatcataaatgatggaaacggggacaccatacaaacgaacaatctcccgaatataaatctctgccaactactcagaagaatatgtagtacatacatgaataaagtgcgcggacttggtcagacgatccacaatcacccaaatagcatcaaattttctcaaagtccgtggaagtctaacaacaaagtccatagcgatcctctcccacttccactcaagaatatccatctgctgaagcaagccacccgatctctgatgctcatacttcacctgctgacaattgagacaccgagctacaaatctcacattgtctttcttcattcttctccaccaattgtgctatctcaaatcttgatacatctttgcggcacccagatgaatggaataccgcgactatgggcctcctccagaatcaactctcgaagcccatccatattgggcacacaaatccggccctacatcctcaacacctcatcatcaccaatggtcacatctctggcatcatcatgctgaaatctgtccttaatgacaaccaaatgtggatcatcatacaagctctcactgatgcgatcatataaggaagactgagaaaccacacaagccaatacccgactgggctccgaaatatctaacctcacgaaccaattggccaaggcctgaacatcaactgcaagaggtctctccccaactggaatatatgccaaactccccatactcactatctttcggctcaaagcatcagccaccacattggcctttcccggatggtacaatatagtgatatcataatccttaagcaactccaaccatctttcaaattaagatctttttgcttgaacaagtgctgaagactgcgatgatcagtgaacacctcacaagatactccatacaagtaatgcctccaaatcttcaacgcgtggactatggaagccaactccaaatcatgaacagggtagttcttctcatggggattcaactgacgagaagcataagcaataactctgccctcctgcatcaatacacaaccaatcccaactctcgaagcatcataatacatggatatgaacctgaagctgatggcaaaaccaatactggagttgtggtcaaggctgtcttgagcttctaaaagctctcctcacactcgtctgaccatacaaatgaagcactcttccgagtcaactttgtcaaggcgatgtgatagatgagaatccctgaacaaactggcgataatagcctgccaaaccaagaaagctgcgaatctctgtagctgaggacggtctgggccaactctgaaccacctctatcttcttcggatcaacctgaataccttcgctagataccacgtgccccaagaaagccactaaactaagcaaaaactcacacttgaagaactctgcataaagcttctcctctctcaatctctgcaacacaactctcaaatgttccgcatgctcctcctgactacgcgaattccccagaatatcatcaataaagactatgacaaacgagtcgagataagactggaacacgctgttcatcaaatacatgaacgctgctggggcattggtcagcccaaaagttatcaccaagaactcataatgaccatatcgggtccttaaagctgtcttaagaataaccgagtccttgatcttcaactggtgataacttgaacggagatcaatcttggagaacactctcgctccctgaagctggtcgaataaatcatcaatgcgaggcaaatgatacttgttcttaattgttaccttgttcaattgcctataatcaatgcacatcctcatagtgccatccttcttctttacaaatagaactggtgcaccccaaggtgacacactatgccgaatgaaccctttatcaaggagttcctgaagctgctcctttaattccttcatctctgctggtgccatacgatacggtgaaactgaaatgggctgagtgctcggcaccaggtcaataccaaaatcaatatccctgtttggtggcatgcccgataggtctacaggaaacacatcaagaaaatccctcacaactggaacagaataaacactaggagtctcagcactgacatcctttacaaatgctagatacgaaagacaacccttaccaaccatacgctgggctttcaagaatgagataactctactggaaaattagtcacacctcgccactcgatccgtggcacacccggtatagccaatgtgattgtcttagcatgatagtctagaatagcacgacacggagatagctaatccatgcctaaaatgacattgaaatccaccatacttaacaataatagatccactcgggcctccagacccccaatagtcaccacacacgattggtacatacagtctacaacaacagtatcacccaccggagtagatacatgtacccaaataacgagcaaagtatgatgacacataagaaatggtggaaccaggatcaaataatacagaggaatatttgtggcagattgaaacaatacctgtaataaccgcatctgaagcaataacatcgggtctgcccgaaagtgcatagaaacgggcctgaccgccacctgatcaacctccctctctggggtgacccctagctggctgggcggatggtggtgaagtaactggtgctgaagccgataactgattcacccgcatgcctcaaactggaactaacatagcacataaccgtgcaatcgactaattaatagtggactcccccacttggctcgaagccatagaccaaaacatatacaataactcataacgcatatactttattggtgccataataccatattgagattaaactcaatcctttataagctcgtggaacacagaccatcttgtagtttatatcttctgcaaatctcgcattcactctcgtagtagtaaagcctactctcttgagcaacccaaattcaaattgtaaaacatatatttccctggtaacaaatgacacaagggattacacaaacttcagaataatccgcaggagataaccctacctgctttgcctcaaacaaacatttctgtataccttccaccatcataaacattacgcagttacttaaacttcttgagtctgaactcagaccacaacatgaaatttactccactcccaactaggaaacatagaaagattcttcacacacccataactcggggctatacctcaaatcaagataaaaatcgagcacctaatagtccttctatcctccagcaaacccttctcgttgcttccaaatcacatgaatacatctcgcagtcacatcacattcatcacgtaactatccagtcatcacctcccttaatagggacataacagaacatatggatccagaaactgcgctcatgaaatcaacagctcagggctcaagctataggcaaaaatccggcctcgagtcctccaaactggcccaacatcaatgcacagagatcacatctcacccctagattgaggaatcacaagccatcaatgcacatctgataccgagcgctcatgcgcacatacgaacgtgtggaaagaattcaaagagttacttttcaagctgaatcaaggacgcacgagaagaattcaagaatgtgaagtttttcctaaaggttctgcagcctctcaaggataaatacagacatctccgtaccgatacacgagactctactaaacctgcttataactcgtgagacctatataacctaggctctgataccaacttgtcacgactccaaacccgaacccagtcgtgatggcacctctcatgaagacaaggccagccgacacttcccattatccgattattaataattaagcatttaagataccatctaaacatgaagaaataaaccaaagtttaagcaattaatagaataatatgcggaatacagcccaaacacaacaattaatagcatactgataccggagtgttagtagtcatgagcatctaaacaattcggaatactacaaatcaaactacagagtttaatatagaaactaagaaaatgaagaagtaaaatagggaagagctccgggctgcgaacgccaatagctacctagagactccttagatccgcctgagccggaacggtcaacactaaggagcaggaccagatacgcttgtttctgcacacagggtgcaaggagtaaagtgagtactccaactcagtgagtaataatcataaataaagactgaaagcaggaaatcatgcaaggcacaaaagcatgctataatgaagcagtgaaaacactttttaaaacagtaaaccagtgaaagataggtgaaaatcctttaactcaaatttacttccttaaaagcctttttcaacaattaagtaggtaattgacagtcaattatgaaaaataaacacataaaggtttgccccccaggcacaatatcaacaaatccgcccctcgggcaacatctcagaatagtacctgcccctcgggcattatcttagaacaataccagcccctcaggctcaatctcgtatcacaatgggtactcgttctcactggggatgtatagactcttggaggggccccttacggcccaagcgcaatatcaagccacctcgtggcatcatcactacatcctcggccttatatcaatcaagccacctcgcggcgtacatacctcaggccctaggcctcataatcagtatcaaatgtttcctcaaaacataggccctcggccttactcagtcaaaaatcctgacaagccactcgcgcaatagtaaaatagtgtttctcagcccaaacatcatttaaagtatcatttaagtattaaaactgagtaaaacatggctgagtatgaaaacaatggaaaataacatgattgagttcaagtataaagttaaaacagtgaggaaatatcaataaaaatccctgaagggttcaaatagttggcattcagcccaaataattatgatatcaaatagatttcagtcaaatacgcggtaaaatcatcagtcgggatggaccaagtcacaatccccattagtgctcgacctcacgctcatcatcaaacgtgtgtctcacctcaatatagaaccacgatgtgcaaatccggggtttcaaaccctcagaacatcatttacaatcattactcacctcgaaccggtcaaatctctagctcgtgatgccttttcccctcgaatcggcctctaatcgcgtcggaactctccaaaatcagaacgaggatgtcaaaatatgctaaaggaatgaagcccaagcgaatataattaatttacaacataaatcccgtaattaccaaaacccaacccccgggcccacgtcttggaattcaataatttttatatcaatagatttcttatctccccacgagttcatacatatcaaaagttctgaaatccaacctcaaatggtctttcaaatcctcaatcaaaggtctaaatagtgaagccctagttctttatttttggcttaatttccatgatttactatgtggaattcacattagaatcgagttttaagtccaagaatcttacctccaagtgattctccttgaatccctcttcaatccccttcaaaaagctccaaaaatgaccaacaatggaagaaataaaccccacattcacggataagacgaccttttaaaccttctgcccaggcctaatttccttcatcgcgatcgcaggacatccttcgcgatcgcgaagcacaaatcctcagctcccggatttaaccctatgcgaatgcgtaatatcccatgcgaacgcgatgatcaagctcccaacactatgcgatcgcggactggctaccgtattcgcaatgaacaacttcaagacaagacccctggtccacttaactctacgcgaacacgacccactccccgcgttcgcgatcaacaatgcctttaccctatgcgatcacatccccatcttcgcgaaggcactgagtaaactgtactgtccccacaatagctctacgcgatcgcgagactccctacgcgatcgcgaagagtaaaagctctacaacaacttaaccaaaatctgcaacctctccaaggcaagaaatggtccgattgaccatccgaaactcacctgaggcccccgggacctcaatcaaaggcacaaacatatcacaaaaccttattcaaaattgtaccaatcttcaaaacacctcaaaacacatcaaatcaacaaaaacacatcggattcaagcctaagtttctaaaatcttccgaatttcgcttttgataaaaaacccaaccaaaacacgtacaaatgaactgaaatttttcacacacatcccaaatgacacaacaaaaatagtgcaactctcggaattccattccgacccctatatcaaaatctcgcctactaaccggaaatcaccaaaatatcaacttcgccaatcaagcctaaatctactccaaacctccaaaacgcattccgatcacgttcctaagtcccaaatcacctcccgaagctatctaaaccatcgaaattcacatacaagccctctaacatataagtcaacatccggttaacttttccaacttaagcttcctcaaaagagactaagtgtctcaaacctttccaaaatcatttcggattcgattcaaccaacctgataccacataacacagatacacaaagcataaagaagcataaatggtggaaatggagcggtaacgcatgagacgactggccgagtcatcatatatatatacagatttatcctattgtaaaataacaaataaagaatattcctatacacttgcactactcctatttgtctgttgtgcaacagaaaactaaaaaatattctttcccatatgctcatgcgagaagcacatgagtttgacttcttggaagcttatgtacaactgtttaaatattaatcagatggttgagaataaaagattatgagtacgctccatgattcttccacgtgtagggatgagctataattgataaaagacttaggcacttcaacacaatatagagaagtctgaaaagctaagtgtttgtctgagatgtttcttcttcttccttctcttttctgtgtgaagatggttgtgaaaatggcttctcttcatcatcccccctcaagctggagggtagagacaaaaaccccagcttgctcatgatgttggtgtgagaaaccctagataagggtttggtaaagagatctgcaatttgggatttttaaggaacgaatgaaagggatatcaatccagcgagaaattgctatcgaacgaaatggcaatccaactctacatgtttagttcgttcgtggaagatgggattgcgggcgatatgaatcgccgccagactgtcagagtgtaaaggaaccggcaaagttggaggagtagataaatcagcaaggagtcgaacaagccaagtgatcttagcagtcacccatctcatggatcgatactcaaattcagcggatgacaaggagatggagatttgcttcttcgatttccaagaaataggggcacctccaagagtaataaaaaaaccactgacggagtgacgagaatctttacaagcagcccagtcagcatcacaaaaagcgacaagatcaaaagagggagcagaagagagaaggataccttggcctgggtctgatcaaagatatcagaacactctgagaccagtagaaaaatgtgaaagagaaggcctttgcataaattgactaaggcaaagaaaagaaaacaaatatctggccgagtattggtgagatagttaagttcacctaccgatcatcgataaagagtgggatcctccattggtggttctaattcagcgtgcaatttggagtatggatcaagaagagatgagacggtaggccctttacaatcaaactcaaccaatagttccaaggtaaatttttgttgactgactatgtacccttgttgttctctgagtatttccatgcctaagaaatagtatgtatgtcccaagttcttgactttgaattcagaattcaaaaattgagtcataagttgtatttatgtggcatcatttcctgtgatgagaatattgtcaacatatactactatgatggatatcctcttatttgtgtgtttgtagaataaggaatagtcattcagggaaatagaatagctgtagacatgtgatttttgaccctccccaagattttacacatttttgtatttaaatatttagtttaggtctaatatagttattttaactagttttgacccttttactttatttttatcacaaaataaaaattacaaaaaatatttcttgtttttagttgcttttagtttatatacctttcgtaaaaattaagaaaaatacaaaaatagtaccttattattattttaatatgatatttgaaaacaccaaaaaataagtttgttttaattgttagtcttattttaatagttatttttacttaagtaggatcaattagtaaatgagatcgtgtttttagtctcgtttgcggaaagaataaaatttgggataacgacccattttaggcctaattttcggacctagcccataattttcaagcccataccccctaacctaatataaccctaaaagacctaaagtgatgagattttatatatagagcctaggaccctaagagccaaaaaagacaacagaaaaatgaaaaaaggacctaaggaaaatctgaaatgaggaacaaaaacctagatcccaaaaatcacatcagatccgccgctgacacccacgagcccccccacgtttcttcttcaaacccttccaccccagccgctagatccatcaacatacaccatcagcaacaccaagccaaagaccagcaccgttcaaccccaaacgactttgcctttcatcttcttaagtgctaaagcatgaatagcccacacccctccatcttgaacccaaaaatggtggatccctaatagctagcagcggccaggcttcttcatacaaaaaaagctacagcgcctcatcttcctcttcttaaaaagcattgttacagtcgcagaatttcggtgttcgacagaggtagtggcattttcagccaccaaaatagatttagattctcctccaacccccgttgcaactagccatagaaccagctccaaatatacgaaaatagtagctcaaaccagtcatcttcaagtaccaaaacagctccacccgttttgtttttttaaaactttggtcgtatagttactgttatttatcaacaaacgaaacactatccatttatgttttttcagaagatttcgtaagtgttatggggtatttgagattgaaatgaactctaatttcaaaacgtgagaactgaaaaggctgaaagactattattttggttgcttgattctggcgtgaacaatgattaaagcatgggtttgaatccgtgtttagttgagtttttgttgctaattcgggttttgtccatggttcgtcacatttttgagcgttaaacattgaaacaaacaattccccggctatattgaggtccaattcttttatactctattcgttttaatcaagcttaatgttaataatttggttggtgatgcgattccgttgtttccgtaattattttttgtggttctgaattttcttgctcggttatctgctcgtgtttactcgaattggttatatctaaacatgattttgtcatagtatagaattgagtcgctatccatcaactgaactacgccaactagattaaaagggctcgagtgtgcatttcatgtgaccctgccataattttgataataataatggaataaatatgttataaatccgggtgtacatttcatgtgacctgattctcctttccaataaggttaaatagaacgtgtcgtgaaccacaattgcatttcatatagcagggattacgatgcgttttaaataaccttgaaatttcctaaaatattaaaagggctaaaaagttaaaaatgcacagtaggttttaaaacgtgtaaaagatcagataaataggccaataataatagttgagcgaccgtgctagaaccacggaattgggaaatgcctaacaccttctcccaggagaacagaattctatacccggatttttgtgtttgcggactataaaacagagtcaatttcctcgattcagaattctaaaccggtgacttgggacaccattaattatcccaagtggcgactctgatcttaaataaataataccgtttcgattgttatttaaatttaaaaaatctcccttatatcccttttgggggtggtaaaaaggaggtgtgacagctctagcgactctgctagggacctgctaaacgagcataccattgccttgaggcatgttttagtccatagagtgatttcttcaataaacacacctgattaggatgagagggagtgagacaagctggaaatttcatatacacctcttcctatagatctccatgtagaaatgcattgttaatatccagttgtgagtcttcccaccctttattcacagctacagtcaataagcatctgatagtggtcatctcgaccactggactaaaagtctcagaataatcaatgccttccctttgtatgtccccccgacaaccaacctggctttcaaccttttaattgacccatctgattcgtgcttaaccttgtaaacccatttacaaggcaattctttcttgcctgggggtaaagaaacaacattccaggtgttgttgagttgaagagcttgaattttagcttccattatttttctccatccaagatcttgggaagcttgtgtatagctggtaggctcaaaaactgtggagatagatttgaaaatagtctgattgttgagagaaaggtctccaaaagaaaaaatattagtgtgatgacccgactagtcgtctcatgtattatcgggctggttggctcgggttcaaaaaaattttggcgaggtttgaggcacttagtctcttttgagtgagtttaagttggaaaagtcaactgaatgttgacgtatgtgaaatagggctcgtatatgaattctgatagttcggatagcttcgagggggtgatttgagacttaggagtgtgatcggaatatgttttggaggtccggaatagatttaggcttgaatttgcgaaattgaaactttggcgttttccggttgataggtgaaattttgatgtaggggtcagaatggaattctgagagttgtagtaggtccgttgtgtcatttgggatgtatgtgcaaaagtttaggtcattcggacgtggtttgatagatttttggatcaaaagcaaaactcgaaatattttagaatcttaggcttgatttcaatgtgatttggctgattcgatgttgtttgaggtgttttgaagattgttacaagtttgagtggtggtatatggcttgttggtgcttttggttgaggtcccgggggcctcagggtgatttcggagggttgacgaagagtttgattttttggtgaagttgcagaatttttctgcttctgttgtttccgcacctgtggattggggaccgcaggtgcgatgccgtagatgcgttcaaggatgcgaggggtgggagctgcatatgcggtatgttgagcgcaccggcgatggcgcatgtgttgttatttgatcgcagatgcgactttggacatttaagtggaaaactataggtgcgatgtcttggaccacaaaagcagtaccgcagatgcggtggatggaccgcaggtgcagaacccctaggtcagaaagtatataatgtttccttcgtgaagttttgctaagttctccatttttgaagacgggaaatgggctaaggcagtggatttcaagggaaaattgaggaatatcagtttggtaagttccctaagcttcattacttgagtttatgatcatttttccattgtttaatcatggtgttagtggaaattaaggaagaaaattgaggtattagggcttggtattgaagacctttgagtgaggatttgaggggtcatttgtgactggattttgggacttttgatatgtatgaactcatggagtgataaggattctgttgatgcaaattttatcatattttgagacgtgggcccgggggtcgggttttggtcaatttcagaatttttggtataatttgattattctcgcttgggcttcaatcccttagcatattctaatgttatgattctgattttgggtagattcagtgcgagttgaggccgaggcgagaggcaaaggcattgtggagtagtaattcatccggttagaggtaagtaaccattgtaaatctggaactgagggtacaaaccccggtatttcgaaatgttttgataaatgaggtgacacacatgctaggtgacgagcgtgtgggcatgcactggtagagattgtgacttggtctgccccgtagcgactattaagctgcgtacttgatttgaaatcttataaaatctcatattttagacatttatattgtattatgggttgtatgccatgtttgggccttgtgccgacctgttgaaacccttaggggcatttttactgttttcctcactctatttatttgaaagcatatcctcagtcatgttttacctgtttattatttaaaactggttttatcattctacttcttaaaatgtgagaactcttcgaactgagtttccctgatttctactgttatgcccgagtggttgtgaggttaatgactgacagaggttgaggacctaatggtgaggattataaatattacggatcgggctacacaccgcaacaatattatatgtatatattatggatcgggctgcatgctgcaacaatatatatatgttggatcgggctgcgcgccgcagcgatatgacgcttgggctgtaggagttcctccagagtctgtacacccccagtaagcatagtcgtctataaactatggatcgggctgcacgtcgcagcaattattatgattattactattatgaggtgtatttgagcctgagtgctgagtgtgagtactgagtgatgagagctgagtcatgggtgaccaagaggtttgcccgagaggctatatttttgagtgatactttgcccgaggggcccatttatgatacttttgctgatttcactcttcttttaaaataagccctgctgaaattttttaaatgatttcaaagtatttcaattgaaactgaagttttatgaagaaactggtctaaaaccgttgagtttgatttgttattctgttgtttactcttctatatgattttataactgctcgtcactgctttcagaccttatttactttagttacttattgagttggcgtactgacgttactccctgcaccttgtgtgcagatctaggtgcccgagcggcagagtgagggtcctcagcattgtcagagtttgccagagactgcaaggtagatgcatggaatccgcagccctgctttcttccttcctatccttgtttttctgtattttagacttgttatgtattagatagtcggatttatatatttagaggctctagacttgtgactccagatgtttaggctatgttggtttaatgttttactaaattccacacattttagctgttttatacatttcttatgagaatttgagatttaaatcaatgttaggaaatggtttttataaaagaaattattgtggttgatggtttgggttggattgcctagtattgtgataggcaccatcacgaccgagcatttagggtcgtgacaattagggtgagaaatatgataaaaacaggaggaggtaagattagagaaaacaatgctattgcagacatatttattgagataggtaggtttctgggaaatcctctcagattttctaagaggaggtggtggtattgggattgtaggctgtgaaatagagtaatcagtatgagatggattatgaaaaggagaatctggggagctggtaatagatacaggatttccaggattattgagagaaataagggtgctattctcagaagtatttggatatagagggacatgtgagtgtgactaatgattgatggttgagttgggagataggaaatcttgagaagtagtttcagtagtggtagatgggtgagggaagaaaagataagggggaaaggagagaatgaggttggagcagcagaaacaaaagaaaaattgcttcatggaacttaacatctcttgaggtaaagaccttcttagaatgtaactctagcaatttatatcctttctgatgttgtgcatatcccagaaaaataaaagcgtgtgccatgggatcaaatttgcttctgttttgtgttagagtagaggcacaagataagcatccaaaggacttgagttgttcattctgtggactccttttaaacaaaatctcaaaaggtgtttttccttttagaactctagaaggaaacctattgattagatatgtaacagtcaaaatacactctccctagtattggataggaacatgtgactgaaaataaaatcctcttgcaacttccaaaaggtgcctatgctttcttttaactaccatattctgctggggacttgctacacatgaagtctcatgtaagatgccttgagactaaagaaaatcagactgaaaagatcccttccccattttattgcattatcagatctaattcttttaactttccttgcaaattgtctctctaccataactaagaaagattgtaagatagtgaaatcattacttttggaacttaaaaggaaagtccaagttcccctactaaaattatcaaccacattcaagagatatttatatccattgtaagtagtacttttgaatggtcctcatacatcaatacgaataagataaaaaattccatgagttctgatttgactcaagggaaaaggtaatctagtttgtctagcttttggacaaatatcacacacaaaattgaaattggaaggaaaataaatgaattgaagatttttcattactaaaaatggcagatgccccaatctaaaaatgccattggagtacattggagacctctatattggaattagaaacagaacaagaaacttcactaggaactagaatggaatcacttccttgtggaattgaaaatatattggtatttaaactaaaaccagaatctattttaggtgtactaggttccagcaggtacaattctcctcttaattcatcaaaaacttgtccctcttcattaaagggacctgcatgatgcatccactagaaattagattgagtgagcaataaaactggacacacaacttatggactgggagtaaattatatttgaaagaaggaacataaagaaccctttcaagaatcatattagactgaataggaacactacctatgtgtttgacatataattgaaataagttaggtaggctaatatatacaggaataggaagtggatctaaagttaagaaacaatttgaatcaaaacacatgtgttcagaagcccctaaatcaatgatccaggtttttgtgttaatagctgccaaccaagttttagtatatttaagtattgtatcagccactgcatttgcattgattgtagttcctaatgttgctatatttccaagttgtgcctgcttgattaggttcatcagctcagacatatgttccttactgaaaaactgagtttaaggtgttccatcattgctttgagtgcttccattgtcattgtcttgtcctttaactatagcattagccttgacctgtgttgatatggtgaattggaaatcatctggaaacccatttagcctataacaatctaccctgacatgcccaattctcatgcaatatgtatagttcatattaggattaaattttgctttccttcccttaggtttctgctgtgtgttattaaccttttgtgaattagtccatgacttttgttgtgactgattgttgtttttctgtggagccttaccttgaactcctaccatgaatgaggaagcatcagcattgaactgtgatcttgcatatatctccctttgatttttatcttgtagaagaagtgaataagaaaaatctattctagacaatggattcatcataaggatgtttcctcttgcctgggaatagacatcatttagtcccattaaaaactgaatgatcctttggtcttctaaaaactttgtgacttttctttttccatcacaaactcagttactagagtagactagatgagagttgagggagtcaagttcatcccataatttcttaagtatggtaaagtatccaataatactgttgttaccttgaactaacactgatattttcttttgcagttggtacagcttggctctattagtttgcccaaatctgtgttcaaggatattccacaaatcttttgtagattatgaatagatgatactgccacctatctctttggataaagagttcagaagccaagatgtcaccatgaagttgcatctgctccattgaaggtgatctcgtacatcaggttttggtttcccacacaccatttatgaagcctatcttgtttttggattaaagtgctacaaaaattaatctcctccgtccctcaaagcctctatcatcaaatagtgtggtaacaagactcaaaccaggagaattagacgagtaaaggaaataaggatgattcacatcctgtgaatggttgaaccagagataatgggagtaaaaagagtcggaggaacttcttctcctgccatagttgaatactatattctgagaaaaaaggaaatttggatcgatctactactgctctgataccatgaaagaaaataggaaagaattgtgaaatttctctgccttgtattgataatgtaaatccctaattatatagatttatcctacagtaaaataaaaaataaagaatattcctatacacttgtactactcttatttgtctactatgtaacagaaaactaaaaaatattctttcccatgtgctcaagcgagaaacacatgagtttggcttcttggaagcttccttaagtacaactatttaaatattgatcagatggttgagaataaaagatcatgaccctccataattcttccacgggtaaggctgagctacaattgataaaacacttgggcacttcaacacaatatagagaagtccgaaaagctaagtgtctgtctgaaatatttcttcttcgtccttctcttttctgtgtgaagatggctgtgaaaatggcttctcttcatcaccccttctcgtaagaaagaaatccctactattgtgctttcctagctccttcaattatttatcaataaataatggaaaattaaatatttttctttgtgagcataactccacttaacttatttacagattttttttagaaaataaaatacttgaataagttactaatttaatcaaggattggagttatatttttttgtcagattattctgtagaaggacaattatacataataatctcaaatgaatcaattttcatgaaaaatggtgagttgaaaaacgtctcgaaacttgctactgtttcaaagttcaaagtgcttattagtataaatttttgccgtagagtatttaattatgcattgttattagtgagtcactatttcttgtacaaaatacatacacttttctttttatttaaaatcatgtatacttcgactgagtttattttgtttttcaccaagttatcataaataattacacaatttctttttggatcgaaattgtgatgatccgaaaggtcatcacttattttagaaataaatcctgtattccaaggccttaaaatcttcttttctacttcacctaaatttgcgtgcgtggtctggacgtatatccagaaagcttttatgggaaaatatgagaaatagaaatttctagagttaaaatttaattatggttgactttggtcaatattttgagcaaacggacccggatctgtgttccgacgatcccggaaggtctgcagtaaaatatgatacttgggcatatgcccggaaatgaaccccgaggtcccaagccttagaaattaatttttgaaagaaattattttgctgagttatttatgaaataaaaaaagaattaatgtttaaaatcaatagtatcgggcctgttttttggttctggagtccggtacaaactcgttaaagtatttaaatggtaactgtgaaatttgatgaaaaatggagtttatttgacgtgatttggacctccgattgaagagttatgaactttaagtgtttttgatgaaaatgatgagttttgaggtttaattcatagttttacatgttattttcatgatttgattacacgagtaagcccgtatgatatttttaggttggtgtgcatgtttggtttggagccccgagggctcgggtgagtttcggataggccacagagtgacatttggacttgggaagttggaggttttagctggtatgttgcaggtctgcaggctttgcattcgcgaaacttggctcgcaaatgcgagattgcaaatgcgaataacccatcgcaaacgaattgtggaagtaaaattagaaattgaaccttatagagcattggctcaagttttatagtgagttgtgaagtaaacgtgaaaaaaagaagaggattattatttgtctcccttgccgggatgttgttgcttttaatgctatctcccttgccggaatgttgttgcttttaattctatctcccttgccgtgatgttgatattcttgatattgttcccttcctggatattattgttgtactattgttcccttgccgggattttattatgatttcatttatttccttgtccttatttcttgtgatttttgattgggtgaggaagagtgttaaaacacgaagggtgatgttgtgcattgttttggtgagagagtgttaaagcacgaagggtgatgccgtgtttgattattgtgaggaagagtgtaaaatcacgaagggtgatgtcgtgctgtacgatgtacaattttgtgccaattatattgattttatggtgagtacgagagtaaaagcatgaaggatgatgccgtgcagattatattgactcttatggttaggacgagagtaaaagcacaaagggtgatgccgtgcacttgtttgatttctgattcttgttgataattgagttatggtgttccttgtaattacttgctatccttctagtatcatttcatatttccccgcaacatgttcccccctcccattcttaactgtacactcctgctgttattttccactgtatatgatttaactgcacaggtttatttggtagtctggtcctagcctcatcactacttcgccgaggttaggataggcacttaccagcacatggggtcggttgtgctgatactacactctgcattatatgcagatcccgacgcagtagcttttggaccttagctttggggttgctgccttcagtccatacggagatccaaggtagtcctgtgggcgtccgcaggccctgacatctccatctatcctttcgtcctgtttcatttacgtatttcagaaacaattttgtatttatttttcagaccttgtttgtagtattcctagaccgtttgtgaagttgtgacaccagttttgggtagtccttgtttaagaaattgtattggaaatatttaaatagttttatttgtttttcttccgcttgtttaaattccgttgtttataaactgttggttcatcattattaaaggattaaaaatgggaaaaaggtaaattgctcaatggttggcttgcctagctttcagcagtaggctctatcgcgactcccgagggtgggaaatccgggtcatgacaagttggtatcagagctctaggttacatatgtctcacaactcacggacaagcttagtagagtctgagggatcggtacggagacgtctgtatgtatcccagcagctacagagttaggaaaaacttcacaatttcctgttgcacgctttggtttctcaatgctaattgaatttctactctgttcttttgtagatggcgagaacacgcgcttcctcatccactgatcagcaaccgagcccctagcagcagctcccacgaggttcgtagggcaagtccgaggccgtgctagacgccgtagtaggggcagagcttagcccaaagtagtagcaccagcggcggagcctcaggttgagtttgatgatgaggttccggcctaggtagttccggtgggcccagatcaggtcccagatgggttcattactacaccagtgctctaggatgctctagtccgtctggtgggccttatggagaggcttgcttcctgtagcaccagccatctctcgagctagaggaggagcccagaatcctgctactcgcactccggagtagatggctccctagtttcagactccaacagctcagccagttggagaagttcagccgggcatggtagctcagactggtgatggagcagctatgtctgccgatgcattgtggaaattggacaggttcaccaagctctttactaccattttcagcagtgcatcttctgaggatcccctggattatttagatagctgtcatgaggttctcaagaacatgggatagtggagaccaatggggtcgactttgctacttttcgcttgtctagatccgccaagacttggtggagagattattgtttggctagaccagacgggtcaccagctttgacttgggagcagttttctcagctatttctggagaagtttctccctatcactcagagagagatccatcagaggcagtttgagcatctctagcagggttttatgactgttactcagtacgagaccaggtttattgatttggcccatcatgctttacttatacttcccactaagagagagagagtgatgaggttcattgagggactcattcaacctattcgactttagatgtctaaggagacggagagtgagatttctttttaggaggcggccaatgtggacaggagagttgagatagttctatcacagggaggtggtcaggggtctgacaagaggcctcgtcatttaggcagatttagtggggcctcatctggaggcagggatttgtacggtagatgccatcatcctaggcctttttagtcaacacttcaggtttctcacagtttttcaggtggccgtgattctcatatgcagtattcggatcaacagtactatagtgcaccgcaagctcctatcagtgcctcgccgctccagagtttcgaggtggtcattcaggtcgtcagggtcagtagtctcagcagccgagggcttgttatacttatggtcatatgggtcacattgctatattttgccctcaagcattgagtagctctcagcatcagggttctcgtgccatggttcaggcattgagtgttccacagctcgctcagccatctagaggtggaggtagaggtgctagaggtggatgtagaggtattagaggtggaggtcaagccgctagaggtggaggccagctagcagcaggctgtcccagatatgtagttcaaggtggtaaggcctagccccgatgttatgctcttctagtgaggcctgaggctaaggcttccgatgcagttatcacaggtacggttctggtttgtagtagagatgctttagttctatttgatccaagatctacgtactcttattttgcaccatatctggtcatgcctagtgattctttaagtgctcctgtatatgtgtctacactggtaggtgattatattatggtagatcgtgttcatcattcgtgtatagttgtgattgggggtcttgagactcatgtagatttgttacgtctgaacgatgtcatattggggatggacatgttatccccttaccacgctatcttgggctatcatgccaagactgtaaccttagccttgacgggcttgcctcatttacagtgaagagggactcctggtcattctacccgtagtgttatctcatatatgaaggatcgacgtatggttgagaaggtgtgtttggcttatttggcatatgttcatgattctagtgccgaggttccttctattgattttgtgcctattgttcgtgagtttcctgaggtatatcctccagacctgccgggtatgccacccgacaaggatattgacttctgtattgatttggctctaggcactcaacccatttctatcccgccgtatcgtatggccctgcctgagttgaatgagttgaaggagcagttgcaagacttgctcgaaaaaggcttcattagacctagtgtctcaccttggggtgcgccgatgttatttgttaaaaagaaggatggatcaatgatgatgtgtatagattaccgacagttgaacaaggtcacaatcaagaataagtatccattgccaaggattgatgatttgtttgatcagcttcagggtgccaaggtattttcgaagattgacttgagatctggctaccatcagttgaggattagggcatctgacgtccctaatacagctttccgcacttggcacaagcattatgagttcttggtgatgccatttgggttgacaaatgccccaacagcttttatggatttgatgaaccgagtgttcagtccttagttggattcatttgtgatagtcttcattgatgatattttgatctattctcccacccgggaggagcatgagcagctgagagtggtcctccagactttgagagatagtcagttgtatgctaagttttcaaagtgtgagttctagttaagttcagttgcattcttgggtcatgttgtattagcaaagggtattcaggtagatcctaagaagatagaggtagtcaagaactggcctagaccagcatcaactacaaagatctagaatttcttgggtttgggaggctattatcatcagttcgtggaggggttttcgtctattgcagccctgatgaccaggttgacccagaagggtgcccaatttaggtggtcggccgagtgtgaggcgagctttcagaagttcaagacagctttgactacgacgctagtgttgtttttgcccacaggttcagggacataaacagtttattgtgatgcatctcgtattggacttggtgcggtgttgatgtaggatgtcaaggttattgcatatgcttcacatcagttgaagattcatgagaagaactatctggttcatgatttggatttagcatccattattcacacgttgaagatttggaggcattatctatatggcatgtcatgtgaggtgttcacgaatcacaagagtttgcaatacttgttcaagcataaggagctaaacttgaggcagagaaggtggtttaagctattgaaggactatgatatcaccatcttataccatctgggaaaggccaatgtggtgcccgatgctttgagtaggaagtcagctagtatgggcagtcttgcgtatattcaggtcggtgagtgaccactttctttggatgttcaggctttggccaatcagttcatgaggttggaccgtgtgttagattgcacagtcgctcattcttcttttttgaagcgtatccgagatcggcagtatgatgatcctcatttgtgtgtccttagagacacggtgcaatacggaggtgccaagcaaagtacattaggagattatggagttttgaggctacagggtcgagtttgtgtgcctaatgtggatgggcttcaggagttgattttagagaaggcccatagttcccggtactctattcacccgggtaccgctaagatgtttcaggatttgcggcagcattattggtggaggagaatgaagaaggacattgttgcatagatggcccgatgtttgaattgtcaatagtttaagtacaagcatcagaggcctggtggtttgttccagaagattgagattcctgagtggaagtgggagcatatcactatggacatcgttgttggactcccacggacttagaggatgttcgatgtagtgtgggttattgttgataggttgaccaagtcagcacatatcattccggtggcagtctcctattcttctaagaggttagctgagatctatacccgagagattgttcattttcatggtgtgcccatgtctatcatttcggatagaggtacatagtttacatcacatttctggagagcagttcagcgggagttgggaacacgggttgagttaagaacaacatttcatcctcaaatagacgggtagtccgagcgcattattcagattttggaggatatgctccgagcttgtgtcattgactttggaggctcgtgcgatcagtttttgcctctagtggagtttgcctacaacaacaactaccagtcgagtatctagatggctctttatgaggctttatatggtaggtggtgtcagtcgccggttggatggtttgagccgagagaggctcggttgttgggtacgcatctattacaggatgccttggacaaggttaggatcattcagtataggcttcgtaatactcagtccaggaaaaagagttatgccgaccataaggttcgtgatttggcgttcatggtgggtgagcgggtgttgcttcggaagtctcctatgaagggcgtgatgatagttagaaagatggacaagcttagccctaggttcattagcccgtttgagattcttgatcgagtgggagaggtggcttacagacttgcgttgctgccgagcttatcaatcgtgaatctagtatttcatgtgtccatgctttgaaagtatcacggtgatccatcacacgtgttagatttcagcactgtccagttggacaaagacttctcctatgagaaggagctagtagctattctagactggcaggtttgttagttgagatcgaagagtttcccttttgttcgtgttcagtggagaggtcagcttgctgaggcatcgacctgggagtccgagtccaatatgcggagctgttatccccatcttttccccgacttaggtacttccttcttatgtccgttcgaggacgaatgtttgttttagaggtggaggatgtgatgacccaaaaggtcatcacttattttagaaacaaatcctatattctgaggccttaaaacctcctttttaccttacctcaatttgcgtgcgtggtccggacgtatatctggaaagcttttatgtgaaaatatgagaaataaaaatttctagagttaaaatttgattttggttgactttggtcaacattttgagcaaacagactcggatctatatgccgacaatcctaggaggtccgcaataaaatatgagacttgggcgtatgctagaaatgaattccggggtcccaagccttagaaatcaatttttgaaagaaattgttttgctgaattatttatgaaataaagaaaagaattaatgtttaaaatcattggcattgggcccgtattttggttccagatcccggtacaaacttgttaaaatatttaaatggtaactataaaatttggtaaaaaatagagtttatttgacgtgatttggacctccggttgaagagttatgaactttaagtgttcttgatgaaaatgatgagttttgaggtttaattcatagttttacatgttattttcatgatttgattgcacgagcaagtccgtataatgtttttatgttggtgtgcatgtttggtttggagtctcgagggcttgggtgagtttcggatatgccacatagtgaaatttggatttgagaagttgcaggtttttagctagcatgttgcaggtctgcaggctccgcatttgtgaagcctggcttgcaaatgcgagatcgcaaatgcgaataacccatcgcaaatgcgagagaaggcctgggcagggctgatcgcaaatgcgatcatttcttcgcaaatgcgaagaggcctagaaatcccgatggtcgcaaatgcgacttccccatcgcaaatgcgatttcgcaattgcgaacaatggtcgcaaatgcgagtgtagcaagtccttaagggttctcaattgcgaacccttgtcgcaattgcgacatctgcgacctgcaaattcattacttagacgcatttcaaccatttttcaaaccctttcaaaacataaactctcttgggcgatttttcaaagacaaatactcttgcaaatcgattgtaagtcatttataacttgttttattattctttaacatcttttctcatgatttcaactcaaaatcaagggttttcatgggggaaattggatatttttggtaaaacctaggtttttcaaattttggggatttggacctcgatttgaggtccgatttcaaaacaaattgtatatttgggttcgtgggggattggttaatcgagttttggttcgaacctcgtattttgaccatgtggtctcggaggcgatttttgactttttgggaaaaactttagaaaacctattttcatgtattggaattgattcatttagcatttatggatatagttaagtaacttgtggctagatacgagcgaattgacatcgaggtaagtgtttggtctaaccttagcttgagggattaggagttgtgtcctatttgctatgttctatttgttgagtacgacgtatagacatagtgacgagtatgtttaccgtgaaaatggtaataccaattaaatttgtaaatgggattctaaaaatacgtgatctattctcgagctagttgttagagcaaacaatgctaatatcatgaagtttaatgataaagtgcgagctaaaatgaggcagtaatcaaaccgaaggggtctgttgcccggatgcaggaccggccggagaggacctcggggtcgaggtttgagtcgggctcgagctatcggggatagccgggaatgggataacaattaaggatacgattaagcaaggctcttttcagccaatactgagctatatactgaagaataagtaagaggacgatatatattaaagtggcctcgggccagtgaggacgaacaagctagaaagaaaagagagagagagatattatcgcacttatggagaaatagagcaacatcagtcccttacaaggtagggtgagtcccctttatataggaggggggacttagctacaagtatgtggagattaattacaaagtatgtaaatgggatggcttgacgtgatgcctcaacataggctctggataggccggccctgtcagatttagctatgtgccttgggagcttccctctctgtactgacttcggtctccttttcctctaagtcaggcttcaacgagccctgatattgggaactcggttgtggcctctcgtcctcggggtcccgaggcatgcttccgaaatgactcaacagtgagaaataaagtcttctaattttgctgtgtatagattgtctccgcatttcctattatgaagtgatgggaaatgattttgacactcgactcctcgagcttctttcggcgatgccatatcgatgatgcgactctggtcgtgagctttgtggtaaccggacatccacgagctcgtgatttctgacctcattcattgtactcctaattctcacttcccaaggtgaaggtaccactgttggtttggttttccatggatgcattgactgcgcccgtcagtcaatcttccaaagcctagatgagcgtgttgtaaccccctataaatgggggtgccttggctttgcttttcctatcacagtgcctccgttggcttgcttgcctatttcttcttatcatcttctttcacccttgaacatcatgctaggggctcatgaccttaagtccttttggaggagtttccttagactgtgtcgtggccttttgcaggggcttcccttcgttgagcataaccatgttgtcccgctactactgtggccgttaacatattcactgtggctattgttgttggcccgagatgatgatggaaggggggtcaattttcccctcgtgtagacagtcattcggattatgcaccgctgctcaaaagggggctcggattaaacaccgtttctcaccttcataccctagctcgatgtggtgctccgctccgagttgggggcttgcatggctagacgttccaagaagtggattctaagtagtcgtgcaagcgggatcaaggtttgtttggtccgatgtcactccagagttcccttggccaaagagggtcctcgagtttcggagagctatgccattttttcatccctccccgccactcaccttgtcccttggggatatcagtgtggaaggttgggatgaaactttcgaggatgcacgtccggaggcacctgttgcggagttcaaaggtggaccagtctttcgggctttcacttggcgtgtgcatccctttgtctcttcttttaggcgcagagatcctccgtaggattttgtaattgtatgtaatgtccccttgagggttgttgtaaatggatcttttatgaaatggaatatactccagtgacgtttgctttagatctttactttgtttctgtatcatctcatgccctttgaggccctttgaatgccttcttttattcgttgactactgatatgtgacttgggcgcggacattccttccgatcctctactgatcgacatggctctctttcgaactcatcgtcgtacttcagaccaatcccagattgatttgataggcccgggctaccgaggcccttcgagctgtatggagataatgcgtcgaattttggagccttcgggaatgttatcctaaatgaaggtcagcttcaggtacccgagggtcccttttaatcttgatgtagatagccctcccttttttaaagcgtataggatagacttatgctgaggagtttcctgctgcctcagacctttgtggagctttcgagattggagcttcctacatttattcctctttttagaaagagggaatcacgagaccaggtacttgccctgcatcgagtgctggtgttacaaaacttcccgaagtccgacttctttgggtcagggatcctcgaggtaggatgttgtctcgagcttggagataatatggatggcccctcgggtcttgacttctcattgaaggattctatctagattgggtatcgatttgtcgatctgtatcgaggctgtcggctccccgggtctcgcatcgggtaggcgagtcgtcgctgcttctcgcatatatgtggggcggcttcggcttcttcgcaagacctcactatttttagatagacgatttcctgctttggcacagggtacttcatctctccaggcataaaaagtgctggtgcacgcccttgctttgaactattagttttaccatagtcatggaaaccacttcagggccgattcggcagggaacaggggggggggggttgctcccagcgctcaagaaccgaaggagtttgctttgaagacggcatccttgataagaggggaacacctggagatggtgaggaattactgcgggtggagcgagggggtaacactgcaggtgctttctccaaataagggtattacagactccactgatggagttttgagcgtatacctataccctttcgcatttggcccccctgctagggttgtgcttgatttttgcttgaagtatcgagttactctggcgcagatttatccatcgtttcggcgaatggtaatgataatgaggttcttcgtggagaaggttgggctcgaattcacgtttaatcacctcgttagactataccggccatttcattatcgaggcctgctaactctgaggtgccgtttgtccacgccctttgttgtcgatgatgaagaagacaaggaccgagagtgggccagttggtttattcaggctcaaactgctgacattatcccaacagggcttttgccatttcctgaagggtggaatcatgcacgtgagtggagtgtctggcgcttttttaaattttgcctatagcgaaaatcagttgagtaataatgttgtctaccttgttgcagcaacttcgtggatgccgggcaaagtccttgaccttcccgtctgggtccataagttggcgacccattcgacttgcgacgagcgcaggtggcgagctgtatttcgtaccaaatggggagtgaaataccaaggtatgtgcgtatgttgcctttgacttggccttcgtatattcgaggtaatattttcccctttcatttgtactggattcaccgtttgtagatacagggcggttgtttgggatgagacagtgttcttccgaagaggagaaagagtcgtcagcctccaagccgagggaggatggtgataagggggatcggcacccgcggtgtgatggagcttttagtggcattgggcgggctcagatctttgagtagagggcatcgtctgagcctgatgttcccggagtatcagattcccgggcggcgattcctccgagtgaatatgctctgcccgaggttggttctcctggggccggagaggcaggatcaacaggaatgtgttctggcttagaggaagtccatcggcttctcttcgaggtgagtttaggcgcgttttttcctgtatgtcacgccctcctccctttattgagttttccttgcataggcctgtgatgggcttatgtctaagctgctctgtcaaggggccaggctccagaaattcttgaacgatggcgagtcctttaggctccttagccaagagaatggggctaagttggcacgttggcgatatgaggcgtatcagagctcaaactatgagagttgtttgatagagcaggtaactttatatagtatgcgctttgctcctctctaaccttaaggctcaccccttttgttatatcagctgcaaaaaaaggcagaggccttggagtacctcaaaggcgacgtcaaccgcgtcagagttgtttgtggggagctaagggctcaagagcaagcttgagctttagaggagatatgtgcctcagccagggtccctgccatcgaggcccaactctgcttgactcgtgataacgccaaagttcaagcggacatgattgggaaactcgaatctgatctcttgaaggtcagagctgagataattaatgcccaggctaaagtggcgctaagccggaccaaggctgatcaggagatggcgattcatatgaaggatgttgctgatgcccaagctgagctaaagcgagccctcgaccgggagaagaggatcgaggagtatgttcgttgcagatctcggagagaggtactcgaggaggccagtgtacggggcttcgttctctcgaaagaattggctcgagcaagggtggatgagcgcgacgctctgtaacttcttgctgacgtcgcggagggagaatttgacaagttgtagccctttagtgcggagtgtagatttcgccattttgtcgctttgtttctgatatatgtagagcatgcttgtagatggagaatgcgcccttttcgcgcatataatatgtaggaagaaacttgaagctttattttttctgtacctcttttttgttattgcttttcgactgggcaggccggttttggtgtttggcgggatcctcgtaggtccggaactggtcggatagacctaggggctcttaagtgtaatcccttacgtgagctggtgctggggcctccatgcttggcccgactgttttaggcttagtctctgagtcgggcttcgtctcaagccttttgcccttgaatcttttatgcccgctcgggcaggcattaattatttttatttcttgctcttgggcatttgccgtttcgactattttggattcagtctccgagtcgtactgtgactcgagcttcaattgaccctcaagctctttcctgcctgcataggcggatgatgatggccttttgtgctccgggtcgaaatgaccttactggcacatggcccggagatttgctcggctggcgatagtggcatttatgtcgtgcccttaggcatattgtagtttaattattccgggtcaagcctccgagtcgcgttgtgacttgatcttttattgacccttaagtacctctggttttcagactgacgatagtgcctcttacgctatttcggtcgttgagacctttcaatatgtggctcggaggtttgcatagttaactattttggatccgatctctgaaccgggttacgatttgagctcattttaatcctcaagttgtcaaattttagctagtgacaatggctcttacgctgtttggtcgtagagaccttttaatatatggcccggaggcttgcttagatggcgacaatggctcttacgctgtttttgcctgtgggcttttttgtaggctttgttttctgctcgttaaggtcttttggaatatttttgcttgacccgtcttcggttctagaggaacttcgatttcaagtcgttgtcggcgatgttttgagcacctcaaaaggttcatagctcgtaggttgagtagatcaacactttggcggtttggagtcgacatggtcggggttcgtttttgcctgttaagggaaccctattttaaccggttcttttcgaagtatatttggagtagtgtcctgagattttagtaacagtcgggtgtccccgagtcatgttattttggctgtattaaccgttttgatcatagtcatgtgcgtttggccgtagccatttttaatcccgattgatagtttaggtgtctacaccgagggtatgccctttagggatttttacacatgcgacgtataacctaaacttcaggattttcatgtttgttgaggtcttacagttaatcattcctcttgaggtcttatagtttgtcatgcctgttgaggtcttacagtttatcatgcctgttaaggtcttatagtttgtgtaatatataatagatctggttacgttgaggctgcctgctaggggtctcacagtttcgatttttccagcatatgacgatcaatggcagtctctgagtcatataatttgtttaagcttgaagaccgctcctcatgagctcggagttgccttgtaggggcttgttgagcccggagttctaaccctggggtcgtgcgggtattgaattgctgatgctaagtctccgagtatctcgggatgcattcggtagagaggcccttgccatgagtatgttgaaatccccttttccgaagtacgaaatgccgaaaagatattctttattacttgtcataaatatatgttgtaaatacatgttctctcgtcgttgtgagctcggcccacgtaggtacgactcttcggaccatctgattcgttacaaggttccctcttgacactcagtctgatattttcggtccttctgagggaatggtgcccttgaaagaagatcatcgcccgtcgttcgattgtagaagaaggcatgtgattttgtcgtatcctgctggcaggaccctctttgggggtacactgctctgctaataatctttttggcgggaccctctttgggtctaaagtctgatcgagggaatagagcacaacgggccctgctaaggccttggatctccgtgtggagttagaactttcgaatgccccggctgattgcctgcatataagttagtgaaaaaataatgaaggagtgaagtagttcctcctcaccgcggggtgcgtaggtaacctttcgaggttcgggatgtttctgctgttccgaggcacgagccctaatacagccttctgctgtgttcaaccaagcttagcagaagatgcgattctgcttaccctttgatccttttgagggcggacgtattgatgccggcgatgcgttacatggtgagggttttcctctcgtcgtgtgcagctccttgtcgaatactttagtcccacccttgtcctggggtttcatccatttggtggagtagggtcgaagttgcctccggggaggcgtgcccgttgtcatctgaataagacgtacgtgccttgcgtgttcggcattccagtccgagctgatacgggttgtattaagggagtggtcttcctgatgtggcgatcggtgcctagaatctgtcaaagattcgagatgtgggagtgacttggttcgttagtccgaatcgccccattggctttggtttgacatcgttggtataattaattgaacaacctgtattcatgaacacatgttttatttggaataggtcaaatgagtgagagggttaccaacacatcaatacgaggccgaggcgaagtctcggcgtccctttccttggaagcaagggtgtcctttggaatattccccagaccagtgtttccccggtgatgagcattttcactttacattttatggcctttgaagggtgtcgccgccccttcactgtcgtggtaatacatcgtggcttgtcatcttcattcttcccggtctccttcctcccttggagttggattcgagcctgaccgctcgacgatactcggtggtgatttttattgaatagcacggttgtcgttcttttgagcgggtggccattttttactccgtagctgtgcgcgccctacggtttctgcgtcgggctatggttcttttgaaggggtcttggtagaataggtttgagtcgcctatcgttcttgttttagcttaaggtgatcatgatgttcggtaaagcaatgttgaaattgtacttagctgagcggggttcccctgctagctgtgccttgtcaaatctggttccattggagatttctcggggatgtttccctcgagctatttctctatcattgggaggtaagtaacaactcatgtcgttccttccattcgcggtgcatggagggtacctccatttgtttggcatcatcttctttgtcggcataccaaacctgaggaggttcctggacggaagtccacggccctgctccgtggatagtgtcaggtgcgtgtatccgaccatatctcgactgggtatctggtcaggatttgtttgaaatgtcctggagtcgtcgggcatatttcgtttaaccttcgggcggaggcccgggttgtccagtcatccgaaaccgggagcgatctcattcatcctaacagggaacgagacgcgacttcttgtagtgcttcactctctctttgtctagccccaggtgtgtcgagcccttttgttactgcttcgataacatcggtgtgtgctcccgtggagtggtctgctgatatggtaagcgagtttgcgaggccaggtgccaggctgcggtgctgcatcaaggtttttttcgagagtgtttcctcgaacttcctcaatgagtcagactcacactcatcattatggaggtctctgcctttgaataagcacgtgtaagcggtggtgcgctcgtagggacccaaggtcctatcgcacctagggagttttggcgttccagatttccgtgaagagagttccgggaccgcttccttaggagacggttgctgtaagaacttccacgaacctgactcgatcctttcgaagagattcccaagcatcctggggtcggttaccgatccgttgttgcttgatctcccgggtactcgctcggcgtagggagatgttttcggggctactacgctgggagtctctgggtggctttgcagctgagcgatagcaaactactatgcctgcaacattccaaaaataacatgaatactaacttcctattcttcccaggccgggggtttttgagcttcctgttggtcgatatgttgtatgctaccatcggtgcgcgaggcttcatcgacctattgtgcgccttgcaagcccgcgtccgcttgaattgatccagatgtgttatcggggtactgcggtgtcacgccagccactggaacagccataccattttcgtcgtgatttttggggtagtcattctcgactttgcttaccgagccggacattttaacctgaaatcaaaggatcttggacaagaaaaagtgtgaaagatagtgtgtatttgtgcaataaaaccagcaataaaataatcactattatttttagccctacggtgggcgccaaactgtttaccgtgaaaatggtaacaacaattaaatttgtaaatgagattctaaaaatacatgatctcgagctagttgttagagcagatgatgctaagattgtgaggtttaacgatgaagtgtgagctaaaatgaggcagtaaagaaaccgaaggggcctgttgcccggatgcaggaccggtcagagaggacctcggggtcgaggtttgagtcgggctcgagctatcgggggcagccaggaatgggataacaattaaggatacgatgaagcaaggctcttttcagccaataatgagctatatattgaagaacaagtaaaaggacgatatatattaaagcggcctcgggccagtgaggatgaacaagctagaaagaaaagagagagatatattattgcacttgtggagaaatggagcaacatcaggcccttacaaggtaggatgagtcccctttatataagaggggggactcgactacaagtatgtagagattaattacaaagtatggggatatgatggcttgacgtgatgcctcaacataggctctggataggccggccctgtcagaattagtcgtgtgccttgggagcttccccatctgtcctggcttcgatctccatttcttatgagtcaggcttcaatgagccccgaggttgggaactcgattgtggcctcccatcctcggggtcccaaggcatgcttccgaaatgactcgacagccagaaatcaagtcttctgattttgccgcgtacagagtatctacaccttggtgtcaagcttgcccgtgagtcttatattatgattattatgactttgtttgtattgttcatgcctttaatgatgatttcattgttgagcaaagcttgtggaagtagtgttggtaattgaatattgaggagtgttggctcaagttgtaaaagaattgtggaagtaaaattagtaattgaacctaatagagcattggctcaagttgtgtagtgagttgtgaagtaaacgtgaaaaagagaagaggattattatattgtctcccttgtcgagatgttgttgcttttagtgctatctcccttgccgggatattgatgttcttgatattgttccttgccaggatatgattgtgtactattatttccttgctgggattttattatgatttcatttatttcctttccattattttttatgattgttgattgggtgaggaagagtaaagcacgaagggtgatgtcgtacattgttttggtgagagagtgttaaagcacgaagggtgatgccgtgtataatttttgtgaggaagagtgtaaaagcatgaagggtgatgccgtgccgcacgatatacaattcagtgccgattatattaattttatggtgaggatgagagtaaaagcatgtagagtgatgtcgtgtacattatattgactcttatggtgaggacgagagtaaaaacacgaagggtgatatcgtgcacttgtttgatttctgattcttgttgataattgagttatgatgttccttgtaattacctgttgtccttctattatcatttgatgtttccacgcaacatgttcccccctcccattcttaactgtacacccctactgttattttcctctatatatgatataactgcacagatttatttggtagtctggtcctagcctcgtcactacttcgccgaagttaggctaggcacttaccaacacatagggtcagttgtgatgatactacactctgcactgtgtgcagatcccgacgcaataacttttggaccttagcttttgggttgctgccttcagtccatacagagatccaagatagtcctgcaggcgtccgcaggccctggcatctccctctatccttttgtcatgtttcatttacgtgtttcagaaacaatgttgtatttattttttagaccttgattattgtattcctagaccgtctgtgaagttgtgacaccagttctgggtagtccttatttaagaaattgtattggaaataattaaatgattttatttgtttttcttccgcttatttaaatttcgctgtttataaactgttagtttatcattattaaagtattaaaaatgggaaaaaggtaaattgctcaatggttggcttgcctagctttcactagtaggcgccattacaactcccgatggtggaaaatccaggtcgtgagagaaatacaaatagataaaaccgactaaatgttaccctatttggagcatataaattatgatatgtctacgttcaaaatttatggcacccagaatgttcaaatcctagtgttagcctcttcaaggataacccactcatataccaattgatgttttatacttcaataccacacaagagggaggtgatttatgtggtgtctaattttttgcgtgcaccagattataaaaggacctagttcttctatgtgttctttatactactattgcagaataataaatgcagaaagtaaaaaacacaaagatatttatgtgaaaaatacccgtctcaaaaggtgaaaaaatcacgacctactacccagtaggattttctctaaacactttactacaactcagagccaacaacaatgtttacaaactcttgcaaacctaaggattaattctaacccttatagcaaccatccacaggctgttgtgactgattcaggttaactctaacttgaataatacaactcgagtttacaaccttttgcaaacctaaggattaactctaactcttatagcaacatgctacaagctgttgtgactacttcaagttaactctaacttgaatgatacaactcaagtacctagtacaatttgcttctaagaaagctaaaaggtacagctcaaaatgcatactacactttgaactaaaaataaagaaagacacataaaactctttataaagctggtttttcaatctggttcgtgtagcttcaggatctcactcttaaaactcacaggaattgctcacaaaatgccttgctattttgcactcatttcattcttaacttcagtatgtgtgcatcacctgtaaagtgagaacatcatgcgatttatagagttagtagagtagaaaataactagagttctaatgctactcttccttggtggaagagttctagttaacttcaacccctatctcctttcttatgttggatagtgttctctttgagtaaggagtccttctccttatcaattatgtaatctttttgatcaggagatatcaaatataccaagttaaacttatctccttcacatgcatctcatatactcaaatctgcccgtgtctatgttcataaggggtcctggttcatgcctgatcttcctttgtcaatcttcaaaacaaacctttatttgggccaacaaattccccctttttgatgatgacaaaatctgtgcttttcataagcttaagccctgtttcaactcagctcaacatcaacacaatgttagaacattttatcacttattatcaaggaccaggttcattaggttataaacatcacagtccaaagaaaaagcacaacctaattcctcctttggcatcatcgaaaagttgcataattatgtgagataaccaaatttaaatagaaattaatcatggccactaggctacttcaaatgcaatcatagatttaagcatcatctataaatctaaggatattagtcatctaagaaatatcaacaaacagctagagcaaaaggcagtaaatttcattgattgataagatcctactacaaagcataaaaagaataagaacattggatcatgagcaaaagaaacaaaaaaatcctaagctgggtcactggttgatctacagtaggttaggaggattaaggctgggaaggaccaggttcttggtttttggcttggagcagtttcagcatatcctgaagaatgccctaattcttctcattctcttttgcaagctcagctctgagagcatctctctcggtctccatttcagccaacctcttctttagcctatcaggctcagcatcctttgccctactttcttgcaccaaaactcgcactttgctattcactggtacctttttggatgaaccaggttttttgggagtgatttgagcctcatagttacaagcagtcaaagtgttagccccaaaatgatccttgtttgtaccaacttcccatttcttgatgggtacctttaaatgtgcaagaacaatcgtgagaataaaaccatagggtatgacataagtcttagttccatttagaaccctgtcaagaagctgaattttagacccaggccaatttatttgccgcctattgtccaaacattccataaggaccaggtccatgaatgtggaaatgtgcctcctttcctaccttggcagcacacatttgtttacaaattggagcaacactttgttgggtggcttcatctcatttttgtaaatagccttgggctcaatttcctcctcattgtcacaaaattttctagtactggcaagggcagtagggagattctctaggcttgtccatttgagcttcttatagtcattgtatcctttagaatgcaccccaagatctctctcagctctttctcatcaaaagtcaccatcaccctttaccacactggtgaccctaccatcttgatctcacaatttgccataaactgcacaatatcagttatggccaaccttccatcatctgaaagaccatgtccttccatccttgcacctgtaacttctccagaagcattaccattccttcctcctctaagttcctgaggagcctacctttcaagatggttctcttcccaaacttaaccatcttgtccttctcaacatcggattcttcttcttcttcttcttcatcttcttcttcttcttctccactctttctcttcctccaccatttttcctttcttgatttcatagaaaacctgttcttttagacaaagtggatggaacaatagactttgtatttgaagtagacttctttgtagaagtcttgcctatcttagcttttggagtcacagtctccacttgttctatctcatcttcatcttgaaggaccaggtctatctcatcaatttaaacagcctcaacagtctcaaccatcttcttcttgtccttagtagcaacttttcttttactttcttctaaggctttgtccagttcatcctcactctgcttcttctaactcctagtagatcttccttttgtgggaggaatttctacagggatagaagaaacaaccttccttttcttgttggctctagtggtgccaggggttttaactcctagacttcgtttcttctttggattgtagctttcaatcactcttttcagtaggtctgtgagggtctcctgttcagatggaacaggttcatctacattttccctagttgaaccagcccctcagcaacttctccagacccacttccctctatttttctcagactctcctctatttcaacaaattcctcaccctaaactaccatatcacctgactctttagttagaccaacaggagtgcgtaaagattcagtcactccttttcccattccccttacagtacttcgataaccctctctctctttatcttttctcttttatttttacctcccacctttccagacttagtactttcaacacctgacatatatcctacaagaacaaacgtattcttcaaattcatagaaaccacaaaaatagtttcaagattaactttggggctagacgttacctgttcacactcagaaggaactgtttcttcccccttagttgtagatttgaatgactcatcagatttttggggttcttcttccctatttgctttcaaattttcattgattttattaatttgctctccaccaacaacaaccttgcgagccatcatttttacccttcctttattagagatgggagtagttgaaggtgtatcatatggtgtgggtaaggtttccttgggtggtgaagagggattatcagaggtgttatccatttctgtgcttggaagtaagaaaagaaagtttaagtgtgtttcgaagttgagaaaagatgaagagtagattaacgacttaaaaagtttaagtgaagaatacactaagcctaatcaatttaaagaggagtgtttaatggtagcgacagtctctcagaagtctaatcaaactgaattcctgttttgacaagatattggaaaggttccctacaatctaggcatttaatgcagtttggactcctcttttgaacaaactggtccatttttgtaatgtataagtatagtggggtttgatattgaatggtaatcttttcttaaacatgatctaaatataattatttcaaactatgcagagtagagaatacgtaccaaataatcttgatgaactgggttcttcattgaaaaatctcttgtgtaaacctgaatttcccaagaaaatagcgataatatcattagagataaacgagtcatattaacacatggcacaagagtatacttatgaaagtatgagaatgagcaaaatctaatctaattatgtaccaagttcataattttctaaccaaatttttgagttagaactggttctgtgatgactcggtcagtcgtctcatgagttaccactctgttttctcccttttatgcttcttattgctttgtctattagttctatatgtgatcgtgttggttggctcgggcttagaaaggatttggtaaggtttgagacacttagtcttttttgaggaagcttaagttggaaaagtcaactgaatgttgtcttatgtgttagagggctcggatgtgagttccgatggtttggatggcttcgagaggtgatttgggacttaggagagtgataagaatgtgttttggaggtccgaagtatatttaggcttgaattagcaaaattggatttttggcgtttttcgattgatacgtgagattttaatatattggtcaaaatggaattccgagagtctcattagttccgttgtgtcctttgggatgtatgtgcaaaatttcaggtcatgtggacgtggtttggttgggtttttgatcaaaaacgtaattcggaagatttttgaagacttaggcttgaatctgacgtgttttggttgattcgatgttgtttaaggtgttttgaagattggtataagtttgaataaggttatgggatatgtttttgcttttggttgaggtcctgggggcctcggggtgattacggatggttgacggagagtttggaatttgtggtgaagctgcagattttctgcttctattgtttccgcacctgcggattgggaaccgcaggtgcgatgccgcagatgcgataagagggggtcacagaagagcaaaggagctagggaggtagaaaccgcagaagcggttggaaaaccgcacctgcgatggcgcaggtgcggatagtgaatcgtagatgcgaaaatgagaacttaagtgaggaccacagatgcgatggtcttgaccacagaagcgataccacaaaagcgagaatttgaccgaagatgctaaatccctgggctagaacatataaattgtttccttcgcgttttttgagctattccaccatttctaagtcggctttggagctttttggactattttgaagaaagatttcaagggaacttcattgaggtaaggagtttggacctaaactcgttcctaaggtattattttatggattagagctgtaattaatggaatttaagggttaaaattggggaaactagggcttgatattggagacctagacttgaggttttgatggaccatttgtggttgtattttggtacttttgatatgtatgaactcgtgggaagataaggagcctacctttcaagatggttctcttcccaaacttaaccatcttgtccttttcaacatcagattcttcttcttcttcatcatcttcttcttcttctccactctgttcgtcttcctccaccatttttacctttcttgatttcatagaaaacctggttcttttagacaaagtggatggaacaatagactttgtatttgaagtagacttctttgtagaagtcttgcctatcttagcttttggagtcacagtctccgcttgttctatctcatcttcatcttgaaggaccaggtctatctcatcaatttaaacagcctcaacaggctcaaccatcttcttcttgcccttagtagcaacttttcttttactttcttctaaggctttgtccagttcagcctcactctgcttcttctaactcctagaagatcttccttttgtgggaggaatttctacagggatagaagaaacaaccttccttttcttgttggctctagtggtgccaggggttttaactcctagacttcgtttcttctttgaattgtagctttcaatcactcttttcagtaggtctgtgagggtctcctgttcagatggaacaggttcatctacattttccctagttgaaccagcccctcagcaacttctccagacccacttccctctatttttctcagactctcctctatttcaacaaattcctcaacctaaactaccatagcacctgactctttagttagaccaacaggagtgcataaagattcagtcactccttttcccattccccttatagtacttcgataaccctctctctctttatcttttctctttttatttttaccacccacctttccagacttagtactttcaacacctggcatatatcctacaagaacaaacgtattcttcaaattcatagcaaccacaaaaatagtttcaagattaattttggggctagacgttacctgttcagactcagaaggaactgtttcttcccccttagttgtagatttgaatgactcatcagatttttggggttcttcttccctatttgctttcaaattttcattgattttattaatttgctctccaccaacaacaaccttgcgagccatcatttttacccttcctttattagagatgggagtagttgaaggtgtatcatatggtgtgggtaaggtttccttgggtggtgaagaggaattatcagaggtgttatccatttctgtgcttggaagtaagaaaagaaagtttaagtgtgtttcgaagatgagaaaagatgaagagtagattaacgacttaaaaagtttaagtgaagaatacactaagcctaataaatttaaataggagtgtttaattgggtagcgatagtctctcagaagtctaatcaaactgaattcctgtttgacaagacattggaaaggttccctacaatctaggcatttaatacagtttggactcctcttttgaacaaactggtccatttttgtaatgtataagtacagtgggtttgatattgaatggtaatctttctaaacatgatctaaatataattatttcaaactatcagagtagagaatacgtaccaaataatcttgatgaactgggttcttcattgaaaaatctcttgtgtaaacctgaatttcccaagaaaatagcgataatatcattagagataaacgagtcatattagcacatggcacaagagtatacttatgaaagtatgagaatgagcaaaatctaatctaattagttacaaagttcataattttctaaccaaatatttgagttagaactggttctgtgatgactcggccagtcgtctcatgagttaccactctgttttctcccttttatgcttcttattgctttgtctattagttctatatgtgatcgtgttggttggctcgggcttaaaaaggatttggtaaggtttgagacacttagtcttttttgaggaagcttaagttggaaaagtcaaccgaatgttgtcttatgtgttagagagctcggatgtgagttccgatggtttggatcgcttcgagaggtgatttgggacttaggagcgtgataagaatgtgttttggaggtccagagtatatttaggcttgaattagcaaaattggatttttggcgtttttcgattgatacgtgagattttgatattgtggtcaaaatagaattctgagagtctcattagttccgttgtgtcctttgggatgtatgtgcaaaatttcaggtcatttggacgtggtttggttgggttttcgatcaaaaacgtaattcggaagatttttggagacttaggcttgaatctgacgtgttttggttgattcgatgttgtttaaggtgttttgaagattggtataagtttgaataaggttatgggatatgtttttgcttttggttgaggtcctgggggcctcggggtattacggatggtttgacggagagtttggaatttgtggtgaagctgcagattttctgcttctattgtttccgcacctgcggattgggaaccgcaggtgcgatgccgcagatgcgaaaaaagggggccgcagaagcgcaaaggagctagggaggcagaaaccgcagaagcggttggagaaccgcacctgcgatggcgcaggtgcggatagtgaatcgcagatgcgaaaatgaggtcttaagtgaggaccacagatgcgatggtcttgaccacagaagcgataccacaaaagcgagaatttgaccgaagatgcgaaatccctgggctagaacatataaattgtttccttcgcgttttttgagctattccaccatttctaagtcggctttggagctttttgaacgattttgaagaaggatttcaagggaacttcattaaggtacggaatttggacctaaacgcgttcctaaggtattattttacggattagagctgtaattaatggaatttaagggttaaaattggggaaactagggcttgttattggagacctagacttgaggttttgatggaccatttgtggttggattttggtacttttgatatgtatgaactcgtgggaagataagcagcctacctttcaagatggttctcttcccaagcttaaccatcttgtccttctcaacatcggattcttattcttcttcttcatcatcttcttcttcttcttctccactctgttcgtcttcctccaccatttttacctttcttgatttcatagaaaacctggttcttttagacaaagtggatggaacaatagactttgtatttgaagtagacttctttgtagaagtcttgcctatcttagcttttggagtcacagtctccacttgttctatctcatcttcatcttgaaggaccaggtctatctcataaatttaaacaacctcaacaggctcaaccatctccttcttgcccttagtagcaacttttcttttactttcttctaaggctttgtccagttcagcctcactctgcttcttctaactcctagcagatcttccttttgtgggaggaatttctacagggatggaataaacaaccttccttttcttgttggctctagtggtgccaggggttttaactcctagacttcgtttcttctttggattgtagctttcaatcactcttttcagtaggtctgtgagggactcctgttcagatggaacaggttcatctacattttccctagttgaaccagcccctcagcaacttctccagacccacttccctctatttttctcagactctcctctatttcaacaaattcctcaccctaaactaccatagcacctgactctttagttagaccaacatgagtgcgtaaagattcagtcactccttttcccattccccttacagtacttcgataaccctctctctctttatcttttctctttttatttttaccacccacctttccagacttagtactttcaacacctggcctatatcctacaagaacaaacgtattcttcaaattcatagcaaccacaaaaaaagtttcaagattaactttggggctagacgttacctgttcacactcagaaggaactgtttcttcccccttagttgtagatttgaatgactcatcaggtttttggggttcttcttccctatttgctttcaaattttcattgattttattaatttgctctccaccaacaacaaccttgcgagccatcatttttacccttcctttattagagatgggagtagttgaaggtgtatcatatggtgtgggtaagttttccttgggtggtgaagagggattatcagagatgttatccatttctgtgcttggaagtaagaaaagaaagtttaagtgtgtttcgaagatgagaaaagatgaagagtagattaatgaattaaaaagtttaagtgaagaatacactaactaatcaatttaagaggagtgtttaattgggtagcgacagtctctcagaagtctaatcaaactgaattcctgtttgacaagacattggaaaggttccctacaatctaggcatttaatgcagtttggactcctcttttgaacaaactagtccatttttgtaatgtataagtacagatgggtgtttgatatggaatggaatcttttcttaaacatgatataaatataattatttcaaactatgcagagtagagaatacgtaccaaataatcttgatgaactggttcttcattgaaaaatctcttgtgtaaacctgaatttccaagaaaatagcgataatacattagagataagtcatattagcacatggcacaagagtatacttatgaatgtatgagaatgagcaaaatctaatttaattatgtacaaagttcataattttctaaccaaatttttgagttagaactggttctgtgatgactcggccagtcgtctcatgagttaccactctgttttctcccttttatgcttcttattgctttgtctattagttctatatgtgatcgtgttggttggctcgggcttagaaaggatttggtaaggtttgagacacttagtctcttttgaggaagcttaagttggaaaagtcaaccgaatgttttcttatgtgttagagggctcggatgtgagttccgatggtttggatcgcttcgagaggtgatttgggacttagaagcgtgataaaaatgtgttttggaggtccggagtatatttaggcttgaattagcaaaattagatttttggcgtttttcgattgatacgtgagattttgatatatgggtcaaaatagaattctgagagtctcattagttcctttgtgtcctttgggatgtatgtgcaaaatttcaggtcatttggacgtggtttggttgggttttcgatcaaaaacgtaattcggaagatttttggaggcttaggcttgaatctgacgtgttttggttgattcgatgttgtttatggtgttttgaagattgatataagtttgaataaggttatgggatatgtttttgcttttggttgaggtcctgggggcctcggggtgattacggatggttgacggagactttggaatttttggtgaagctgcagattttctgcttctattgtttccgcacctgcggattgggaaccgtaggtgcgatgccgcagatgcaataaaagggggctgcagaagcgcaaaggatctagggaggcagaaactgcagaagcggttggagaaccgcacctgcgatggcgcaggtgcggatagtgaatcgcagatgcgaaaatgaggacttaagtgaggaccacagatgcgatggtcttgaccacagaagcgataccacaaaagcgagaatttgaccgaagatgcgaaatccctgggctagaacatataaattgtttccttcgcgttttttgagctattccaccatttctaagtcggctttggagctttttggacgattttgaagaaggatttcaagggaacttcattgaggtaaggagtttggacctaaactcgttcctaaggtattattttacggattagggctgtaattaatggaatttaagggttaaaattggggaaactagggcttggtattggaaacctagacttgaggttttgatggaccacttgtggttggattttggtacttttgatatgtatgaactcgtgggaagataaggaacctaccgatgtgaatttcctcgaatttcgagacatgggcctgggggtcgggttttggtaatttcggaatttgtgttgtatattgattattttcgcataggcttcgttcccttaacagattttgacatcgtgattctaattttggatatatttgatgcgagtgaaggccgattccagaggcaaaggcatcgcaggctagatttggactagattgaggtgagtaatgattgtaaatgatgtcttgagcgtatgaaatcccggattgcacatcgttgtgccatattgaggtaacgcacatgctagatgacgagcgtggggtcgtgcattgttggggattgtgacttagtccatcccgaatgactattttaccgtgtatttgactgaaaattgtttgctatcattatgtttgggctgaatgccatatttgggcctcgtgccaactatttgaacccttaggggatttttactgatatttcctcactgttttgactttatacttgaactcagtcatgctatattctactattttcataactcagtcgtgtttactctactttaacacttaaatgagattttaaatgatcttttgagctgagcatcatgttttactatttcccgtgtggcctaagagaattttgactgagtaaggccgagggcctataatgtgaggaaacacctgattatgattatgaggccgagggcctgagatttgtacgccacaaggtggcttgttgatatgaggccgagggcctagtggtgatgccacgagatggcttgatattactcttaggccgtaaggggcccctctaggagtctgcacatcccagtgagtgcgggtacccattgtgatataagatatagcccaaggggctagtattgtttttgagatattgcccgaggggcggatttgttgacactgtgcccgaggggcgatcctttatgtgtttatcattcctaattgcctgtcatttgcttgcttaattgttaaaaaggcactttatgaagttgtaaactgaactagtaattttacacatctttactacttcactgttttactggcttttactgcttccttatagcctataatgtgccttatatgatttcttgctttcagtctttatttatgattgttactcactgagttggagtactcactttactccctgcaccccatgtgcagattcaggcgcatcaggtcctgctagcgagtattaatcttttccagctcaggcagattcgaagattctctaggtagctgccggcgttcgcagcctagagcttcttccgttatctaatcttcctctattttaaatttgtattagactatgtagacctttcttgtatcatacggattgtagatgctcatgactagtgacaccccggtatcgggttgtgttggttttacttctgcattgtactattcactacttactttgggtttatttattaagtattagaattaattcttattgtttaatttcttaaaaatgaaatgggaaagtgtcggatgcccttgtctttatgagaggtgccatcacgaccgggtccgggtttagggtcgtgacaagttggtatcatagcctaggatacataggtctctcgagtcatgagcaagtttagtatagtctcgtggatcggtatggagacatttgtatttatcctcgagaggctgtagaatctttagggaaaccttcatattcttgaaattcttgtcttgcgaatttgttgatccgagtactaaacttatgttattctattctctcatagatggtgaggacacgcgctaccagtcaagatggacgaccaccagcaccaccagcgtggccactagagtccgaggatgcggtcgtggttaccgtagggacataggtgtggcccacatagtagctagagcagcacctgcaaaatccttctatcgccctagttcaggatcaggtcccagttgtggacgctccagcagcactagctcaggcaccagttgtgcccattgtgattcagggtcttcaggaggccttggctcagattttatcagtatgcactggcctagctcaggcagtttcagtcagtacagccacaactacttcttaggctagaggaggcactcaaactcccgccgcttgcacacttgagcaggtcgtgcagggacttcagacaccggggatgcatctagccgagccggttatagctgctcaggactatgtggttcctgctatgctagaggacgaacaacataggttggagaggtttggttggcttcagcctccgaccttcagtggtgcagatggcgagaatgcccagggtttcttggataagtgttagaggatgctttgtacaacgggtattctggagaccagcgtggtcgctttcactacttatcagttttctagaacatccttcacttggtgggagacttttgagaggcgtaagcctattggtgcagcaccccttacctagcagcatttctccgttctctttttggagaagtatgtgctgcagtctcatagagaggagctgcgtaggtagtttaagtggttgcatcagggagagatgactatgatgtagtatgagatgaggttcttcgagttagctcgttatgctatttggttggtttggattgatagagagaggagtaggaggtttgttgatggccttacttatcagcttcgtactctcatgaccagggagagtgtgactggtgcgacttttgaggaggttgtagacatcgctagtgagattgagtttgttcattgctaggagcgagaggagagggatgccaagaggcctcgaggatctggtagttagagtagtgctccttcgagaggtcagtttcagcacggcagagggcatccatttaggcatgctcagccagctcgcccaggttatcatggggcatcatcgagtcatggttctcacagttctcatcagggccagtcatcacttagtgcctttctagcttagagtttatctcgtgctcaatcagttcagggatcttctatgctaggtgcatctactagtcattccggtgctaggggtcccttcagtccccttctccagcactcgagagttgctatgagtgtggaaagatgggtcatatgtggaggcagtgtcctcgtcgtcttgcgggttcatctcagcagaggagtcagtcatcggcttcagcacgagttacttcaccatcacctgcccagccagctaggggtggaggttaggtatctagaggccgtcccaaagggggaggtcgatcagatggcggtcaggcccgtttctatgcacttccatctagacccgatgctattgcttttgatgctgttattataggtattgtttcagtttgccctagagatgcctctatattattgcctggttccaccttttcttatgtgtcatcatactttgctcgttatttgggtatgccccgtgagtctcttgtttcacctgttcatgtatctatcctgatgggcgatactattattgtagacaatgtgtaccggttgtctgtagtgactattggggatctggagaccctagtagatcttttattattgtgtatggtggatttcgatgtcgttttgggcatggattggttatctacaagtcatgctattctggactatcatgttaagacagtcacattggctataccgggtgtgccacagattgagtggcaaggtttgactgattatgttcccagtagagtaatctcatttttgaaggctcaacgtatggttgggaagtgttgtctttcgtatctagcctttgtgagggatgtcggtggagagactcccagtattgatttcgttctaattgtgagggattttcatgatgtgtttcctgcagacctaccgggcatgccaccggacagggatattgactttggtattaacctggtgccgggcactcagcccatttctattatgtcgtatcgtatggcaccagcagatttgaaggagttaaagaagcaacttcaggaactccttgataagaggttcatttggcctagtgtgtcaccttggggtgcgctagttctatttgtaacgaagaaggatggcattataaggatgtgcattgattataggcaattgaacaaagtaacaattaagaataagtatcctttgcctcatattgatgatttcttcaaccagcttcagggagtgagagtgttcttcaagattgatctctgttcaggttatcaccttgggctaaccaatgccccagtagcattcatgtacttgatgaacaacgtgttccttacttatctagactcgattgtcaaattcttcattgacaatattctggtgtatttgcgtagttaggagtagcacatggagcatttgagagttgtgttgcagagattgagggaggagaaactttatgcaaaattcttcaagtgtgagttttggctcagttcagtggctttcttgggacacgtggtgtccagtgagggtattcaggttgacccgaagaagataaaggcggttcagagttggcccagaccgtcctcagccatagagatttgcatatttcttggtttggcgggttattatcgctggtttgttcagggattctcatctatcgcaccgcccttgaccaagtttactccgaagggtgcttcatttgtatggttaaatgagtgtgaggagagctttcagaagctcaagacagccttgatcacgactccaatgctagttttgccatcagcttcaggtttatataccgtgtattgtgatgcttcaagagttggtattgggtgtatattgatgtaggagggtagagttattgcttatgcttctcgtcagttgaagtcccatgagaagaactaccccgttcatgatttggagttggttgccatagttcacgcgttgaagatttggagacattacttgtatggtgtgtcttgtgaggtgtttactgatcatcgtagtctccagcacttgttcaagcaaaaggatctaaatttgtggtagtggaggtggttggagttgctaaaggattatgatattactatattgtaccattcggggaaggccaatgtggtggccgatgctttgagctgaaaggcagtgagtatggggagtttggaatatattccagttggggagagacctcttgcagttgatgttcaggccttgtccaatcagtttgtgaggttagatattttggagcccaatcaggtattggcttgtgtggttttttggtcttccttatatgatcgcatcagagagtgccagtatgatgatcctcatttacttgtccttagggacaaagttcatcatgatgataccagagatgtgaccattggtgatgatggggtgttgaggatgatgggccagatatgtgtgcccaatgtagatgggtttcgggagtttattctggaggaggcccatagctcgcggtattccattcatccgggtaccgcgaagatgtatcactatctgagacagcattattagtggaggagaatgaagaaagacattgtgggatttgtagctcggtgtctcaaatgtcagcaggtgaaatataagcatcagagaccaggtggcttgcttccgcggatggatattccagagtaaaagtgggagaggatcactatggactttttagttggactcccacggacatttaagaagtttgatgctatttgggtgatcgtggatcggctgaccaagtccgcgcacttcattcatgtgtgtactacttattgtttagagcggctagcagagatctatattcgggagattgttcgtttgcatggtgtcccagtttccatcatttcagataggggcactcagtttacttcgcagttttggaggtctgtgcagcgagagttgggtactcaggttgagttgagcacaacttttcaccctcagatggacgggcagtccgagcgcactattcagatattggaggacatgttgtgtgcttgtgtcattgattttggagggtcatgggatcagtttccatctctcgtagagtttgcttattacaacaaaccagttgagtattcagacggctccatatgaggctttgtatgagaggtggtgtagatctccagttggttcgtttgagctaggtgaggctaggctattggggatagactgggtgcaggatgctttagaaaaggtgaaggtgattcaggagaggcttcgtacagcgcagtcgagacaaaaaagttatgctgacaggaaggttcgagatgtgtcctacatggttggcgagaaggttctgttgaaggttttgcccatgaagggtgttatgatatttgggaagaaaggtaaattgagtcctcggttcattggggcttttgaggtgctttgcaggattagggaggtggcttatgagcttgctttgccacccagcttgtcgagtgtgcatctggtatttcatgtttctatgctcgaaaagtatattggggatccgtcccatgttatggatttcagcacggttcagttggatggtgatttgatctatgatgtggagccagtagctattttgggtcgtcaggttcgaaagttgaggtctaaggatatagcttcagtgaaagtgcagtggggaggtcagcccgtggaagaggcgacctagcaggctgagcgggagatgcggagcagatatcctcacctgtttgaggcttcaggtatggttcttaactcgtttgaggatgaacgattatttaagagagggaggatgtaacgatccgactagtatctcctgagttaccactccattttccccattttctgcttcttatttctttatctatcggttctatatgtgatcgggttggttggctcgggttcggaaaggatttggtaaggtttgagacacttagtctcttttgagtaagcttaagttggaaaagtcaaccggatattgacttatgtgttagagggctcagattgtgagtttcgatggtttggatagcttcgggaggtgatttgggacttaggagcgtgatcgaaatgtattttggaggttcggagtagatttaggcttgaattagcgaaattggatttttggcgtttttcgattgataggtgagattttgatataggggtcagaatggaattccgaaagtcgcagtagtttcattatgtcatttggtatgtgtgtgcaaaattacaggtcattcgaacgtggtttggttgggtttttgatcaaaagcataattcggaaggtttttggaaacgtaggcttgaatttgatgtgttttggttgattcgatgttgttcgaggtgttttaaagattggtataagtttgaataagattataggatatgtttgtgcttttggttgaggtcccgggggcctcgtggtgattttggatggttgacagagagtttggaattcgtggtgaagatgcagattttcagcttctgttgtttccgcacctgcggattggggaccgcaggtgcgatgccgcagatgcgatgaaagggggccgcagaagtggaaaggagatagggaggcagaaaccgcagaagcggttggagaaccacacctgcgatggcgcaggcacggatagtgaattgcagatgcgaaaatgaggacttaagtgaggaccgcagatgcggtggtcttgagcgcagaagcaataccgcagaagcgggaatttggccgcagatgcgaaatccctgggccagaacatataaattgtttccttcgtgatttttgagctattccaccatttctaagtaggctttggagctttttggacgattttgaagaatgatttcaagggaacttcattgaggtaaggattttggacctaaaactcgttcctatggtattatttcacgaattagagccgtaattaatggaatttaagggttaaaattagggaaactagggcttgtattggagacctagacttgagggttttagggactatttgtggtcggattttggtacttttgatatgtatgaactcgtggggattgtaaggaacctattgatgtaaatttcatcgaattccgagacgtgggcccgggggtcggattttggtaattttgggatttgtgttgtatattgattattttcgtatgggcttcattcccttagcatattttgacatcatgattctgattttggatagattcgacgcgagcggaggacgattcgaggggcaaaggcgttgcgggctagatttggactagattgaggtgagtaataattgtaaatgatgtcatgagggtatgaaaccccggattgcacatcgttataccatattgaggtgacgcacacgctagatgatgagcatggggtcgtgcactgttagggattgtgacttagtccgtcccgaatgactattttaccacgtatttgactaaaaactgtttgttatcatcatgttttgggctgaatgccataattgggcctcgtgccaactatttgaacacttatgggatttttactgatattttctcactgttttgactttatacttgaacctagtcacgctatattctactgttttcataactcagtcgtgtttactctactttaacacttaaatgagattttaaatgatcttttgagttaagcatcatgttttactattgcccgagtggcttgaaataattttgactgagtaaggccgagggcctatgttgtgaggaaacacctgattatgattatgaggccgagggcctgagatttgtaagccacaaggtggcttgttgatataaggccgagggcctagtgatgatgccacaagagtgcttgatattgcggttggtccttaaggagcccctccaggagtctgcacatacctagtgagcgcgggtacccattgtgatgtaagatatagcccgaggggctagtattgtttctgagatattgcccgagggtggatttgttgacactgtgccagaggggcgatcctttatatgtttatctttcctaatttcctgtcatttgcttgcttaattgttaaaaaggcattttatgaagttttaaactgaactcggtaattttatacagctttactgcttcactgttttactagcttttactacttccttatagcctataatgtgccttatgtgatttcttactttcagtctttatttatgattattacacactgagttggagtactcactttactccatgcaacccgtgtgcagattcaagcgcatcaggtcccgctaacgagtgttgatcttttccagctcaggcggattcgaagattctctaggtagttgtcggcgttcgcatcctagagcttcttcctttatcttatcttcctctgttttaaatttgtattagactatatagacctttcttgtatcatccggattgtagatgctcatgactagtgacaccccggtatcgggctgtgttggttttacttctacattgtactattcactgcttactttgggattatttattacgttttagatttagttcttattgtttaattgcttaaaactgaaataagaaagtgtcggctggccttgtcttcatgagaggtgccatcacgaccgggtccggatttagggtcgtgacaggttccttttaggtgatcttaatcatccctaattcaacatgttcctttcaaagtgatctctacttagagcttttgtgaagatgtcagctattttcttgtcagtagcacaaaattccatagtaatcaaccccttctcatagttgtccctcaaaaaatgatgcctaacatatatttgcttagttctattatgatgaaccggattcttggtcacactaatggcactagtgatatcacagaatatagggatacaacctatatcaattccaacatccattaattgttgtttgatccataataattaagcacaatatgaggcaccaacaacatactcatattcgccagtagatagcgctacagaattttactttttagtagcccaagacacaagacatgagccaagaaagtgttccatacctgaggtgctctttctattcacaagaaaacctacataatcagcatcaacatatcccactaagttgaaattactaccttttggataccatagacaaaggttagtggtgcctttcaagtatctcaagactttcttgatggcagtcaagtgagactcctttggattttcctgaaatcgagcacaaaggcctacgctaaaaacaatgtcaggcctgctggtagtgagatataacaaagagccaatcattcctctatacaacttctggtcaacagatgaacgaggttcatctatatccaatttagtggatgttgcaataggagtgttaatttctttggatgttcctttctggttttgttactaaggaataggttcatggacaagttccctcgaggtttgaggattagttcctctctagtcacttcgccttgtcaggttgcccacggtggaaacccccattccatcacctatttcttcctgtgatgcagcttcaggctagactgtggcttcatcatttgagtttcttgtcagtccaatatcttcatcatcttgttcctgcttctcggaaagaattttagtttcaaaaataacatacacactttcttttacatacatagttcttttttatatatcttataagctttactatgtgaagaatatcccaaaaatactctctcatcacttctgggatcaaacttacctagggagtcttttacattattgtgcgcagagcacttacatccaaatgccctaaagtaggatatatatttggctttatccctttaaatatctcatgggaagccttcttaacaagaggtctagttatgcaactatttatgacgtagcatgcattattcataacttctgtaacattctcaaattcagtatcatgatcagacctaattgatgcaagttgattatctagatttttctgagtttttctaaaaaaaaatgaagtgaacatgtcaaatacttcatctctagatgttaaaaacagtgtacaagtaaacctagagtaatcatcaacatataccataacatatctcttaccacctctgctcaatgttctcattcgtccccaaaaatccatatgggccagttccatcgttctggtggtgcttaccattttcttgcttttgaaagaagatcttacctgcttctcccttgtacaagcctcacaaactttatcttcctcgaacttaattttaggcagccctattaccaagttcttgaagactagtttgttgagtcaacttagattatcatgtctaagtctcttatgcaaaagaaggggatcactgtccaggacactcaagaaagtgagttcattatcgaaaagtatggacagatctacaacatatatatttttcactcttcttcctggcaagactttccgactccaatgattttaccttgctttctcttttcagaggagacattacctcttttaaaggccacaagtgaatggaacattttctaatttcctgtcatgtgttttgagcaaccttttatcatatattatttttggttgctctttatcacttggacctataaaagaatatcagaggttagtcgtaggaacccaaactagtttgggtccctttctataggcaaaaggataaattaaattctttttagcccaacttggcaacatttttccctagaataaaatttttattcttttgatctgccttttcttttgtaatgcaatcactcttgtagtgacccgtgtttctacagtgtgtgcaaatcttattctcagggaatattaggtacttatttttgggatcccatttaggtgcagagttcccaatgctaagtccctttctattgctactatggtattcttgtagtcatgaaagtgcatcaaaggatctgttccatttacatgttctatctaacttatgcttaatcttagtcaagtcatccttcaaggttcttaccagttcatcccttttataaagctcatcttttacctttcctagatccttttctagtgagagttgtgtgtcactggctatttctttacctgttcctaacttcaatttcagattctcagatataagttctaagacaaatgtatcaagtgcatgaacctggttcttcaaagcagtattttccttttaagttttacaaatgtttattttcaggcttttgcattttgtttttaaatagttaccctcttttgataactgttctttttcataacttatattcttagattcatcaattaaagttagaaacaattttgatagtctatctttagaaaggagtttaattttattcttaaggtccagaaaacttatctcatattcttgatcaggttcattttcaaattcttgaattgctatgagagctcgttcaacattatcatcaatgtcttcatctgaactatctttccaagtagcaaccattgctttagatgaccttttgttgtagttcttcttgtcatgaacctgttccttatttcatatttctctttttttcactcgactttccatataggacagttcttgatcatgtggttttttttaccacatttgaagcatccatcagtcatctgcaagtgatctcttctcctctccttccacaaaaaataatagtgatcattgaatagtggtggcctagtggtagattgctctttagagttttcagatagtgcactcatcttgatcttttcctaaggtatttgcctcttcaagtataatctgctctgataccaattgatattttttacttcaataccacataagagaggggatggggtgatttgtgtggtgtccaattttttttgtgcacaaattatagaagaacctggttcttctatgtgttccttatactacagttgcagaataataaatgtagaaagtaaataacacaaggatttttacgtagaaaacacccgcttaaaatgtaaaaaacccacaacctgctacctagtaggattttctccaaacacttcactacaactcagagccaacaacaaagtttacaaactcttgcaaacctaaggattaactctagcccttatagcaaccagccctaggctgttgcgattgcttcatgttaactctaacatgaataataaaaatcgagtttacaacctcttgcaaacctaaagattaactctaatcattatagcaacccgccacaggccgttgcggctacttcacattaactctaacttgaatgatacaactcaagcacctagtacaatttgcttctaagaaagctgaaaggtacaactcaaaacacatactacactttgaactagaaataaagaaagacacataaaactctttatggagttggttcttcaatctggttcgtgtagcttcaggatcacactcttaaaactcacaggagttgctcacaaaatgccttgctattttgctctcaatttgctcttaacttcagtatgtgtgcatcacctgtaaagtgagaatatcctgtgatttatagagttagtagagtagaaaataactagagttctaatgctactcttctttagtggaaaagttctagttaccttcaacctctagctccttccttattttggatagtattcactttaagtaaggagtccttctccttattaattatgcaaccttttcgataaggagatatcaaatataccaagttaagcttatcttcgtcacgtgcatcccatatgctcgaatctgcccgtgtctatgctcacaagggatggacctggttcatgcctgatcttcatttgtcaatcttcaaaacaaaccttttcttgggccgacacctagttctgcctctaattgatatcgctttccatcaaaattatattcattgatacaaccgttattcacgaattaatatagttaatacaacttttccatcaaaacggtatttattgatgcagcctgacaatgaattgatacaacaaaatttgaatttggttgtatgcgtttgatacagcgaaattgaaatacattacctacgaatgataattaggccaactataactatgttaataattggactctaaactataatactttttgaaaattcctctacaatgaaacacaacccaatgattttcaaaacaaatgggctaactgagctttattagtccaatgtcattatccgatgatccactaatggtggatatgttcagggtatccgtaagtatatatatatatatatgtaggtcccttctgctcacataatctcattttttaaattttgtgcatatagtttaggaccgatcatcagttttaacacatacctgtattgtatataaactttattgttttggcatatattctataaataatgacatgctggggcggatcgacataatatgaggcctaaggcgaaaattaaaagtgaggccttaatttttttctctcttataatttatcgaaatttataatcagttttaattattgccaatgtctaaccaatttgtttaatctctcttgtattattttgttgaactttattgacttagtttttaaaaactttttcaaccgagacaactgatatagaaaaatccaacctattttaatttaaaaatctcaagttaatttgttaattaacaatattgaattaacactttttagctgattaagtttacccattagagtattcttctacgtatacagtttctcttagcacttttaaatctaaatataagttgaaacaaataatattatagtaactactatgtttcaagagtcaattaatgttaaggacaaattttaatagttactaatcaaagtagcttgaaaaatgtctacaaatgcactcaaagaattaagaaaaactgttctaaactaacattgtaagaagatcaacttaagttgggacgaattaaagacagaaaataactagtaactgaaatttaatatttgtaaaacttttagctataactattttaaccaaatgatttaaaatttctaacaatagtatataattatcaaaatattatatatatatattatttttatattttggggccgtaagtattttgggggcttaaggccattgccttagtggccttaggcgccagctgggcctgatgacatgcatgcaaagaaaaagacaaaaaaaaaaggaaaagaaaaaggaaaatgttatatgaaaaattaaatcttacaagaagtatttgctggtaagttgactcgacaatgcatggctcgctttcaaggaatacacaaatggattttctaactttattcaaaggccaaaagcataagtaagtttaagtaggcgtttggccataagttttggaagttttttttaaaaataaaaaattcaaatatatgtttgtttatagaagtaattatgtcacgaccaaaatcgatggttcgtgacgggcacccgatatcttactcaaccgagtaccaacataatgtatcttttcatatcatactatcatagataactgggtcggagaggccaccgtgaaataggtagaatacaatatgtaataccaacttatacataagacatatgagcctctaagaccaaaataatcactcgtgcactgaacataggttgtcaaggccatacaatctcttacatacatgatatttgtctacaagcctctaaggatacataattgttataaaggtagggacagaaccctccataccaaacaatacacatataaatcatactgaccaaacaagcaactccggagcaaatggagagcaccaacatcttccgctgagttgatcgcctacttagaggactcttgacctatctatcgagacctgcggacatgaaatgcagagtcctcaagcaaaaggaacgtcaatacgaataatgtaccgagtatgtaaggcacataaataagtacgtaaaagacatggaagaaatataaagtaaatgactcaacctgtaagtctggataactctgtaaattatgaaatacttttagtgtcatgcatatatgtatgaatgtcatgtcgtgtataggtacatgtgttcataacatcatcaagcctctgagggcatcccatcatatcatctcgtccactatgggcaaaatcatcaacgtataccagctgatcaggtggtggtgcgtatacaatatcgtaaccttttcccatatcccatatacatataatatacatatatatgcatatataacgccatctagtcatgggtcaatgtacatgtataaatgcatgaaatgcataagaaaatatgtcaataagattttctcagaatgccataaaaattcatatgcctttcggataaactttatcaaatacgtatttttctgagaccgtgaatagaagatataataataatctacattgggaatcaagaatatagacacccctagtatttctatgattagagtcatttattgaaattgtgcatttactcgtttcgtttgtgacgtatagatcatgccaaaagaaataagggatagtcttaacatacccggaccgattctcttaacaattcttctaacacacgtcttatgtgaaaaacatgtaatgacagattgaagtagagaaaaatccgtatgatattcttgagaaaaattataccaggcttcgttagaatttcaaaaatatcacatttctaagatatgcttgcttgaatttattgaaacagaatgccagtcacgttactaaggcaaattgcctaccattttttatataagcaactctttttagagaggtcttatgttttaatgctgtaggccccactaatttagtgacttggccacaaatcttactaagttttgacaccttaatatgtgacattaagagtcacaatttagagctagtcttgctgccacgttttagggtgggaaagcttaatctttatccagtaattaggtaacgttctattacccggtaattaatcaattatttgcataattaagaaatgtctcaaattactttaaaatactactcatttttaatatactttatatataccttatgtcgtagtcatgtggtacctcgtatggcactagtccataaataccgagtattttagatcgggttgtattcagtcagctcttcaggtttctcacggtgcttcaggtagccgtagtccgcagatgcaatattctgatcagcagtcctacagtgcaccaccagctcctatcagtgcactgctgctccagagttttcggggtggttattcaggtcgccagggtcagtctcagtttcctcagccacaacacttaggtggatgttttgagtgtggtgagtatggttatattaggaggacttgtccgaggttagtgggtactcagtcgcagcagcagggtttccgcgctatggttggggcaccaggttttccacagaccacccagccagctagaggttctagatgtggaggtagaggatttagaggtggagctcagaccgctagaggtggaggccagccagctacaggccgtcccagaaatgtagtccagggtggtggggcccatccctgatgttatgctcttccagccaagcccgaggctgaggctttagatgtagttattacaggtacggttcttgtttgtgatagagatgctttagtgttatttgatccagggtctacgtactcgtatgtgtcatcttattttgcaccgtatctggacatgcctagtgattcattgagtgttcctgtatatgtgtctacaccggtgggtgattctattatggtagatcgagtccatcgctcttttatagttgtgattgagggtcttgagactcgtgtagatctgttgcttctggacatggtcgatttctatgttatattggggatggactggttatcaccttaccacgctatcttagactatcatgccaagactgtgaccttagccttatcgggtttacctcgtttagagtggagaggtactcctagtcattctacccgtaggtttatctcttatgtgaaggcttggcgtatggtcgagaaggggtatttgtcctatttggcatatgttcgtgattctagtgccgaggttccctctattgattctgtacccgttgttcatgagtttcctgaggttttcacttcagacctgccaggtatgacacccgatagggatattgacatttgcattgatttggatctgggcactcagcccgtttctattccgccgtatcgtatggctccgtctgagttgaaagagttgaaggataagttgcaacacctacttgagaagggtttcattagacccttgtttcaccttggggtgcgccggtgttgtttgttaagaagaaggacggattaatgagaatgtatattgattaccggcagttgaacaaggttacaatcaagaataagtatccattgccgaggatcgatgatttgttttatcagcttcagggtgccaaggtgttctcaaagattgatttgagatctggctatcatcagttcaggattagggcatccgatgtccctaagacagctttccacactcggtatgggcattatgagttcttggtcatgtcatttgggttgatcaatgccccaacagcttttatggatttgatgaaccgcgtgtttaggccttatttggactcgtttgtgatagtcttcattgatgatattttgatatattcttgtagctgggaggaccacgagtagcatcttagagtggttcatcagaccttgagggataaccggttatatgctaagttctcgaagtgtgagttctggttgagtttagttgcatttctggcctagaccagcatcagctacacagattcagagtttcttgggattggtaggctaatatcgtcggttcgtggaggggttttcatctatcgcagccccaatgactagattaacctagaagggtgcccaattcagatggttggacgagtgtgaggcgagctttcagaagcccaagacagctctgaatacgacaccagtgttaattttgcccacagattcagggccttatacagtctattgtgatgcatatcgtattgaacttggtgcagtgttgatgcaggatggcaaggtcattgcttatgctttgcggcagttgaagattcatgagaagaactacccggtccatgatttggagttggcagccattgtttacgcattgaaaatttggagacattatctgtatggcgtggcatgtgaggtgttcacggatcacaagagtcttcagtatttgttcaagcaacaggagttgaatttgagacagaggaggtggttagagttgttgaaagattatgatatcactatcttatatcatccgggaaaggccaatgtggtggccgatgcattgagtaggaagtcatccagtatgggcaatcttgcttatattccgggcggtgagagaccgcttgctttggatgttcgggatttggccaatcaattcatgaggttggatgtctctgagcccagccatgtgctagcttgcacagccgcttgttcttctttattggagcgtatccgtaatcggcagtatgatgatccccatttgtgtgttccttagagacggtgcagcatggaggtgccaagcaggttaccttagatgatgatggagttttgagattgtagggacaagtttatgtgcctaatgtggatggactccgagagttgatcttagaggaggcccatagttcccgatagtctattcatccgggcgccgcgaagatgtatcaggatttgcggcagcattattggtggcagagaatgaagaaggatatcattgcatatgtagctcggtgtttgaattgtcagcaggttaagtacgactttggaggatatgctctgagcttgtgtattgactttggaggctcgtgggatcagtttttgcctttagcagagttcgcctacaacaacagctaccagtcgagtatccagatagctccttatgaggctttatatggtaggcagtgccggtctccgatatgatggtttgagccgggagaggctcggttgttgggtacagatcttgttcaggaggccttggacaatgttaggattattcaggataggcttcgtacagctcagtccaggcaaaaaggttatgcagaacgaaaggtttgagatgtggcatttatggtcggtgagcgggtattgctccgagtgtttcctatgaagggagtgatgagatttgggaaaaagggcaagcttagccctaggttcattggtccgtttgagattcccgatcgagtgggagaggtggcttatagacttgcattgctgtcgagcttttcaaccgtgcatctagtgtttcacatgtccatgcttcgtaagtatcacggcgatccatatcacgtgttagacttcaacactattcagttggcagggacttgtcgtatgaggagaagccggtggctattctagacctgcagattcgttagttgagatcgaagagttttccttctgttcatgttcaatggagagatcagcctacggaggcatcgacctgggagtcggagtccgatatgcggagccattatccccatctttttcccgactcaggtacttccttcaggtactgtccgttcgaggaggaacgattattttagaagtggagaatgtgatgacccaaaaggtcataacttgttttaatatgaaacttccatgttctgaggccttgaaaaccttatttagagtcacctcgagttgcatgcgcagtccgggcgcgtagccagacaacttaaatatgataatctgtgaaaaatgataagttttgactgtaaaataaataaat

SEQ ID NO: 74 - DNA, 64981 bp, Nicotiana tabacum
ttaacttttctcacatttcttgctttaaggaagcgtcttcctgaatgaacattccctaaatttctcatgaatctatgtttgttgtccattctattatcgccagaacgcaatatgaaattctcatgatgttgaacattatcaaaccagtccctaattcatgtttattttagcttgttcaccaatccatactgatttctgctactttggggtctaacttttccttctggtattcacgttagggtcacgaatttattttcgaaatgaggatgtgactttatgacttatactcttttgttgcatcaaggtctgtcacctttcgtcttttccttccttgaccatagattcagtaatacttaccgttgtcatccatgtatcacttcttactcataatgcttcattatctctcttcttatttcccgaacatttatgtctatcactttattttaaatacttcaacaagatattcatttgctttgctcccttgctccatccactgactcttcgagttacgtaacattctttatctactaggacgggagccatgctaaggtaatatttatcccttcaaggcttccagtgcctatctttatagtacacaaatctagcttcactattttagagtacaccactaggtatctcacaaggagatctattagcacatttgcaatatccttcaaaaatgtgaataaacaaacattctatccaccattttgggtgctctaacctagtcgaatcctaatatccttccctctcttatacttcttttgttagcctcatagggcataaataagatgagtgtggccaattgtacatactcttgttattgttgaaggtgactctaaatgcttatatttctcttcctaaattgtagataatgctcatctttactaattaggtaccttgtacccttgttcacgttgcttcttttatttgttgaaacttgtatcttctgattctttcattgctttttaccataagagtggatagatgttctttccttagggatcattatcaagaagcttacacctttcagtatacacatgatctgctgaagacctcacatttacttatcataaacatgatacaaagtcaaggtctactggcgcaactcttccatagacatatctcttaccaacaatatttttagatgtaggtatcgttttattatgaataaatagagtttatagtttgaattcttacaaataagctctacaacatgatctagagtaagaagaagagtgacagtcctaaatgcgtcgcctcctgcttataagtgtggtgaacaacacacccataaacaagatgatagattttaaatattcttgccttatgttttgatgatctaacaaacttactgttaagaactagatagggaacctgacctacttagactgctgcaagctttaatagactccagctagaggtgaactgctacagcttgaggagctaggaaccaccaaggactgatgctcttgtggtttcctcatagcagtacagagtcaattggacatagctggaatgaagtgactgacgacactatttttgccacactacactgtcctcccactcattctctaaccaaacaaagtactcacatcatttcaagtgatgtaatcaagatgtaccacaatgagctttatacaaaacatcattggaagtttctgtttcttattcaagcctcttgcaaaaatagagaaatcaatactcacaacttgaagaacaaggttgaacgcaactatggaccagttcctaaaagatagcctgtttgtccttgttgagttgtaaccttgttattatacttattgtatctcctaaactacttactagaagcgtttgattaggaatcctcttgaaaatccgtaaactccttaaatttatgttgtgattagatttagccataaggaaaagtctttgtaattgtagagttacaaagtggctttggtgagagcatcacaagttagaaaaagcctttgtaactaggaagtcacaaagtggcttgtgtaagagtaccacagttagttgagtaaatcctttgcaataggaattattgtaaagtggcttgtaataggtagattacaagttagtgaagttaaaagcctacatgtataggtcgtagtttttttatccccttgtgtgggatttttccacgtaaaaatactctgcctcatttacatactgttttgttagcattctcagtagaatcttgtagagggccaggtactctatagtttggtggacccatacaaactaacaattggtatcagagcaggttcctcatattaggctaacacctaggaaggatcctcatggcaactccaccaaattttgaagaaggtcattccatatacaaacccccaaagtttaatggacaatgttattggtggtggaaagctagaatgcatgatttcattatgactgaggattgtgagctatgggatataatttgcggcggtccttaagttccaatcaagttactagatgaatttccattttcaatggcaaaaaccagcaaagaatacactgaagcagacaagaaagcggtggagaagaatttttgtgccaagaaaattctagtatatggaatgggacctgaagagtacaatagaatctctaccagtgacactgcaaaagaaatatgggaagctttgcaaacaactcatgagggaactacacaagtaaaacagtctgaagataaacctaatactggtggtagttccatgatggtagttgaaggcgaggagattggatatgactcaacttttgctttgatggctcaatcagatgatgatgaagacaatggcaacaaagaggtaaacttcagggatgttaagagaaatctgaaattctattctctaaaaaaacgcatgtgtttaggtgttgttttaatcactgccttttgtagtcttgcggaggatagggattctttgatcttagaattagaagaatcttaacatagtatagaagacttagtggctgcagttactgaccataagaaaaccattgaaatccttagaaaagaaaagagtgatatgttggcaaaaattgcataccaaagggaaacaatagtaaaaccatggactaagtcaaaacttgaaagttctgaaagaggaaaggagatagcaagtgaggaatacattaagcttgaagatgaggtgaaagctataagatttaggatgtgtgctgaaattgagaaaaatgagcttctccaaaccaatctagaaagagtaatgaatgatcttgaaaagtctttaaagtgaacccggtccttagaagctaccactgccttacttaataatgattgtgaaaaaaggctgaatgcagggttccaaagggagaaaatgcgtcacaaccctcacagtaagtatgtcactatctctgataactagcctcgtacccaatgtgggaacactgggcgcttcaagaaaggtgtccaggccaagaatcaatcagttcagaaagacaaagtggctgttgaaaccgtgaccataaaagagggaccaggttccacttacaaaaaaacacacattaactgcatggactaagagagctcttattcatcctcttgcttactacaagggacccaagcttgtttgggttcctaaaactaactcctaatctcttatgcagggaacggtgaaaggaggcggccgtcaatagttcatggatagtgggtgttcgaaacacatgactaggaataccacaaactttctttcactaaaatccctacaatgagggagtgtatcctttggcaatggtaaaaagggtacattcttggagttgaaaaagttgggacgtcactcactcatcctattgaaaatgtgtactatgtcaatggacttaagtatggtctcctgagtgtttcacaaatctgtgataaaggaaacaagatggaattcttgtccaaaatatgtacagtcactgaccttgtgatcgatgaaatagtactggtggccaaaagatacaagaacatctatgttgctaactttgaatatttatagagtggtgatctgagttgtctgaaagttgttgatgatgatgatgaactatggcacataagactaggccatgcaagcttttcctttctgaataaactaattcagaaggacctggtttgtggtctgcctttgtcactaattaagatgcagaaagtctgtgatgtctgtgctagaggaaaacatgtgaagtcatcctttaagtctataagagatgtgagcacctcaaagccgcttgagcttctacatatggatctgtgtggacctatgaggctgcaaagcagaggaggacaaagatacatttttgtaatcatgaatgactattccagattcacatggactctgtttctcagaacaaaagacgaaattattgaagtgtttgtagcttttgtgaagaaaatccaggtgaagatggagtctagagttgtatgcattagatcagatcatgggacagaatttgacaatgtcaaatttgatgaattctgtaatgaaaatggcatcactcacaacttctcagctcccaaaactctccagcaaaatggagtagtataaagaaagaacataactctagaaaaaatggcaagaacaatgctgatttgacagtggaattgcaaagaacttctaggctgaagctgtcaacactgcctgctacttagtgaataggtgcgtgatcagatcacttctaaacaagaccccatatgaattgttgaatggaagaaaacccaagctgattcacctaagaacatttggatgcaaatgttatgttctcaacaatggaaaatatcatcttggtaaattcgatgccaaaagtgacgaaggaatatttcttggttactcctctcaaagcaaggcttacaaaatatataacaagcggactcaatgtgttgaggaaagtatccatgttatttttgatgaatcatatccatcatttgagaagagtgctgagaaagatcaagatggagaacccttacttgttcctggtgaaggcattaacatgacaaacgaaaaagtagatatgatgagtcaagtaaaggagccaaatgaagacaacgctgcctcatcataagcagaaccaagcacttcaattacaaccactgaagctgaaaaaagggtggttgatgcagtttagagaactctctctagcatctgagagaaggatagaggaaaatcagccaaccataccttcctcctctcagaatgaaccttgggcgtctaactggagacaccaaagctctcaccctatagataacatcatcactcctctagattctggagtacaaaccagatcaagagccaaaatttacttgccttctcagcctttctctcccagatagaacccaaaaatatcaaggaaaccttgaaagatgcagattggattacagccatgcaagacgagttgcattagtttgagagaaacaatgtgtagcacctggtacctagaaccccagatcaaaccattataggaaccaggtgggtattcagaaacaagctcgatgaacatggagttaccacaaggaacaaggccaggctagtagtccaaggctacaatcaagaggaaggggttgaatatgataaaacgttttctccagtggctcgcatgggatttatcagaattctaatcgcttttgcatctcatacaatattcaccttgttccaaatagatatcaagagtgcatttttgaatgaactccttaaggatgaagtctatgtgaagcaacccttagggtttgaatgtcacgagcaccctgaatatgtgttcaaactggacaaagctttgtatgggctaaagcaggctcctcgagcttggtatgaaagactgtcaaagttcctcttagaaaatggttttaaaagaggaaaaattgacaacactattttcttaaaaaaacgaggaaggaacctgctcatcgttcaggtttatgttgatgatatcatttttggagcaacaactgactctctatgtgaagaaattgcaaaacttatgggaagtgaattttaaatgcgcatgatgggagaattaaacctcttcttgggtcttcgagtaaaaaagtccccaaacggtacttctatttgttagcaaaaatacatcagggaactcttaaagaggtttaacatggaagcatcaaaggtgatagacactcccattgcaactgccactcgactagacatggatgaaactggatctcctctgaatcaaacaatgtatagaggttatcttgtgatgcaaactatgcaggttatcttgtggacagaaaaagcacttctggaatggctcacttcttaggttcatgtcttatctcttggggaacaaggaagtagaattcagtggctctgtcaacagctgaagctgaatatgtagctacagcatcctgttgtgctcaacttctatggatcaaaaagcaactggaggattttggggtactcactgagagtgtgccccttctatgtgacaacaccagtgcactcgatatggccaagaatctagttcaacataaaaggacaaaacatattgatgtgaggcatcattttctgagagataacgtggagaaagggttgatatgtatgaagttatgtagcacaaaagatcaaattgtagacattttcaccaaggcactaagtagggaacagtttgaaagaaacatagtaaagctgggactgttgaagccaaattaagaacctgtttcctctttggttggcacctatccttaagaaataactggctcaaagtgttttctggccatgtctaactcacttcaataccgttgcaggtaaacacacatgatgagcatagaggaaatagatgcaatgcaagattgatgaaagaggattgatttctttcaaaacaaaaaaaaagagaagaattttttttcaagaactaggttcttgtactaaaggttagtagttctatgcatccttttaatacacgtctaagggtacaaaatacaactgccatgtcatcaactttttagatcttgctgtcacgtcctttcaattcaaaatgttccatctccctctgaaacattgcaattctccatgcccaaccaccgtttcagaacaagtgcttattcctttccctttataattatcctctccttttaaaacccctctcttctgctcttcttaaccataagtcctacactagaatcacccaaaagggaaggatcctaacaccacttctttcaatggctgaaaaaacttccgatctctttgcctctatggagatgagcaggttctacaccactgacccatatatggaacctttcattttgactgagccttcctcaccctctaccactcttgctgctgcagtcacaccttccccaatttcccaatatcttcccaactcagaaacctttaaaactactattttgttctccccatcgtctgttgttcccaccaatcaaaccctaagtggagaacaaggtcaaaatactgagttcacaagggttctgaaatcgttgccaccgatttcatggttttggaagcaccggttgaagaaaagaaagatgttgtaactatgtttgtagtatccactgatggggtattgcatgaaattacatcccaaaaaaatgagatacacgatgtggaggaataaggggccattgtggctattgaagggtatgcaatagcagatactactggggcatcacatgaggaacctgatccctctccggaggacccaggttagggctctcatccctaggacagtactattcctgcatttgatgttgtgcccctgggaattcaagcacctgaaatacgatctagtgatgaataagacctggataatgtggctcttgatgcattcataagtaagcgaagggttgcgtccacccttgagtctgaaatcaaacgacctactaccacgcttcaagtcaaagtggcctacgactctactctccaaacgagcaagaagagtagtaagaaaaaaaaagaaaaaagttggtgaaggatggtgtacctgtaagtgatgaggctatccttgtagtcgaggtggaagagggaactccagaggaacccggttcacttgttaggcgatctttgaaaaagacaaagcctgtgtcaatagagaaagggtcaacatctaagtccaaaaagaaggaggtagtgagtgagttttctatgtctgatgaggatgtactagttaagtctaaggcaaaaggcaaagtcagtggagagaagtttgggaaacgcaagtcggaatcttttgacgaacctagttctatgaagaaaatgagaagtgaagtcagccttggctctgagcttttgaggcatcaaaaagttctattgggtcgtatgtttgacccaacaatctctgatatggctggaatgcgccaaattctggaaatggtcgagtttcaacgttgggtgcatctatttcacatggatgcacctaaggtgtatgaggaggaggtacaaagtttctttgctagcctctttccagttgatactgaccatgtctatgctttggtcaatggggtggacatcgtgtttgatgtaaaattgcttggagagattttaaaagttcctacagttagggtgttgagtgtacgagatgtttgtcagtataacttcagaaatgcaatggtgaaagaaaatgctaatcagaaaggggactagatccataagaaagcactactccctgtttaccagttgttatttaaattggttaacaaagtcatgttgcctcgagccgaaaggaggttagtgacttctaagtctgacctattcctaatggagcaacttgacggtttcaatcctatgattcttcctgctattatgatcgaacacatgcaaaaggtttccaccttcaaggacggtaatcatggacttccctatggattctttcttactccagtgttcaaattctttaaagttccactgggaataggtaaagtggggtctcgaaagcggacattctcatagacaactttggaagagtgtgagtgtgtggaaaagtattgggggggaggagtaggaaatacatcaaccgtttctcagcttatcaacgtccaaaacagtgcagctgaggaaattcatcggttgaaggccatgaatgttatcctggaagatcagcaagcccaaggggttcccatgtcgaatgatgaagtggcttgtttgacacaggagaatgctaatctcagggcgcaagttgagaacttgaaggcggaactgctcaacgagcaaaagtcggcaaacaccttaatagacctcgttctccaggcattttctgctgctaccaatccttttactcctagtgccctaaagtacccctttagtgaccagttttctggatatgtttcttatgtttttgtttcattgttgatggtttggcggatgtttttttgttttctttttttgatggttgggaggaaacattactactcccgttagcaagtccaaatgttgcctctagcctttttcataggcagaggtatattaaatcgttattaatattaattctagttttattatgtcagtactctatgtgttctattctctatcatgattgtgtgcacatatgtggcatgagttagcttcactggacttctttgtgctgttatttttttaatgatgccaaaagaaggaaaaaaataataatcagggggaacacacatggaggaactagttcttactactctgatcatgtaaaagataaggcatagtcttagggggaactctctgtgttccctgatactttaaaactggtactgccctaattccagtttataaatgttaagtttgtcatcatcaaaaaggggaaattgatatattttaaatactcttgccttatgttttgataatctaacaaacttactgttaagaactagatagggaacctgacctacttggattgctgcaagctttaacgtattccagctaaaggtgaactgctacagcttcaggagctagaaacccacacaaggacctgatgctcttgtggtttcgtcatagctgtacagagtcaattggacacaactagaaatgaagtgactggcgtcactgtttctgccgtactgcactgtcctcccactcattctctaacaaaacaaagtactcacatcatttcaagtgatgtgatcaagatgtacccacaatgaggtttatacaaaacaacactggaaggtttctgtttctcattcaagcctcttgcaaaaatagagaaatcaatccttacaagcttgaagaataaggttgaacgcaactacggaccatttcctaaaagatagcttgttgttgtcctagttgagttgtaaccttgttactatacttattttatctcctaaactgcttacctagaagcatttgattaggaatcctcttgaaaatccataaactccttgagtttatgttgtgactagatttagttataaggaaaagtcattgtaattgtagagttacaaagtggcttgtggtgagagcatcacaagttagaaaaagactttgttactaggaagtcacaaagtgatttgtggtaagagtaccacaagttatttgagtaaatcctttacaacaggaattattgtaaagtggcttataataggtagattacaagttagtgaagttaaaagcctacatgtgtaagtcgtagtttttttgatctccatgtgtgggattttttcacgtaaaaatcctctacctcatttacatactattttattagcattctcagcagaatcttgtagaggaccaggtactgtatagttcagtggacctacacaaacaaacacaagactctactagacatggcttgtagactccataggacagaactgctttgataccacttcggtcacaccccgaacctggggggcgaggtgcctcacctatccttgtgtacaaacttgcgactaagggactttgaacatataatgtcatactttggccatgggccacattgcaagacaatttgcaaatgctaactaaacatcaacataatgttgggccgacaaaactatcataactactacagctggaaaaccaatcaaaatatacatacaaggcctacaagcccaatataccacactaactgacaggatatatgtacaggcctctactgatggatatactatgatcataatagggccccgagctactcataacatatatacatatatacacaagatgtacgtaaagctctagacccgacaactctaaagggcatggagcttaccgatcaagttaaacttgggcaacacctaatggggatgtctacctctctgtctgtttgaacctgcacgcatgaaatgcagtgctcccaaaaaagggacgtcagtacgaaataatgtaccgagtatgtaaggcaatattatgaaagctgaaactgaattgataatataataacttaaagtaactgggagtcaaagataatctgaagatatgctcacctgctgatactggctcaactctctcaatatagtaagtaaaatagctatccgaccttataaggtttggcatatatatagctgctctgccgtagtaggctcgctcataggtgctcaaccatactaggatctgtatctcggccaactaggctcgctcatagccgctcagccgcagtaggatcggtatataacttaccatctgattagaggttgcccaatagaggtctgtccaccgattatatgtaataacccggctagtcgtattgagaattaacgcccgctcccatattaactgctttcaccgtgttttcatctatttttatttgtcgggatgtttggttttgagtttcgaagtatttttaggacacttaatccctaaatgagagtttaagttctagaaattagatcgtagtcagatcagtgtgtagacggcctcagaatagaatttcattggttccgttagctccgttgagtgatttaggacttaggggcgtgttcggattatgttttggaggtccgtagcctcattaggcttgaaatgccgaatgttgaatttttgaagttttcggtttgatagtgagattttgatatcatggtcggaatgaaatttcggaagttggagtagctccatagtgttggatgtgacgtgtgtgtagaatttcaggtcattcggacgaggtttgatagagtttttgatcaaaagcataaattgagagtttctgaagttcttaggcttgaatctatggttaattggttgattcgatgttgtttgaggtgttttgaagttttgtataagtttggatagtggtatataacttgttcgtgcttttggttgaagtcccgggggcctcggggtggtttcagatggttaacggggggttttttagtttggtttggcagctgaagtttttccattgctgtcataaccgcacctgcgactaggggaccgcaggtgtggactcgaagaagagagcatagagacgcagatgtggccacaagtgaaggcagcagataccgcagaagcggaagggttaccatacctgcgggaccgcagatacggaatatgggtcgcaagtgcggagatggaggttttagtgaaaacagcagaagcagttccctcaatcgtagaagcggtagcgcagaagcgggaattttgactacacatgcggatttactaggcagaaaataagaatttcaagggtttagtttcaaaagttgggacaccgatttggatcttgggagatggcgattttcagaggattttgaagaagaaataagtgggtaacgattcctaatccctttctagttgtattcctataatctaatcttagatttgtcatttaatttcggatttgggatgaaaattgggggaaaatttggagaaagttcttagacataaatttcaagttttggtatggttagactcgtgagagtatgaggattctgaaaataaaatttttatccgattccgagatgtgagcccgagggggcgttttggtcattttatctaattttgcatattagcttagaatttgtttataaaatcagttatttgaagtcttatttatattatgcaattgaattgaatagatttgggccatttggagtcaagtacttgtggcaagaacctggtttcgggttgattttgagcttgttcgaggtaagtggcttgcctaactttgtggggggggggggaactccccttaatatttggtattattgatatttgaaattccttgcacgtgaggtgaagagtgcgtacttgtgctaatcgttgaaaatcttgttttcactaagtaactttaattgtgttttcccttcttgtttattctacttgcaatcaagcatgctgttagcttagagaatcatgtctaattgccttaattgtttttattttctcaaactgccttatttggactatgtgaagcatgttatgttagaaatacttgttaccttggtgtgaaattgaatttaattgagtattcttcgtgttgttactgcgtgtttactttaggactacaggacggtatcccgggagatcccctacacatatatatcgatttggactgtagtgcgggataccaagagatccccaatacatattgaggatactaagagatccttgggataccgagagatccccaacatacatattgaggatactcaaagatcctcgggatactaagagatccctggcacacatattgaagatactaagagatcctcgggatactgagagatccctggatgttatctctgtgttgagttgtactctttttcgtgattattttgtctctgttatagttgttgttgttctttctattttatgttatttcttactgttgcacttaatttttactgtcttattctatactgtcataccttatatttcatttaatctcaatagggccttgactttcctcgtcactacccgatcgaggttaggcttggcacttactgagtaccgttatggtgtacgcatgccctttctgcgcatgtttttcatgtgcagatccaggtatttccactcagtcttatcacactttaggcgaggtgctgttgtagacactccaaggtatatctgctgtgtccgcagaccgaagagtccctttctattctcagtactagtatagcccttctgtattttccttgttgatagacatttctggacttagagctttttatgtaatctcttagcttgtgattcatggggttctagattttgggagtgttaggttgagattcttgtactgttatatgccgaacggcaccttaaacactgtttcactttgttatctcggtttttaattattttctttccacaattgtttcttttctacatttgttaggcttacctagtcatagagactaggtgccgtcacgatagttcacggagggagaactgggatcgtgacattataactcaacgataatgaaaatactgtaatactgtatctataggctctctactctcttgactggaaaaagacaatactcaatagaatatgaagtcccaataaggtagaatactgtaacttatgagactaggataatgtatataaattcgggagcatgaacttctctttatgcctctttatcaaccatatgtaataatgagatcatgtcaaaatgaaggaagggcttagctttaacataccttatctgattctattgacaattcctccaacacacgttgattgtaaagaaacacgtaatggcgagatcaaaataggaaacaatccgtatgaaatgctcaaagccaaaacgttgctattgcaaaattatttttgttgaaactctttctcaagatatttagaattaacgttatgtaatggaaagtttggctaaaattcttcttaagagattagaaaatattgttcaattatgaatgttatctttaatttttgggtaggccccacattccaagcttggtgtcactttcctttctcaaagtgtgacacctttccaccttcagtaatagtcattagatagataaagaaggcttaccaagttgggggggggggaggggtctaagtcttatcccaagattaataattaattacccactaattttaattaacttgcaaattctccccattaaccaataatccacataattaagatttatctcaaattacttagattgatactcacttttaacacaccttatgcaccttactatcacggtcatatggtaacttagatggtattaatccataagtaccggttattttagctcggcccgtattttattccaaaatatcaaactttgacgaaaatttattttcttcgatttgcttgccctctcatcttcacaaatttatccatcacttgtttgaaatagcttaatgcttataatcaccaaagaatcttgtccttaaactgaggtcaattatcttatgataatttcatgtataatactaaagggtgtaacatcgtcttcatataatattacaggtcctaatatcgacataatactgcggggagtaataaccacgatttactacccagtaggattttctccaaacacttcaccacaactctgagccaaccacaaagtttacaaactcttgcaaacctaaggattaactctaacccttatagcaaccagccacaggctgttgcgactacttcaaattaactctaacttgaaagatacaactcaggtacctagtataatttgcttcttagaaaactgaaaggtataacttaaaacgcctactacactttgaactagaaataaagaaagacatataaaactctttatggagctggttcttcaatctggttcgtgtagcatcaagatcgcactcataaatctcacaggaattgctcacaaaatgccttgctattttgctctcaatttgtgctttttacttaagtatgtgtgtatcacctgtaaaagaaaacaacactaatatttatagaattagtaaataaagattaactagagttctaatactttactcttccttggtaaaagagttctagtcaacttcaacttataattcttctcttatcttggatagagttctcttcaagtaaggagtcctgctccttatcaaatatgcaaccttttcgttcaaggaatattagatataaccacttatacttatctctttcaagtgcaagccttttgctttatttaatccatcacatgtgtacactgtccttggacctgattcatgcatgtgttcctttgtcaatcatcaaaacaaacttactcaagctagcactttgattggatctgtggttttagttccggtgtcaattatgatgagccatttcagatttggtgcccattatgacaaccatttcggaatcggtgcctcaatctctatatgtagggatggccaaacctgaatttgaatcttttattcttccaaactttgagacttaaaacatccttttggaacctctattttatgcattgtttccttctttcgcatcctaaactctctttccagtatccgtctttactttctcataaagatgtcaaatgtatcatctgatgttgatgaagggagccacattgttccgttggtggttgtgttccctaatcaaggggagaatgcagctaccaccataaagaatgaaacttttccctcggtggaggatatcatctcccgcagccccgaaggcaggtctgatttccaacgttcgccggacgcggtgcttggaaaatccctcctcatgttatctctttattctttcctaggttcagtttgtatcaagatgagtcatcgagttggtccattgatgtcgtcatcatatgctcggactacagcacaataggtattatggatttcatcccaagtcgttggaggatacttcatcaattggctcagcagctatcttgtcgctcttgaaccctatctactcaacccattcttaaaggctgtgactataatcccttcggatacatttggtaaggtcatccttaccctgttgaatcgggtaaggaagtccctcagtccctctcctaaggattgcttgatggagaagatgttgtttactctcgtttcgattttcttggccccaacatgtgccatcacaaacttgtcagccattttttcgaacgtttttatggagcaggctggtagccgtgaataccatgttaatacccctctagggagggtttcactgaatttcttcaacaaagtggaggacacttgttccttggtgaggtcgttgccctttatggcggtgacgtaatgagtcacatggttttcgaggtcggttgtcctatcgtatattagagatacagtggcattttgaaggtatttggtatggcatgtagggcctcttcctcgctatggctactctacaaacctaccgacgtccctttttggcggtaacttaggggcacccgatatcttgtctactcgctccccatgttccttcatttggtctgtgagcgtcttattttcattctccatttcttccattcttttcaaaatagcggcgaggacgttgtcatctgcactgtcagtaacattgtgtgttatacctagagttggagggtctggttgatcgccatgttcgtcccctcgttgtaccatgtgggctcttgtgatttctatggtcgtgcatggagcttgttttttgagcacgcttactagggtatcagttagtcatgcttcgaggggttttttcattgcaggtggcttcctttctcccgtatacatggaagatccttttctgtttagcctcattgtgttgcaataaggggagatgacttctcacgcctaggggaggcagtgggcgtcatatcctcgcactgtatttcatagctctcgttgatggagctcatgaggttactggtatgtcccatgtcgccctagtcccttttccttggttactttccagggaaatgtttgtgcatgcagagaggagaaaaaatttgtggcctcttaggttagaaagtcacttgagttttagacttaatagaaactaaaagattagctaagaaatccccacagacgacgccaaacgttttgaccaaaatttagatcaagtttaaacaattagattttttaacaaggtggggttaatgttagccaataataatatcccttagaatgtttaactagtgtcgtgataaaatgttacaagatatgtggtaacagtgataaatatataataatgaacaacacttaatggcacaaatatgaagtgaataacattcagtagcaataaatgatgtataatggtatttatgtaaatatatgtgacagaggtgaccgaaaaagggaatgaagctgtctaatattccttccgacaatgataaatgattgataagcctttgaatattcatattttccttggatcgtgggaaaaaatctaggcagggatctcaagaaaaaggtatcttttatatatatgtaataaagaaaaaatctcaaagaatatcaaagtgttgttgttttacaaatgggtgttcattatcccctataactatgtctctttctatttataagggtacatgtgccacaaaaccctaatagtacagatccagaaaatattctgtgaaatattctttttaaagtcttatcctaaaactagccattattactctgtttaaggagagtgtttgtcctcgaccttgatctctgttaacccctcgatctagcccttcatctcttgtcatatgacttcgaccttgaatctgttttttcttaaagttacattggtaatacgtggcagccctcgaaggccctatttatactgacgtggtctaaatactgttgacattcaattttttcctatatattttcaatatgaaaaataacttcaaaatgacatatatatgcatatgtaagcatatccaagtgttttattattttttcataatttttaaaggtttttaaatcaatttatttccctcttttatccataaaaaaactaataattgtttccaaaatattattttggtaattcatttgttggaattttatatttatactatgatatagctaaggtaacttttgcatattgttttacaaatttatttagtatttttaagctaaattgcatataattgcaatattggcccttttaagattcaattgtgttttatattcataaaattaagccctgtatttttaaattgttaattatatgttataaatcattttagtgctctcaatttattttcagaaattaatttactattttttataattttaaaagtggaaaattggctatttcaataatagccgagttacatttcaattttagcctatatctgaccccaaattaaacccaatttctccggaccaattcccattcaaacccgacccctaacccaattaaaaaacccaacccggattcccccacctaccattttgaatccaggccgttgatcactcagatcaactgccaccattcgcccttccataattaaatccaaaagaccccttaccctacctcattcttcaccaaacgctgcccttgaatccttcttctctcaactctctctgcaatccctcatgaaccctagccgccgccatctaatcccaccctaatccacttcaacccctgccgaatcaatagcctctcatggccatttgagatgtgtattagcctcctgtggctcctaggtgtttgtttctgtggtttcatggttagacctcgagtgaatctggtccagtccttgctcaatttctgtttatggcctttctccggccatccatgacctttctccggtcattcatggcctttcaaggtagatccttgactttcctagttagatcggtaactttcaaggtctttctcagcttttctggattttttgaaaccctaatctttaagatctttcagttttcttcagatctaccttagatctgttatgaatttcttaagtgttttctcgaaggttcttcaatttttctttcaaaatgacttttcattttttcgataagggtttctcttaacctctcttttaaagatctcttctctgattttggtgttgtttcatgattttgctatgttacctgtttatgctttccttctacttgagtcagcatgttcaaaaccctagttcttttagtcttatccgagttctgaaattatttgcttaaatgtgtgcttatcttaagttcttcgtttatgactctcttttccttgttagacttgtctgatttgagttcttttcatttgttaaactcgactactgttgaagccctaaatttcttagaagtttttctcacatacttgtttccgatttctcttacctgatactatgttcttcttcactgttgattttatgtgactactagacctacttgactactgtacttcgaatattttttcttactactgaatcctagattatttttgccactactatatgtttgtattatctattttgccaatgtatttggcctcgcatggctgatgcttctattcactctatttatatacttaagtgtagaaccatgtttatcctttgattggtcttgaccttttgactgattgcaaaggcttttcttttatgatttctttccttaaataaacttgctattacacgtcaaatagtgattccttaattaaagggaactacctatgttaattgattctgatctaattgtttccatgtttgtgttaagactttacttattaccttacttttcactcattttcaaaaactataaacactcttcacccaagaacacacacttacactcaaaacattgtctcttttctttactgctacttgtgctacttctttgtctagccgcatgaaagtccaaggctagactgtagaatcttgcttatttctttctttctgcactttgtttctctactggtatgtcctagttaattttcaagcatcaacaacaacatgtttctttagttgtcttagttcctttcactcttgcctacttctgcttatgtttatgcaatcaagttacattactagcatgttgtaatatgctccctccccttttaaattaatgtttcccttatgtatgtactctgtcagtcacttgttatgtgatttgatgacttatgaatcccaaaaccccatatcccctgtatgtgtttgtgttctctggctggtttgtgggtatgccagcattatctattgttgtgcatgaatcaaacctgaccctttctggggtcatatgcttcatacaatgtattcccaaaacccccttgacccctttgtgtaattacttattctgttcagtttgagctttactactactattttcaaatcacccttaccacttgctagttcccaacccagttttaaataaatctctttcaactatgttctgcacttccactataatcttataaccttggttctacccctcttgtttgagccttgacttggaaaccttgagctccctctgaacttggacacataagggctagcccttccacactgcactcatctatgtctggttatgcaacctgagtgtaagcactgcccggggtcccttgagacccttagggaactttgacaaacccaggtctgagaaaagctttgataacattggcttttgaggtagtttattccataactcagagaggaagtcaagaatcaggcttcctatggttgtaactccttgtttttgcacttttctgatgtaactcatgcatttttggtctataataatttgtaacaaatattggagggctggctagtaaaaagggatggggtgattatgcatgatttagctattagaagggtatataacatgcctataggatctgtttaataaattttgcatgttttacttccacacttagacatcatgcctacaaggttaaaataagctttgaaattagatgtcatgcctataaaattaaaatcaatatttttataaaagtcatgactataggaatttcgttgtgatcaaataaatcctgcatgtttcacttcacattcaactagataccatgcctataggacccaaatcagccattaatatttagataccatgctggtaggaattaaaatcagtgataatagagatcatgtctataggatctgagaccagtttagtaaaaaatcagtttgactcatactgttcaaaatcattttgaacaacctattcctttcattaatgcggtttagaaagcatgcctataggatccaaatcgcctgtttaaaaattaaccactgctctattacctttttaatcagtaatagatatcatgcttataggacattaccaatacacacttaggcaagcctcaggtattaatgataaaactgaatccgcctttgtttaattaacaactgctacaactagcaggcaggcatgattggggcttcttatctgagttatgtaataaattggtctacttcaacaattaaaatgccgtgccttagtactttaaattctgactctaactgtgtttaagtcatgctatttatgtgcatttttgcagaggtatatataagcctcttatttgtttatatgtttcctctaatatgcagttctacttgttttgtatatcgccttagcctttttacctttaaaacccaagagtcagcctaaaatcctccctcttataggaatagtagtgctaaattcctccgtgactaataggaatgggatggggaggccgagaccaatccgcactttaataccttaactggatgggaagggtagatgtggatatgatgatcggtgcgctaataccacgtgtatcccctcttccgatgagtgtcatacctggtatcgcattgatgtgatccatataataaataaacctaggaccccccctccttttacattctcaagtatttgtaaaatgtaactccttttcaaaattcaccttttaacagttgtttttcaaactcttatgtgtttaaacttaaatcccctactatttgagcctatatttgtctgtttgctaattgtacaaaattcacaaaactgtctggccaggaaccacactagtggatcctgaggggcgcctaacaccttccccttaagataatttcaagcccttaccctatctatgttatcaaacaaacttagaaataaaccctataggtgtcctaatacaccttaaatcattaggtggcgacccttcaaatgcaaacccagttcccaaaaggaatgagttgtcctaccccaaaaatgtcataaacccgattttccgatgcaaagaggaaaaaagggggcgcaatagcatggcgactctgctggggatttttagggttttaccattttggattgttcttgtgaatttgtacctctttatgtgcaattacttgtttaattactttaagcatttaatatccttttcaactgcaaaactgacatgtcttcctgtttctttcctttattgctgctttaaattatgaaactgttgtatttatcgcttttttaacgtgcaaatatgtgccaacatgttttaattattgcataatcatgctcaacatcatactccactcgtgccaaacaaatactatagcaacgcttataatgagtggttgcgctcttcctatatcattaccccctaaattcgtaaaggcgtatttgcgataaaaccattcgattagcggtgtagtcgacggttccgtgccttcccccttgagttgtccgctcaagggtactagtctaaaaccccatagaaaccattactctattcaaattgtgcatgcatcatggtcaaacctagtcaggccagctatgttatccatataatgatcctttaagatggccttgaccaaagtccactgggtttccctaagcctaaacggacatcgtcacgttctgtgcatttatttggagaactaaatgatgcatgctaattgttggtattaaatagtcaagtctggtgggggtaagggcctaaccttttctgtcttgcagaaatatgaggcatgaagtccctagatttagcatggtcaccatcatccacataagactgctaatctggtggaaagatcatcactctagtgatcaaactctcgtccgaaaatatctaggaaatctaccaccccttttggagatccaacctaacaacaagatcatagaagctgccacactgttttgggattatcaagggctgtattccactttggggacattgaaatgacacccttgctagaggatataggaggattggccggtctagtatgggaaactccgggtctactgatgcttgagaaccgtaaaggcaggggtttcctaaaaatgataggtttgaagaagaatctagaattgacatgtctgaaggaattctacatcccttgtgattatttgttagaaaggtacggtcacagcaaatcctaccatacctaccttgacgagttcgccatcacatccttggggcacattcatcgtagggttttcgtcttcatgttttgtttcctgggtctgatcatgtttccgatgaagaaagcaagaatccatactaggttggctatggtaactaagaccctaatggaaggaattggtgggcagccattcaacatcgtgcccatgatcattgaagacatatatcgagccttggacaactatcaacgaggagcaaaacactttgaagccagaaatttattacttcaactatggctcatggaacatctccaaaggggagaataccaacaagtgattcagcaaagggactgggatgatcacatcgctttccatcatccaaagcgaatgaattacatccccaatatgtttgctcagtcggaggatgccaaaggatgggttgagctatttgatattctgactgaggaatgggtccaatggttgttcgagtagttttcaaccgaggagttgatcgctcgatctagagatgcacctttcctgatactgatcagtctgagcggaacatacccttacgtccctctccgagttatgaggcaagctggtaggaagcaggttataccaagggtcgacaagatgagtcattttcgggatgacttcaagaatgatgatagtccttacaagtgccaagatcagtatatgtggcactacaagatcataatggggagagataccatcgagccagacaggtatcatgctagttgcgctcctttctactctggttggttggaagacaatcatgatggtctgggccagctagggtttgctcaaggtcacaggattatagatgaaagtgctgaggcataggtcaaatacaaccaactaagcaaaaggatccggagtacgaaagcgaacaccgcgagatacaagagtccaaccagaagctgattgaggaatggaaggacatggctgtcagtgccaacaagcgactaggatacttggagcgaggtatagtggagttgagagaaagtttctcaaaagggacgaagattgtcaaaatgcgaaagggaccgaaggcggacacctaaccagagtatacctgttgctgggacttcgcgagttggggaagctgttagacggagccaaggatgctgaatctggggaaggtctttctgggaccaagtagataggagtttatctttttgctttataaatgtaataaggcccatggccattagtgacttttatttcctgtttatttatcaatttgggattcgtctactttttatcaataaaatgaggcatttagcatcctaagttctccaaataaatttgtcgctaggcctacctcgggcacaaagaggtccccaaattaggacgcgctttacattcccgcactatgtgtttaaatattgcaatacttcctatattcttcaataatttgattaccttttgtttttattttttgtttttattattcccctccccaaaggttagttcatgcactctggaaacatcatcctattccacgagatccaggggccctccacccactcctcctcttagttctgtcaaaaacaagaataaaggcaagatggaagatttgaacaacgtcagaaaggagaatccaactgaacgggtagaggccactaatggccatggtacttaggtttatctggagaatgtatcccagcttgaacaaaagttgttgaaattccaagaagagctagatcaggttcggaatctggcaagcctctcattttccctcagcaccccaaatatcaactttcccaatactcaaaaccctacacctcctcaaaacatcccaaagaaacagaatcatcccgctcctcaccatcacactattccaccaaagacccaatgcaacacctaccatacaccaaacaatactccagtactcatcccagaaccccaaaactccacaaatgaccattttcacacccctatctacgtgtagaccatgccgcactccacccaacctatctcaagcacacccgagtctgatgaaaaagacatgctcatcagaaacctagctgaggaacttaagaaattgactagccggattcagggcattaaaggaagtaaaggaattgaggggctaaactatgaagatctttgcatatagcccgatgtcgaactacccaaggggtacaaacatccaaaattcaaaatgtttgatgatacagtggatataaggatccatttgagaacatactgtgacaagatggttagagtagggaaagacaagagaatccgcatgaagttgttcatgagaagtttgaaaggagatgtgttgtcctggtacatcagccaagatccaaagaagtggtcaatctgggtaggcatgacattcgattttatgtacaggtttaggtttaacacaaaaaatgtgcggatgtgttctatattcagaatctaaagaagaagcctacagaaacatttcgcgggtatgctactcgctggaggtctgaagctgctaaggtcaaacctgccttagaagaggaacatatgaacaaattctttgtccggactcaagacccgcagtattatgaatgattgatgatgatcgagagtcacaaattctccgacattatcaaactgggtgaaagaattgaagagggtatcaaaaacgaaatggttacaaacttcaaggccttgcaaacttcaaataaggccttgcagtctggtggtgcatccaagaaaagggacgtagggtccgtgatggttgcacaaaggaaaaaatctcccctcaaataacaaacttacccaacacctccactcatatatcagccaactccaaactaccaagcaccctcaccaccaacttatcaatcacctctacctctcacatatcaacctacttcaaccagatacttcgaacccgctcatgtctaccaaacctacaatgctccaccatcccactatcaatcacctcctacacgccaaaacttccctagacctcgacctaattttgatcgcagtcctccaaaacaatatacagccattgccaaacccattgaccaattgtacgagagattcaaagctgctagttatgtcacctccatctctgctgcaacccctgagaacccttctgagtgggttacccaaacaaatcctgtgcataccactccggcatgaaatggcacaccatcgatgaatgtcgttccctgaaagacaagatccagtctttaattgataacaagattattatggcaaaggaacctgctccaaatgtccacaacaaccctatgccagaccataagggtagaggtatccacatgattgaaatagaggatgattaggatctcgatggatctatcgggttgatcatagaatgtgatgacccaaagaagctaacagtcactctcaatccaatcatagtctagatacaaccgtctgaggatgctgaggtagacttgtctgtaccacttgaatttgaattaacttcatccgcaaagacaccaacactaattgaggttgaattcgtgtctccgtaaaatgcacccacaatatttgaggttacagttttactacccgaggcatatgctccattcggagtgaggttagccgtgccaatcccagtagcaatgccaaccatgacaccattccatacaaaggttgtatcttgggattatacagccgaggcgaggaggaaaggcaaggtcaggttcgaagagaccgttgcagcacagggtatgacaagaactggtagagtctatacccctgaacatctagctgagttaagaaagcaggcctctaataggccgcccaattgagatgggtccagacgatctttggaggaaaatacaggccaaagaatactcggccattgaccagttgaacaaaacaccagcgcaaatatccattcttgctttgctacaaaattctgaggcacacaagaatgctctgctaaaggtgctgagtgaagcatgtaccaagcaacatcactggggggaaatggctaacatggtaggacaagtgttggagagccataagatcacctttcatgaggacgagctgccacctgaagggttggggaacaacaaggcgttgcacatcactgtgcaatgcaaagactattttatcaccagaatcctgatcgatggaggttctagtctcaacatttgtccactggtaatactcaagaagttgggtaagggactacacgagatataagatggagctatcaatgtgaaagccttcgatggttcctagagatccaccatttgtgagattgtcctatgcttgcaaatgggaccaacatggttcgatgttaatttccaggtgatagacgtgccagcatcttacaatctgctattggggcggccatggattgatgttgctggggccgtagcgtcagcattgcatcaggcagtaaaattcgaatggaaacactaggaggtgatcattcacggcgacagtagcaaccctatatacagtctccagaccattccggcaatcgaaggaagaagaaagctaagtggagagacttaccaccacattgaacgggaaaatgttgttgacaaagataaatggtgggataacaaaatcgagagtatactgaattggagtgggtacgaacctggcaagggtctcggcaagaacctccaagaaatcaccaagcccatacaactcaagaagcatggcactaccttcggtttgggatatgactacacttgggaagaattcaacaactggtcgccaccatggcgcagtccttactatccactagagcagccaatactggatctagagaagattttccaacaggctgacattgtttatgggtcagacgaataagaagcactttcagcggtgaagagcttattcctagaagacaatgacatggactattgtgttgttctcaaggaggagggggaggaaggcccttccatacaagctatgagcagagaggcacgcctcaataattggaccattaggacaaccagaacctaacgagcctcggggtggcaaggctaaaacaagcatcattctctgttttatttattaaatgattttcttttcgcatttttcaattcccgcaataaaaccttcaatgttcaaaacaattatgcaatttatcaaagcattttgattttttctcataaatcaacactcattatcattttctcccattactttacttatacaacattactattacttatcttgatgaaccaataactgtgacatgtaatgagacaacgcaacaaatggacaatgattcagaggaagatgacataccagatgagattgtcaaagaaattgagaactttaagaatagacctaagtccaacctggatgagaccgaaattgttaacttgggagatgtagaaaatgtcaaggaaacacgaatcaacgttcacctatcgccattagaaaaggaagaatacacagaatttctaaaggaatacaaggacatattcgtcaggtcgtatgatgacatgactgttctgagtacgtctattatgtctcacaaacttccaaccgatccaacgtgtccaccggtaaagcaaaagctcaaaaagttcatacctgatacgagtccgaaaatcaagaaagaagtcaccaagcaggtcaaagctaaggttctcagggtagtagagtacccgacatggttagccaatatagtaccagtgccaaagaaggatgggaaggtcagagtttgtgtcgactaccgggatctcaactgggcgagtccaaaagacgacttccctttgccaaatatacacatcctgattgacaattgcaccaagcatgagttacagtcatttgtggattacttcgctggttatcatcagatctagatggatgttgtagaaatggacggagaagaagtttggccaaagtcgatcaattcagatgcagtcaagcattactgtgtgtaatcattatgcttccttatatgatgtaaattgaactacacctgacctgtttcctgtttaagaggggatacataggcaaccctatgggttcggtcacaattcaataaaattttcatttcccaccacaattagaagttggggcagaattttaaggaggaccctcaaaattctgaagtaatttcagccgatcaccacatgagcaacagtcagaaacataaacctgttaaactaaggtagaattttgagaaggaccctcaaaattccatagctggagaggttacaatgtcccaagctacgtcgcagtcatcggttcatctaaaaaattatatttatacacttatgtcatatttttacaaaagcatgcatgtttattattgaaattgttttgtttagcagtcgtcggttcatctaaactcacgatttttctttggatgcaggtactagaatcgcaaaatcattaaacatactatatgcctatgagtacgactctccgaaccattgcacttgccaacatttgctatcagtacacaagtaattctccgtagtcacaatgctcccaataatcataatgccacaatctgctatcagctaagaaaactctattgtcattcgttattttattatttcttgcataaagctatcattctaccttctgtgactaaacgttgtctccatctacattcttgcataaggctacctttttgtcttccaatactaagcgttgtctccatctgcatttgcattgcataaggctactattctaccttccaatttgcataaggctatcattctgccttctgagactaaacgctgtctccatctacatttgcattgcataaggctaccattctgcctttcgaggttaagctctacctctctctggatttgcatttttgcataaggctaccattctgccttccaaagctaggttctacctctttctgtatttgcatttttgcataaggctaccgtcctgccttccaagactaaacgatgtctccatctgcattcttacataaggttaacattctgtcttccgaggttaagctctacctctctccgcattcttcatctttgcataaggctatcattataccttctgaggctaagctctgcctccaattttcttcgaaactaagcactatctcaagcatcgtctatttcatttctcttacgggctaagctttgtccttcaattcgcaagactaagctctgtcttgtccgcatcatgctactgcatctcatgggctgaaagattgcctcatactgcatctcatgggctaaaagatcgccaaattatccaaaggcgtaatcgttcagaggcatcatcttcatagcctaagaacaccatgtcatggcctgaggaccccttttaatctgttgcatatcattattcaaaggcaccatggttcggaggcaccatcctcatagcccgagagcatcatttcatggccggcgagtcctttattgtacgcttcatggcccagggaatcatggtctaaggacatcatcctcatcgtccgaagacaacattcatggtccgacgtgaatttgcatcatgtttaaatttatgcgcgatatacgcttgtattgtttctaattgcaggtaaaccggcgagcaacggacatcccggcagaagcggtcccactccagttcccgcagccatataaaaccttaaccattcccacaagccgtccactcaccccatcctggatattgcgtccgttcttgaaaagtctccatcggcatactccaccgacggatcctgaactacatatgacctgattcttgtaaaaccaggggtatgtaggtagatcaaaatccatggtgcgtcctaaatctcttcaaactgtttcgcttggtcaaaattggccatcatatctttacccgacaactctttcatccttcccgggtaaagagggcaactgttgatatccaatttttccctatatattttcaatatgcaaaataacttcaaatttaatatatatgcatatttaagcatatccaagtgttttattattttttcataatttttaaaggtttttaaatcaatttatttccctcttttatccataaaaaaccaataattgtgaccaaaattattatttttgtaattcatttgttggacttttatatttatactacgatatagctaaggtaatttttgcatattttttataaaattatttactatttttaagctaaattgcatataattgcaatattggcccttttaagattcaattatgttttatattcataaaattaagcctgtatttttaaattgttaattatatgttacaaatcattttagtactctcaatttattttcaggaattaatttactattttttataattttaaaagggaaaaattgtctatttaaataatagcccagttacatttcaattttagcctaaatatgaccccaaattaaacccaatttcctcggcccaattcccattaaaacccgatccctaacctaattaaacaacccaacccggattcctcacctacccttttgaatccaggctgttgatcactcaaatcaacggccaccattcacccttccataattaaacccaaaaagccccttaccctacctcattcttcaccaaactccgtccttgaatccctcttctctcaactctctctacaatccctcatgaaccctagccgtcgccatctaatcccacccgaatccacctcaacccctgcctaatccatggcctctcatggacatttgagatgtgtattagccttctgcggctcctgcgtgtttgtttatatggtttcatggccagacctcgagggaatctggtccattccttgctctatttctgtccatggcctttctctggccatccatgacctttctccggccattcatggcctttcaaggcagatccttgacttttagatcggtaactttcaaggtctttctctccttttctgcgttttccaaaaccttaatctataagatctttcatttttcttcagatctattttagatctgtgcttactatgtatttcttaagtgttttctcgaaggttcttcaacttttctttcaaaatgactcttcattttttccgattagggtttctcttaacctctcttttaaagatctcttctctgattttggtgttgtttcatgattttgctatgttacctgtttatgctttccttctacttgagtcagcatgtttaaaaccctagttctttttagtcttatccgagttctgaaattatttgcttaaatgtgtgcttatcttaagttcttcgtttatgactctcttttccttgttcgacttgtttgatttgagttcttttcatctattaaactcgactactgttgaagccctaaatttcttagaagtttttgctcacttacttatttccgatttctcttacctgatactatgttcttcttcactgttgattctatgtgactacttgacctacttgactactgtgctttgaatactttttcttactactgaatcctagcttatttttgccactactgtatgtttgtattatctcttttgccaatgtttttggcctcgcatgtctgatgcttctgttcactctatttatgtactgaaatgcagaaccatgtttctcctttgattgatcttgatcttgtgactgattgcaaaggcttttcttttatgaaccctaatttcactcacctgtttaaaattaattgattcctttccctttactgtgatgttttaccttgctgaatcctttcccaaaataagcctattttatacttagacttgattatttacttcataattttactactcccttatatggcaataatcaatcttttcccaaaactgatttcttaattaaagggaaccacttatgttaattgattctgattgggattgcttccatatttctgttaagactttacttcttaccttacttttcactcgttttcaaaaattataaataccctgcaccctctcttctttcaaagacacgaacaattgagttcaagaacacacacttacactcaaaactttctctcttttctttactgctgcttatgctactgctttgtttagccagctgaaagcccaaggctagactgtggaatcttgcttatttctttctttctgcactctgtttctctactggtatgtccatgctaattttgaagcatcaacaacaacatgtttctttagctatctcagttcctttcactcttgcctacttctgcttatgtttatgcaatcaagttacattactagcatgttgtaatatgctccatccccttttaaattaatgtttcccttatatatgtactctgtcagtcacttgttatgtgatttgctgacttaggaatcccaaacccccatatcccctctatgtgtttgtgttctctggctagtttgtgggcatgccctggcccttccacactgcactcatctttgtctggttatgcaacttgggtgtaagcactacccggggtcccttgagacccttagggaactttgacacaaccagatctaagaaaggctttgagaacattggtttttgaggtagtttattccataactcagagaggaagtcaagaatcaggcttcctatggttgtaactccttgttttcgcacttttctgatgtaactcattcatttttggtctgtaataatttgtaacaaatattgaggggctggctagtgaaaagggatggggtgattatacatgttttagctattagaaggatagatgacatgcctataggatctgtttaataaattctgcatgttttacttccacacttagacatcatgcatataaggttaaaatcagctttgaaattagatgtattgcctataagattaaaatcaatatttttataaaagtcatgcctataggaatttcgctgtgatcaaatcctgcttgtttcacttcacgttcaactagatatcatgcctataggacccaaatcagcatttaatatttagataccatgctggtaggaattaaaatcagcgataatcgagatcatgtctataggatctgagaccagtttagtaaaaaatcagtttgacttgtactgttcagaatcagtttgaacaacctattcctttcattaatgcggtttagaaaggatgcctatagggtccaaatcgtctgtttaaaaattaaccactgctctgctgccttcttaatcagtaatatatatcatgcttataggaaatcaccaatacacacttaggcaagcctcaggtattgatgattaaactgaatccgcctttgtttaattaacaactgctacaactagcaggcaggcatgattggggcttcttatctgagttatgtaataaatttgtctgcttcaacaaaaacaccctgtcttagtactttaaatttagaccctaactgtttttaagtcatgctatttatgtgcattgtctgcggaggtatatatgagcctcttatttatttatatgttttccctaatatgcagttctacgtgttttgtatgtcgccttagactttttacctttaaaactcaagagtcagcctaaaatcctccctcttataggaatagtagtcctaaattcctccgggactgataggaatgggacgggtaataacatacaatagaggtcgagaccaatctgcactttgataccttaacgaggtgggaaggatagatatgaatatgatgaccggtgcactaataccacgtgtattccctctttcgatgagtgtcataccgggtatcgcattgatgtgatccatattataaataaacctaggatcccccacccccctctttttacattctcaagtatttgtaaaatgtaactccttttcaaaatttgccttgttacagttgtttttcaaactcttatgtgtttaaacttaaatcccctactatttgagcctatatttgtctgtttgctaattgtacaaaattcacaaaactgtctggccgggaaccacactagtggatcctgagaggtgcctaacaccttcaccttaggataatttcaagccattacctatctctggtcatcaaacaaacttcaaaatgaaccctataggtgtcctaatgcaccttaaatcattaggtggcgactcttcaaatgcaaatccagttcccaaaaggaatgagttgtcctacctcaaaaatgtcataaccccgatttccgatgcgaagagggaaaaaggaggcgcgacaaatacagctaagataatttttggcccatacaattaacatcggaataaattggaaccgtacatgtaaatttcattaattaatctttgtggttgttctttaatgtaaatttaaatctagcttaatgaatattggtacgtacgtcggaagaaagaaattaaaacatggaaatcaactgtaacaacaggatgtgcaaatatactacaggtggtgcactatttttatattttttgttcttgattgaaaataatacatgttgtttgcaacaaatttatgcagagaaaaacaaaattgcaatcacaaacaactataaagaaaaaaagaattttatttataaacattataggttacaactctgtttatcccttgattcttccctccgatttattctatgtgattcgagggtcttagcagcatatttctcgaaagtagaatgatatgcatctccttgatgtatttgatgatcaagaagaatatagcagcactccgtttggatcttgactgttgctagaaatttcagcaagacatatttggcatgtctttgatctattaatgaatattccaagaattttatggaattttagagatcgtatatttgatctcgtgcatgttttgagagtttatggaactgttgagaccgtctttgaagaacatatgtagccttatttgtaggcatgaattagggtttggatggagtagccaccaagtaccctaatagactcctaataattcaagaatcgtcttgaatttaggatttatcttaatctgttaaaattttagtgtctacaactgccccctacttcaaggtttgtcgaggtgtaggcttgctgaaacttgaagacaagatttgaagtaccgaccatcacaacagataatcttgaaacttgtaattttcgatgttgatacccaattttttcctatatatatttttttaatacataaatatagtttcaaaataacatatatgcatatataagcatgtgataactagggattttgacgcattttatactccttcttgcttatgctttgattataaattcacacaaaatagtccaaaaaggctcataagttgtgcatgattgaaggtttgatcaacaaagtgacaagatgttaaagatcaactcgaaaggagtgaaacttgcacaagtaccaaagacaagacaaactcaggaaaaataggcctagtacagccacactacactttgggcggtccccactagggaaattcagagagctggtatttcaggcattaaggcagtgcggtcgtagaaggttttgtgaggtccgcactaaaggcaatgcggccgcactaccattctgtgtggtctacagagctaaggttcagagagggtgaagttggagctttcaagcctgggcggtccgcggtccagtttgtgcggaccgcactagaagcctctggggccgcagtccattctgtgcggtcagcagagcttgagttcagagagtcaagttttcaagttcaagagcctagtgcagccgcacaccattttgtgcggtccgcactaaccccacaggggcatttttgtccaaatttttcagtttaatataaatagatcctttttccatttttaggggatcagacattttagaatagttattgcactcgtgggaacaaatcttgtagccattttgggcatttatacttactttttatcattgaatctttgtatttagcttagcaattaattaatatgtgtttatcttcatctatttctctatttttctcttcaagtatgagtagctagacccattagctaggtttgtggctcaaccctagtgtgggaaattgatgggtgtttcactttagggctagattgactataggtgtttgttatttgggtcaatttcatggtttatttactgaattagtggttgcaaacactagtttgtgctaagttgacttaggctcttctttagaaagagggcctaagtctccgaaattgatccaacaaggaattgggatggactcaagagaattgatagtctcaattaaagggttaaacctcgagagagtaatacctgacttgaaccctaagttgcttgagcaaatttgcatacctattggtcttgagaaagtcaattaggcaaaatcacttgaaccatcgagaggtgtatagtgggtaaagtagtgcaacggttatatcatactccccaataatatcaatagagccttagtttcaagtacccgtcaattgaccacttaggtggatgccactaccctagagcttttagaatatttgaacaacccatagcatttaactcttagcttaatttgcagtttgtagtttgttaaaagtagaattataaaagaaaaccgtaaaaattatgagaagtgcaatttggaacgctacgcaatcctaggctaaatagatactcaattccaattctagctctctgtggatatcgatcccgacccaaaattgggtaaaagctgctctgaccctctctcgctacataattagtagtgcggagtaggtcgcgatcactttttggcgccgttgccagggagctaacggttttggctatctattcagttagtgttgtgtattgttcttctttccttctttgttacttacttgtttgtgttgcgactcaggtaccaatatggcattgaacaacactaatgaccctcttggaaacgtgattgcgggggaggaggtagatgatgttgaacaagatgaggtgcctcttgtacctcaaggacaatgtagaggccgaaatgccaatgctaatccaaatggcaatattccagaccctccttctccacctccaagagtggctcccagagtattaccgaaccaaggctatgcaagtgctattgtcccaccccgaatctgtgagggcaattttcagataaccaatatgatgttgaccttacttgagcagcgtggatacttcacgggcgctgcggatcaaaatgactacaaacatctcaaggggttcgtggatacatgctgggggagcaagcaaacgaatgtgtccgaagatgtgcttagattgagacttttcccattttcacttgtggggaaggcattagattggctcgagagactccccaaccattccatcacaacttgggatgagttggcagataaattcatttctaaattcttttcacccaggcatatggcggcacttcgagatgagatattggctttcaagcaagagaccacggaacctttgcatgagatttgggagcggtgtagaacgatggtgaaggagtgatatgaccgaagctatgatccaacaaaccttctactagggcatcaatacaacaaatcaatgcatagtgaaccaacttttcgggggcaactttgtgaagctatcatatgatgaggcatgtgatgtacttgatgagatggctgacacttcttctgcatggcaaagtagagccaatgtgcctcaaggtgaccccacggttattcatttgcataagaaattacatgaccatggacaagctatagcggagttgacgactaccatgaaccaattggctaaggatcagttgcaacaagtccagaatccttgccaggtgaatgccatggagggtgtcaatatgcttgttaccaagagaagacaaaaaaggcaataaaatcaagggaattctgagcaatttgttgatgactataatgggtgtcaaaattatggttatgatgaccaaagtgaagaggttcaatatgtaaacaactatcaaggtcaacgaggcaactcttcaaactaacaacaatggatacctcaaggaaattggggcaatcaacagtaaaatagtggtaattgggggaacaataatcaaaacgacaattgggggaatcagaacaacaatcaaggcaaccaagggaattggaatggtaataataacaatgggggcaataataacaatcaaggtagatggaataatgggaaccaaggaaaccgggggcaaggatttcaaaggcccccaatgtacgaacaaccaaacaatccaccccctttcctctctcaaggtcctagttcttctagcaatgatttaggtagaattgaaatgatgttcgaacaaatgatgaagaagaatgtggattctgatgcacaattggcatcccacaatacctctatccgaaacttggaggtgcaattgggacaaatctctcagtctttgaatacccgcctgaagggtgctctaccaagtgatacggtagtaaacccgaagagtggaaacaatcatgtgatggcggttacaacaagaagtgggagaggtggtgatgtgaatgcctctaagcaaaagcaagttttggatgatgatgttgagttgcacgaagaggaaatccctttggtagttgaagatgtggttgataaaaatgtgaacaatgaagtgaggattgatgttaacgatgtcgaggtggaaactcaaaatgatgtgaacccgtctaggaaacacataattgacatgccggagttagttgtgccaaaagccaaggttcctttgcctaggccacctccaccttatcctcaaaggcttgcgaagcagaaaaatgataatcagtttaaaaagttcattgacatgatgaagatcctgtccattaatgcgcctttggtggaggctcttgaacaaatcccgggctatgcaaaattcatgaaagacttggtcacaaagaagcgttctatggattgtgaaactataaagatgactcaccaagttagtgctatagtgcattcaatggcctcgaaacttgaagatctcggtgctttcaccattccttgcaccattgggagtgcggactttgccaaggctctatatgatttgggagctagtatcaatttgatgccctactcggttttcaaaactttgggtatcgggcaagctaggccaacctcaatgagacttcaaatggcggttcgatcgatgaagcgacctttgggcattattaatgacgtgcttgtccgggtggacaaattcatattgccgtccgactttgtgattttggattgtaaggtggactatgaggttcctattatcttgggaaggcctttcttacaacggggaaggcattggttgatgttgaagtgggtgagctcactttctaagtgggagatgaaaaagtcgtctttcatgtttggaaatcaatgaagaaacccaatagcaccgaggtgtgctcatttgtagaccttgtcacagctgtgattgtggatgacaccagtgctatgatcaacgtggaggatccccttgaggccatgctattaaatcttgatgtcaatgataatgcaagcagagtggagtgcgtgaatgccttacatgggataggctcttattcttatgagcctaggaaattatctttggatcttgaaaaccgaaaaactccaccaacaaaaccatcaattgaggagtcaccggtgttggagttgaaaccactacctccacatctcaggtatgagtttttgggctcaaattctactttaccagttattctttcttcttgtctaactaacatgcaggttgaggccactttggcggtgcttcaaaggcaaaaaagggcaattggatggactttggctgacattcggggaataagccccgcattatgtatgcacaaaattatcttggaggatgatgcaaagcgttccttggagcatcaaaaaagattgaatggggaaatgcaataagtggtgaagaaagaagtgatcaagtggttagatactggtgttgtgtaccccatttccgatagctcatggacttctccggtgcaatgtgtaccgaaaaagggtggtatgactgtggtaacaaatgacaacaatgaacttattcccactcggacagttaccggatggagggtatgtatggagtaccagaagctaaacaaggtgacccaaaagtatcatttcctattgccattccttgaccaaatgtttgatcgtcttgcggggagagcttttattaccttttggatggatactcggggtataatcaaattttaattgccccggaggactaggagaagaccatttttacctatccgtatggaaccttcgctttctctcggatgtcgttcgggttgtgtaatgctctgatgaccttccaacgatgcatgatggctattttcactgacatggtggaagatatcttggaggtcttcatggatgatttcagtgtggttggtaatttctttgaatagtatttgaaaaaattagatagagtattaacccgatgtgaagacaccaatctcgtgcttgattgggaaaaatgccacttcatggtagaggagggcatagtgctgggccataaaatttcaaagcgtgggattgaagttaacaaagccaagatagaggttatttcaaggcttcctccccccacttctgtcaaaggggtgaggagtttatttgggcacgcggggttttatcggaggtttataaaagatttttcgaatgtggtaaaccccttgtgcaagctactagaaaaggatgctaagtttgtgttcaatgagggatgtatgcaagcattcgagcttctcaagcttatgttgaccactactcctatcattaccgcaccaaattggagcttgcctttcgagctcatgtgtgacacaatcgacattgtagttggggctgttttgggtcaaaaggttaataaaatatttcatctggtgttctacgcaagcaagaccatgaatgaggctcaaaagaactacacagttatcaagaagagttgttggctatagtgtttgcaatggaaaagtttcggccgtatcttatgggtgccaaagtcatagtgcacaccgatcatgacgctcttaggtacttgacgacgaagaaagactccaagtcaagattaatgcgacgggtgctactacttacagagtttgatctagaaattgtggatcggaaaggtagtgagaaccaagtggcagaccacttgtcccatttggaggaggaggtgaggccttgtgatggccttgagatcaatcattcatttcccaacgaacaactccttgcgatgtcaatgaatgatatgtcatggtttgccgatattgctaattaccttgtgaccggaataattctgtgtgagctctcttctaaccaaaggaagaagctcaatagggatagtttggatttttattgggatgagccatactttttcaagatttgcacggatggtgtgatccaaaggtgtgtcccggaggaagagcaattgagtaacttggaggcttgtcattcttcaccctatggtggccatcatggtggggtgaggaccgcctctaaagttcttagttgaggattctattggccaaccttattcaaagatgcaggtgattttgtgaaaagatgcgacgagtgccaaagagcggctggaatttcgaagaaagatgagatgactctcaataccatcctagaggttgatattttttatgtatggggcattgatttcatgggcccatttgttagctcttgtgggaacacttacattcttgtggtggtggactatgtttcaaagtgggttaaagtcgtggctttacccaacaatgaggcccagagtgttgtttcatttctcaagaaaagcatttttacgaggtttggtactcctcgtgcaatcataagtgatgggggtctcatttttgcaatagagctttcaacacgttgctttctaagtacggtgtcaatcaaaagtttctaccctatcatcctcaagcaagtggtcaagtggaagtctccaacagggaaatcaaaagtatattgtcaaagatggtcaatgctaataggaccgattggtcgaagaagttggatgacgctctatgggcttatatgacagctttcaagactctgattggtacatctccgtatcggttggtgtttgggaaagttgccatcttccgattgagttagagcacaagaccatatgggctttgaggaagttgaatcttgaatgggatattgcagccaatcttcctgtagagcagctcaatgaacttgatgaatttagattccatgcctactccatttcatccttgtataaggacaagatgaagtaccttcatgataaatatgcttgtggaaaggagttcaaagtagataatttggttctcttgttcaactctcggttacgtctgttttcgggaaaacttaaatcaaaatggggtgggccgtttgaagttgtgtttgtgacctcttttggtgctcttgatttgaaaaataaaaatagtgaagttttcagagttaacgggcatcgggtaaagcattatattgggaaaattgatgacagccacgtggtggcacttcttcatttcaaatgatgtgatggtaacctgcgtcgtgccgcgacgttaaatcaggcgcttcttaggaggcaacccaagtgcttttcttcttgctttctttgattttctttgaagtataggattgatttttgggctaactggttatgagatgttacagggttgtgttaatgcagtgcaagacatagtgaaaaaaatgcacaggtctctgaagtttccagtgcggccgcagtacattttgtgcggaccgcactggtgtgggtaaaatgaagcctctataaagtttgccaccgcggccgcactacattttgtgcggtctgcggtggacctctgcagccgcagtccattttgtgcggaccgcagagtgttgccttatcaaacttgaacaaaacagttcagtacggactgcggtccattttgtgcagtctacactagtaggtgagactgggccccagtggcttctctataaatagaccttgagggtctcttgttacccttttcaaaattttaactctcaaagcatactaatattgttcatcccttgcatttgatcgtaattacttgcttggcattgattcgtttcacttcatctcataatctggtaacaaaatcttccctttccttgtttaattttgcaatttcatttaatttttatttttcttagcttctgttcttctccctcccgtatttatttcaattgcctagactagagtagttaaattttgaattcatgaggactttgttagtttaatggactgggaaatgacttgggggcactcattaggtgaaaatttggacttaaaagcaaaaatccaacgaaccctaactcaatgccaaacctgggcactcagtgcggaccgtggtcgttttgtgcggtctgcgattccctagtgcgttccgcggtaccattttgtgcggaccacactaaagaacttctgggaagctgaacattgggcagtgcggccgcactacattttgtgcggtccgcactagcccctgtgtggccacactacattttgtgtagtctgtactgtcaagatacagagggtgggtattctgaaccccacccatgtgcggatcgcatggccattttgtgcggtccacactggcccttgtgcggcagcactccattttgtgcggtccgcactaggtattttctacaactttctgctttcttgttgaaacactgctttcaactaatgaaattgattctaacaagttcaactgaattgtgtatgcagacaatggtgaaacaacaagggaaaggctctaaacaaccaggccgaggagaatcctccctgggagggaaacagaaaatggtcaaactcactccccaagctaggcaaaacatcaagaacataaggaaggccataaaagtggctgacaaagacattgacatttcggggagtgagtacgagccatctcgggatatctctttggactcaatcccagaatacatctcgtatccgtagagggccagacatagagacactcttcccctttccccgcagcccaagcatcagtgaacatttcttctaggtcgtctgagggctcaccagcgggtagtagggatgaatactctaccactcccacagcttcattatctgaagagggtgttgtaggagatgaggaagaagtaggtggtgacgatgaagtagaagaaggaggtgaaccacaagtgtgggggggggggggattgtgagaactagaaagccgaggtttggcaagataggtttgttagtgaagtggcataccataaattctaggagtggtggccggtgagaaagttgatcccggagcggagtttcattgatagtgacttgctacctcacaaccccaacatgaggagacagtttaggatgagagttggctgggaccatttccttgataagtgtgaggattccaacgaacacttggtcaaagaattttacagcaatgtagcccacatcaaaaagggctccaaagtgaccaaggttcaaaattggaaggtgttgtttgatgggaagtatataaatgaatacctgagcttcaatgagaggacgagaccttatacatggcaaatttggaaatgggagaggaggtttgtccatggctagcacagtacttggcaatcccacgtaccgtccctgactggttggctgctggaatcaaaatattgagaaagagcctgaactttgaagcgaggggatgagagacttttgtttgcagccggttggaccctaccactcatgacaacgcctttcctctccatcgggctgtattggtcacttctattatggtggggtaccccatcaatatggggaatgtgatgtcgaggattattactattgtgggtgccgagcatgatagaaacaatccattccccagcttcctgactgagtacttccgggacctgaaagtggatgagaggccctatgacatcaaggtcaaggagatagccccattttcctggtatagcatgaagggggataacaaccccaagagcaagaactacaaagctcatgcttctgccccaattgtccagtctaaagatccagttatggtagaggtccctgctgagcctacctctactcctgctgacatctctcccggaccttccacatccacagctattcctgctggtctatccacatcagcgggcccggagatcccatcttactgggcccatcatattactacccaccgtctaagccaggcacttctaaatttcaacaactggatgaagactgcctcatctaagttgtccatctagactaccacggtagaggctcagtcggcacctccagccctacaggtttcctagttgatagaggatgctttgaaagagattttagacaatcagaagaagatccttgacactcaggttgtgctctcaaaggtatatgattcacatagcaaggctctcaaggagcttgcttgggagcaaagaagctgcggaagacacgagcttccaaggagtccgtgaaagcattgagggttgatgttgaccgattgaaggaagatcagctgcctttggacttattgctcgatgcagtcatccagttggcagacccacaggagacctcttccaatcagccacaggatgtactaggtccagagcctgtctaggtcccagtagtagagcagcaagccactgggaaccagtctgagggtcccgagcacacagaggaaccagggaccactcataatcctatgcagacaagcagggcttagggaggcttctacatcctttttccttttttcctcttatctttttgatgttttatttagactagttggcattggggacaatgccagctttcatttgagggcttaggccctacattttacattttggatgattgtacatatatatttgatacatttttatgctttcttgatttttcatctttggtctgtatataattctgatatttcgttacatttatcacacttttattttactttagttctgtatataaagttacgtttcattgtacatattcatcccatctaatgtatatttaaatcccctcttgtatatattcattctattttccgcaaatttttcattcttagcttcttatttatgttcgtagctttttgttttgttttggacatttccaataagcctttggttttcttaataccacggttctttccaaaggtggagtgttgtatgaaccgggtggcacttcccagtgatggatggcatgacaaccttcttaagggtttgagtctgtttttctttctggttttagtagtgagtagttaagggtgcctcaagcaaagcttcacttgggcctagcacattttcccttgatcttatggtcaaaaacaaattgttgtgtttaggatggtgaaaggtgtgaccttgagactcttgcgttgaccgataattatcaagtggttttcgggatcattgtttgctcaaatcgtatctaaggtcattgtaggcccctaactctatgtctttaatgttcccttagcttgtgtggtgagtaaatgaattgcatatccaagtaccgagccattggtctagaactttccctaaatgtttttgaggcaaaatcctaagtgcattttgacttgagacatgattatagactctccttgatccaaatgatatctcgaacaattccatagcctaccaatgataagatccctagtcaacccttttgagtcttagacttttttctttcaagaaccatgatacaagcctatacccgttctaaaaagataccctctcttggcacccaacctttcctttagcacatggaaaaagtataaatttggggggagagacaaggatggcaacaaagtggtaaaaagtcacaaagaaaatgaagaaaaggaaaggcaatgaaaaataaagaaaagcaaaaagacaaaaagaatgttcaatctgaaaaagaataaaaagggattcaagaaaagcaaagaatgaaaggtgtggaaagctaaaaaaggagaaaaggtctgaaagacataagaaagagtgacagtgtgtctctctaaccccttagaaagaagtgaaatgactcaaagagtcaagtaaattacgccaaatgaatcaaaagaagtgcttaagggaagatggaacctacttcgaccaaaacatgtcctaccctgaaccaaaagccttcataatgtctccaaaaaagccttatatgatgttgagttgaataaagcttacattagtggatactcacataaggggaaagcatatggtatttagagccgaacttgtgactttttcttgagagagaagattgaatttccattaacctcgttttgcatgccactattctaaaggtaagtttggcttagggagagttgaggatgtgtgagtttgggttccacaatgaccaaggtaagtgaaaagtgttctttgatgtgttgagtcaactcttgatgctcttgtgtcacacttgatccatggtttttcaaaggttaaagttgtttatgacttatgtgtgttgaagacaattgttagtcccaattgatgttaattgaggttgctttaggacagctgaaaatttcttgaattttcccttaaggggtgggtcttatgttatttgcttgaggataagcaaaagcttaagtttgggggagttgataactagggattttgacgcattttatactccttcttgcttacgctttgattataaattcacacaaaatagtccaaaaaggctcataagttgtgcttgattgcaggtttgatcaacaaagtgacaagatgtcaaatatcggctcgaaaggagtgaaacttgcacaagtaccaaagacaagacaaactcaggaaaaacaggcctagtgtggccgcactacactttgtgcggtctgcactagggagattcagagagctggtatttcaggcattaaggcagtgcggccgcagaaggttttgtgcagtccgcactaccattctgtgcggtccgtagagccaagattcagagagggtaaagttgcagctttcaaacctgtgcggtttgcagtccaatttgtgtggaacgcactagaagcctccgcggccgatgtccattttgtgcgatccgcagagcctgagttcagagagtcaagttttcaagttcaagagcttaatgaggctgcacaccattttgtgcggtccgcactaaccccgcagggcatttttgtccaaattttttagcttagtataaatagatcctttttccatttataggggatcatgcattttagaatagttgttgcgctcatgggaacgtatcttgtagccattttgggcatttttacttactttttatcattgaatctttttatttagcttagcaattaattaatatgtgctcatcttcatctatttctctgtttttctcttcaagtatgagtggctagacccattagctagggttgtggctcaaccctagtgtgggcaattgatgagtgttgcaatttacggctatattgagtatggatgtttgttatttggatcaatttcatggtttaattactgaattagtggttgcaaacactagtttgtgctaatttgacttgggctcttcttgaaaaagagtgcctaagtctccgaaattgatccaacaaggaattgggatggactcaagagaattgatagtcccaattaaagggttaaacttcgagagagtaatacccgacttgaaccctaagttgcttgagcaaatttgcatacccattggtattgagaaagccaattgggcaaaatcacttgagccaccgagaggtgtagagtgggtaaagcagtgcaactcttatatcatactccccaataatgtcaatagagccttagtttcaagtacccgtcaattgaccacctaggtggatgccactaccctaaagcttttagaatatttgaacaacccatagcatttaactcttagcttaagttacaatttgtagtttgttaaaagtagaattataaaagaaaaccctaaaaattatgagaagtgcaatttggaacgctaagcaatcataggctaaatagacactcaattccaattctagctctctgtggatatcgatcttgaccctctctcgctaaataattagtagtgcggagtaggccacgatcagcatgcataagcatttttataatttttctataatttttaaaggcttcaaattgatttatttcctccctttctactcataaaatctccaataatcatccttcaaattatttttatggtgatttagccatctaaattctatatttatgccaaaatattattagaatatttttagccttattaaagcataattatgtttttaatacataaaatggtcttttatattttaaatcattttaatacacgaaattatttttttagaaatcatttattatttattataaattatgtagtgttaaaatggctatttaaaatctagcctaattgcatttcaattttagccaaattccaacccctccctaatcccaattcagcccaaaccggaccccaaattacccagcccaatttttgattaaaatacccgaccaataccggccaaatcctggtcattgatcgttttgatcaacggtccagattttcctttcctaataaaatcgatcaatacccccccccccaaacctaattcattttacaacccaccccgccgcactaaaatcctctatgctctcaaaacactctcaacctaaaccctaatctccaaatgccgaccctccatctatggccatctccggcaacctctcatcttctctcatgtcattcttgccatccctaaggccctcaagggaccagagccatgtcgacttgcatctagggttcatctcttgcctgatcttggccattccgatgtgatttcgagtgaaatcgttctatgttagccacgatctaagggttttcagtatgtttcttcacctctgtatggttttctacaaaaccctaactttgtctctaaacctcctagatctgcagatctaggacgatttgagtctgtttcttgtgtgttttacaatatccttgagattatctaccagaatcatttgacttcaagtgatttcttcaccttttctaaaattagggttttcgaaacttcttttaaaactttgtttgatgattctttgtgtttaaacttctgattctcacacatttttgactaattttataaacttgttgtaaccctatcccgtttgtactaaaaaccctaatgttggtggtttttcattttgtttctgatatgggtacttctgactatgttcttgccttagtttcttgtgacttttcatgatttgcttgtcctagtatgattctattgaatcttctttgttcaaactttcactgatattatgaacttgtgtgtgtactagccattcatgcaaaatttgtatgcttctctttgaatcagtgtcgtttaaccatgggttttgtcgaggctgtgtgaaatcctgactgttcatgccttacctcattttatatgctaagcatactgcttctttcacgattttctgaacctttgattactctgaatcccttattttctggtttaatttgattactttccttcaaacgtgtgattcttgcttatttactcaatttgattgatttgcttgccttaattaattttcccttaccttgtctgcattattacttgattcttactgattatttccctaattagaactttatgtacctagccgttaattacctattctatacctaaggctttactttattctttttcttaaatacctggcatgtttaccgttgattgaactgtccctcgattaagggaagatcttgctgatttatgggtaacttccctgattttctactcaattgatctcttgcctcattttgttaagttttcgactcctatataaaccttctcttcttttaagttcataacaatgataacaaggcactctagttcatctacactattacactattataacaacgataacaaggaactctagttcttttatgtaatttgttcagcttgtctgtaataattatttgtaaacaacattggggtgattactgaaaaggggtgggtagttacatatttatggggtgattcgtgtagataccatatttataggattatattaatatacttgctatgtttgctttaccacactagaaaccatgcctatagggttgaaaaggttcccatattagaactcatgtctatagggtttaaatggattcaataatagaatccatgtctataggtttaaaatcaacttcataatcagataccatgcctatatagtgtaaagtgattgagttcaattcctggtactgcatgtgcttatatttgtctcactaaaatcatgcctataagttccaacatcagctcttaacaattagatacgatgcctattggaaataaatcagaaattctgcctatagaattaaaatcaatttagttacacaagtcagtctaattcatgttagttcactttaaaattgttttaatcaactatccacttctttaattgagtttttaaaacacttccttcactcactactgctagaaagcatgcctataggatatcaagtgtccttttaaaactgttcactgatttactacatcaacgtagttatcatgctcttaggacatcactgttctgcgtttaggcaagcctatagggcgttttaaattctgcaactctaaaactatttttttgctacttaaagctattcagatttaacaggttcaaatcagtaggcaagttaaatagggtctttcacatattgtcctaattcaacgctatataacccctgcttacctagatatcatgttctagggttttctcttatgtatttgaatgttgtttgaagacgtgcacttatttatcctttaaaaccttaggaaagtctagaattgtccaaagaatagaggtcctaaaatacctccagggctacgaagaaggaatgggtagtgcacggataggacattgtcaaagttgctagaacgctttaggctatgaccaaggggagggacttgggtagaaagggatatgatgactacacgctaatgtcacgtgtagctcctcattgaggagtatttatcggacattgtgtgggttgatcttgtaggctaaccaacctaggacccctccttcccaaattccctttactttccatatgtatacaatttgtttaagcctttcctttgtttcattatttgagtcatgtaatgtccaaaaacatgctcttatttgtaattatgtgtttaaaactatttatttgttaatggactagttcgtaaatataagttcggctgggacccatcgttgtggaccaagaggggtgtctaacaccttcccctctaggttatctcaagcccttaccctaaatctctggtaatgcaaaccaatccaagagttaatcactctgggtgacttaacgcaccgtaatcctttaggtggcgactcttcagtacccaaattcccaaaaggaaataagtcattaccttcatgaacgtcggaacctggacttttccagcgaagggaaaaaaaggagcgcgacagcatggcgactctgctgggaatatcttagactcttaccataacgaacctatttttatgaattagtccaagcatgctctatcctaagccttttccccttatttaaatttaattgcctattttaagcatttatgtttctttattcctaaaactgacttgtctttttgttttcttttttctgtaactgtcttttcaattatttaaatattgtatttatttttcctacgttcaaatacatgactttatgctattaattggtgaataaattatgctccacatcatattccactcgtacgtatcaaatcctatagtgacgcttaatgagtggttgcgctcttcctatttattacccttgaatacggaaaggcttatttgtgataaaaccaatcgatcagcggtgcagtcgacggtttcgcgtgtttccccctcaagttgtccgtttgagggtacaagtataaaaccccatagttaccttactctgatcaaaattgtgcatgcattatggtcaaaccaagtcggagcaattatgttatccacataatgatcctttaagaagagacttatccaaagtccaccggaggttccataatcccaacggacacaaccacgatctgtgcattaatttggcaaactaaataccaatatgctaatcatgaatgtataaatagtcgagtctggtgggggataaaggcctaacccttttgttttgcagaaaatgaggtacggggtccccagattgggtatggttagcaacattccaccattgctgctagattggtagaggacctttcctcaagtgacaagaaacatgtaaggaagtacctgggtaacttgccttccctgctagacattgagccaaacaacaagttgatcgaggctactactttgctctgggacagtgagaggtctgtgttcagttttcgcaacgtagaaatgataccacttctagaagaaattggagggcttgcgggttgacttgggatagtcccgggttattggtaccggagaaccataccggtaaaaggttcttaaaaatgatggggttaaagaataatgctaacctggtatgcctgaaagaatattacataccctttgtatgagaggtatggccatagcaagtcctaccgtacctaccatgatgagttctctctcacttatctgggccacatccaccgcagagtgttcgtgttcatcgtatgcttcttgggcctgatagtgttcccaatgaaaagggaaagaatccacactaggttggccatggttgccaagattttgagggaagggatcaatagatagacatacactaaagtccccatgatcatagctgacatctacagggctctggagtgctgccaaaaggggccaaacatttcgagggttttaacttgttgctgcaattgtggttgttagaacattttcaaaagggtcactactgccaagaattttcgcgaagggcttggaacgaccatattgcctttcatcaccccaagcggatgacttacattccagacagatttgctcagccaaaaagtgccaaataatgggtagagttcttcgacaatctgactgatgaatatgtgcaatggatgttagaatagttcccaacagacgaattcatcatcagatccagaaacgctccacacttggtgctgatcgggttgagagggatatacccttatatccctatccgaggtataagacaagcaggcaggaaacaggttgtaccaagggttgccaatatgagtcatttcagggcagactttcaaaacaacgatgtcccttataagtgccaagctcagcacgtgtggcattgtaaaatcattgtggaaaagaacacattgagccagacaggtatcatgtggggtgtgagcctctctacccgacatggttggaggacaatctgaaggggatggtgatgctaggaactggtcgagggaataggatcataaacgaagaagctgaggctcaagtcaaatacaacaggctgcgcaagagggtccacgactctgagaatgagcactgggaaatacatgagagaaatgtacgatgattgaagaatggaaagagatggcagccacttccaacaggaaactggatgtggagcgaggaatagtagagctgaaaggcaaagtgataaagagaatcgaggattgtcagaacgctgaaggagaacatctggacagagcctacttgctgctgggtctgcgcgagctgggggatatatatgatggagtcaggaagattgaatctggggaaggtccttctatgaccaaataggctagatttatctattttcctaaaatgtaataaggccaagtgccaatagtgacttattttttattatcttagtgtcgatttgggattcatctattattatattattaaatgaagcatttattggcatttaaagttctccaaatttatttatcactaggcctacctcgggcacaatgaggtttccaaagtaggacacgaatttacatttccacaatatgtgtttaaatactacaaacatttcagaatcctcactaacttgttacctttttgtttttgcatattttttttaattattcccatctccttaggttggttcactcatactggcctcatcagcatatcatactagatctagaggccctccacctcctcctcctccaagcaatacaaagggtagagggaaagcaaaaatggacgacttaagtggtatccgaaaggagaatgttgagaacgcagaaacctcagatggccgtagtactccagccccaaattatctagtcctgagattggaataaaagatattggaattgcaaggagaacttgagtaggttcacaacttggcaaacttgtcactcaccttgaatgtccccgacatcaaccaacagaacacaaagaacccaatacctccccaaaacacacaaaaccaacatccacaaaatcctcccgcaccaaatcaatatgcaactccaccccaaaatctcaatccattgccaatattgactccgccacaacatcaccatcagccaactcagtacccaccaaccaccacttaccacactccccaaaacacaccacaacccattccccatccccaaaactccaccaacgaccatcactacgcctaagttcctggcacccatcaaagcaaccctatatacgtagaaattgtacctcactccatccaacccatgtcttatacaccagaatcctccgaaaaggacctgctcattaaaaacatggctgaagaactcaagaagttgacaagctgagttcaaggtgtcgaaggcggcaaaggaatagaaggtttgaattatgaagacctatgcatacaaccgaatgtagaactgccagagggatacaaacctcccaagtttgagatgtttgacgatacaggtgatcccatagttcatctgaggacttattgcgacaaacttgtcggggtggggaaagacaaaaagatccgaatgaatctctttatgaggagtcttactggggattgtttgtcctggtacattagccaagatcccaagaaatgatccagttgggtaagtatggcgtcagatttcatggatcggtttaggttcaatacagataatgcaccagatgttttctacatccagaatcttaagaagaaacctactgagactttccgtgagtatgctactcgttagagttccagctttggacgaggaacagatgaacaaattcttcattagagcataggatccgcaatattatgaaagattgatggttatcaaaaatcataaattctctgatatcatcaaactcggagaaagaatcgaagaaggaatcaagagtgggatggtaatgaattttgaggtgctacaggccctcaaagaaggcattacaatcaggcagcatatcaaagaagagaaatgttggggcagtaatggtggcccaaggcccgaaatctccacttacatattaaacacctctacccacgtaccaagcaccgccacccacatgtcaacccttatctcccaaatattcctaatcggccactttccaccatacttataactcccaaccatcccatttataatcacctccaactcgccaaaacttttcgagaccaagacctaatttcgatcgcaagccacccatacattacaccgccattgttgagcctatcgacctgttgtatgaaaggttgcaagctgtgggttatgccacttctgttcccactgtggcattagaaaacccatcccaatgggtcaatctgaacaaaacttgttcgtaccattctggtatgaagggacacaccactgctgggtgccgaacattgaaggataagatccagacactgattggcaacaaggtcatacacgcaaaggaagacacacctaatgtccgcgacaaccccctccctgatcatagatgcggtgaagtacatgtgataaagacgaatgaagaatgggaccctgagggatcgattgggtttattcgagaaggctatgactttaaagttgcagtcacacttactcctattgtggtacagactcagtcaccaatcaaggttgagataaatgcatcagttccatttgaggtagaggtggctttacatgtggccacccctgctccctttgaggtagaagtggtcccaccttttactatgacagtatcaaccacacctccattaaaatcaaaagcaataccctgggattatgttgtcgaggctcagcaaaaagggaacgccaacgtagaagaatctgatgatgcacaagggaagactaggactggaaggggctatatgcctgaacatttgggaggttcaagtaaggataccaatactaggtagcctatcattgagatcgggccgaatgacctgtggaggaaagtacaagcaaagaagtattccatcgtcgaccatctgaacaaaaccccagctcagatatctatcctgtcactatcataaaattcagaggcacgtaagaacactttaatgaaagtgctgagtgaggcttatgtacccaataacatcactggcggagaaatggccaacatggtggggcaagtattggaaagttataagattatcttccacgaagatgagctaccacctgaggggctaaatcacaatcggcattgcacattacagtgtaattgaagacaaattcattgacagggtcttggttgacggaggttcaagcctaaatatttgtccattggacactctgaaaaggttggacaaaggtttccatgaaatacgggtaggaagcatgaacgtgaaagctttcgatgggtccaaagggccacgatcggggaaatcaacctttgcttgcagatggggccaacttggttcgacgtcgagtttcaggtgcttgacataccagcctcatataatcttctgtggccgaccatggatccatgcctctgtgccgtgccttccaactacatcaagcttgaaattaatggaatcgtcaggaggtgatcattcacgggacgggagtcccatttacactagtcaaaccatcccggctattggacatagaagaaggctagaggggaaactatcatcacattgaacgggtcaatgccatcgagaaggataaatggtggagcagtaaaatagaaagcatattggcctggtctggatatgaacccggcaaaggattgggaaagaacctccaaggtatcaccaaaccaataagctgaaaaatcatggtaccacctttgggctggatacagtacacatggcaagagataaattggtcgcctatggctggaccgtactaccctctcgagcaacagtgcaccatttggaacaagcttttcaccaagctgatacgatatgggggactcagaagaggaagcactgctgggttgaagaatttgttcttggaggatgaggacatggactgcagtgccataattgaggaggaggaggaggaagaaggcctccattcaacgtaaagaagggagcgtctcaggaactggagccacaccatccgagcccgcgagtccctgggtagcttggcaaattttacttctatagccattctaggcatttaagatttccgtaattttttttaagatttacttgtttcaaaataaatgctgattcatcgagccgtacttgtcgatgatttttcattttaatcaaatgctttgctctttattattcattactatttttacttttctttctacagcttattattacttttcctgatgaaccagtgactgtgacatgtaatgaggcaagcaacatgaggatagtgattcagagaagagatgagatacccgaggaaatttcagggaggttgaaaattttgagaataagcctaagtccaatctggacgaaccaagcagtaaatttgggagacgccgagaccgtcaaggagactcgcatcagcattcacttgtcaacagagaaggaagagtacattgcttcctaaaagagtatgaggatattttgcatggtcatatgatgacatgacggtttgagcacgtccatagtggctcacgatgcctactaatccatgtgtccgccagtaaagcagaaactcagaaagttcaaaccagacatgagcctgaaaatcaaaggaagttaccaagaatcaaagccaaagttctcagggtggttgagtacccaacctggttagctaacattgtgccattccgaagaaggatgggaaggtcagagtatgtgttgactatcgggatttaaacaagagcaagtccaaggatgacttcccactaccaaaatacacatcctgatcgataattgtgccaagcatgaactccaatcctttgttattgttcgggctatcaccagatctggatgacaaagaagatgcagagaagacaacttttattatgccttgggtgtatactgttacaagatgatgccattcggtctgaaaatttggggctacttacatgagagccatgacaaccatcttccatgatatatacacaaggaaatagaggtgtatgtggatgatgtcattatcaaatccaaagggcgcagatcacatagcggacctgagaaagttctttgacagctaaggaggtacaatttgaaactgaatcccgcaaagtgtgcattcggggttcccgtaggaaaattattgggattcatcgtcagtctcgagggatcgagctggatccatctaaagtcaaggctattcaggagttaccaccgcctaagagcaaaaaggacgtaatgagcttctaggacgtctcaactacatcatcgattcatacacaatccacaatcatatgtgaacccatcttaagatgctagagaaagatgccgaaacaagctgacaaggattgtcagaaagcttttgacaagatcaaggagtacctgtccacaccaccatttggtcccgccagaaccaggacgacctttgctactctatctatctgtattggatggagccttggatgttttggacaacatgacgagacagaagaaaggagcaagccatattactgagtaagaagttcacaccttatgaagcaggtactcttttctgaagcattctgtgctttgacctggacagctcagaaattgaggcattattctgtgcctacactacatacctcatatccaggatggaccctctgaagtacatattccagaaacccatgccgactggaaagttggccaaatggcagatactgttaagtgagttcgatatcgtctacgtaactcaaaaggcggtcaaagggcaagcattggcagatcaccttgctaaaatccggtgggaggagcatacgaacctttgaaaagtattttcctgatgaagaagtatcatttgtggagaagacattaccgaagcatacgacggttggaggatgttctttgatggagctgcaaatttaagagggtgcattggagcagttttggtatcagaaatgggtaacattatccgtatctgctaaactcagatttcctgcaccaacaacatggcgagtatgaactgcatactaggctcaacatggaatcgacatgaacattcaggagttgctgtgatcggtgattcagatttgcttgtgcaccaggtacaaggagagtgggccaccaagaattccaagatattgccatatctgcaccatgtgcaggaattagaaagaggttcagaagatagaattccgacatgtgcccagaattcagaatgagtttgccgatgcattggccaccttgtcatctatgatacaacatccataagaattatattgatcccattccgtgagatccataatcagccggcatattggctcatgttgaagaagaaaagatggaaagccttggttccatgacatcaaggagtatttgtcaaaggagaatatccggagcatgcaaaccacactcagaaagcacactccggagattgtccaatcacttcttccacgcggaggaaattgtacgagaactcctgatttgggttctaagatgtgtcggcaaaggaagcttctaagctacttgaggatgtacatgcgggactgtggccctgcacatgaatggtttgtcttggctaagaagatacttagggcggttacttttggatgaccatggaacgattgcatccagtatgtccgcaaatgctttcaatccagagtgcatgccgatatgataaaagtgccgccaaacgagctcaatgcaacaagctccttggccattcgccgtggggaatggatgttattggtccgattgagcccactgcttcaacgaacaaggtttattctggtagccattgattacttcacaaaatgggtagaggttgcatcttacaaagctgtaaccaaaagagtcatcgtagattttgtcaaggatcgaattgtttgtcgattaggagttcccgagtccattcactataatgccgcaactcaatagtgatctgataaaagccatgtgtgaaactttcaaaatcaagcacagaattccacaacctacaaacctcagatgaatgagccgtagaagcggccaacaaaaacatcaagaagatactaaggaagatggtagagaatcacaaatagtggcacgaaaagctaccatttgctttattgggatatcgcactatggttcgcacattaaccagggcaacttcctacatgtagtttacggtaccgaagttgtcatcccagccgaagtagagattgcttctttgagagtcatataggaagctgaactcagcgatgcaaatagataagaagtcgctatgaacaattggccttcatcgatggaaagaggatgaatgcagtgtgccaaggccaaatttatcagaacataatgtccagagctttcaactaaagggtcaaacaaggcatttacaccaggtcagttggtgctgcagaagatcttcccacattaagatgaatcaaaagggaaattctccctcaactggcaaggttcgtattatggttcacgggtgctgacaggaggagcacccatacttgcaaaaatgatggagaatttggccaaaaccaattaattcagacgcagtcaagagatactatgcttgattatttacatttctcatctatgtaattgaactacgtttgacctgattccatttaagagggatacgtaggcagccttatgggttcggtcatatcataataaaattttcatttcccccaagatcagaaactgggagaattttgaggggtcctcaaaattccggagcaagtccagccaatgcaacatgtgtcagacggtcataattagttaagaaactggggcaaattttgagaaggattctcaaaattccgaagaaggttcagcaaggcctatttccgcaaacagccgaaggatcatctactaaactggggcagaattttgagaggaccctcaaaattccaataagagagtgaatgcatttgagatgtgttacagtcactagttcatctaaatatataatatatttctgaaataactctatttttataacattgaatatttttcgaaaaactctatttccataacagtcaggtgttacctagggaactcagaaagggctttcaggataagcaaagcaaagcagccgacagaagcacaaaccaaccttccccccacaaaacttacaatttttctttgaatgcaggcaatctagcatgcaataacatcctcaaatacatacacgtaacaaattcatatcaatcaggacatcagacaccgaatgtatctccagctaagacatacactactcttatttgctattgctctctacatgaggctaatccttgcctccatctgcatgaggctaatccctgccccctaattagtatgaggctaatccttgcctccacacttgcatgaggctaatccttgcctccatattgcatgaggctaatccttgcctccatatctgcatgaggctaatccttgcctccatacttgcatgaggctaatccttgcctccctatttgcatgaggctaatcttgtctcccctacttgcatgaggctaatccttgctcctatatgcatgaggctaatccttgcctccacat

SEQ ID NO: 75 - DNA, 1508 bp, Nicotiana tabacum
atggtgaaacaacaagggaaaggctctaaacaaccaggccgaggagaatcctccctgggagggaaacagaaaatggtcaaactcactccccaagctaggcaaaacatcaagaacataaggaaggccataaaagtggctgacaaagacattgacatttcggggagtgagtacgagccatctcgggatatctctttggactcaatcccagaatacatctcgtatccgtagagggccagacatagagacactcttcccctttccccgcagcccaagcatcagtgaacatttcttctaggtcgtctgagggctcaccagcgggtagtagggatgaatactctaccactcccacagcttcattatctgaagagggtgttgtaggagatgaggaagaagtaggtggtgacgatgaagtagaagaaggaggtgaaccacaagtgtgggggggggggggattgtgagaactagaaagccgaggtttggcaagataggtttgttagtgaagtggcataccataaattctaggagtggtggccggtgagaaagttgatcccggagcggagtttcattgatagtgacttgctacctcacaaccccaacatgaggagacagtttaggatgagagttggctgggaccatttccttgataagtgtgaggattccaacgaacacttggtcaaagaattttacagcaatgtagcccacatcaaaaagggctccaaagtgaccaaggttcaaaattggaaggtgttgtttgatgggaagtatataaatgaatacctgagcttcaatgagaggacgagaccttatacatggcaaatttggaaatgggagaggaggtttgtccatggctagcacagtacttggcaatcccacgtaccgtccctgactggttggctgctggaatcaaaatattgagaaagagcctgaactttgaagcgaggggatgagagacttttgtttgcagccggttggaccctaccactcatgacaacgcctttcctctccatcgggctgtattggtcacttctattatggtggggtaccccatcaatatggggaatgtgatgtcgaggattattactattgtgggtgccgagcatgatagaaacaatccattccccagcttcctgactgagtacttccgggacctgaaagtggatgagaggccctatgacatcaaggtcaaggagatagccccattttcctggtatagcatgaagggggataacaaccccaagagcaagaactacaaagctcatgcttctgccccaattgtccagtctaaagatccagttatggtagaggtccctgctgagcctacctctactcctgctgacatctctcccggaccttccacatccacagctattcctgctggtctatccacatcagcgggcccggagatcccatcttactgggcccatcatattactacccaccgtctaagccaggcacttctaaatttcaacaactggatgaagactgcctcatctaagttgtccatctag

SEQ ID NO: 76 - DNA, 2919 bp, Nicotiana tabacum
atggctgaaaaaacttccgatctctttgcctctatggagatgagcaggttctacaccactgacccatatatggaacctttcattttgactgagccttcctcaccctctaccactcttgctgctgcagtcacaccttccccaatttcccaatatcttcccaactcagaaacctttaaaactactattttgttctccccatcgtctgttgttcccaccaatcaaaccctaagtggagaacaaggtcaaaatactgagttcacaagggttctgaaatcgttgccaccgatttcatggttttggaagcaccggttgaagaaaagaaagatgttgtaactatgtttgtagtatccactgatggggtattgcatgaaattacatcccaaaaaaatgagatacacgatgtggaggaataaggggccattgtggctattgaagggtatgcaatagcagatactactggggcatcacatgaggaacctgatccctctccggaggacccaggttagggctctcatccctaggacagtactattcctgcatttgatgttgtgcccctgggaattcaagcacctgaaatacgatctagtgatgaataagacctggataatgtggctcttgatgcattcataagtaagcgaagggttgcgtccacccttgagtctgaaatcaaacgacctactaccacgcttcaagtcaaagtggcctacgactctactctccaaacgagcaagaagagtagtaagaaaaaaaaagaaaaaagttggtgaaggatggtgtacctgtaagtgatgaggctatccttgtagtcgaggtggaagagggaactccagaggaacccggttcacttgttaggcgatctttgaaaaagacaaagcctgtgtcaatagagaaagggtcaacatctaagtccaaaaagaaggaggtagtgagtgagttttctatgtctgatgaggatgtactagttaagtctaaggcaaaaggcaaagtcagtggagagaagtttgggaaacgcaagtcggaatcttttgacgaacctagttctatgaagaaaatgagaagtgaagtcagccttggctctgagcttttgaggcatcaaaaagttctattgggtcgtatgtttgacccaacaatctctgatatggctggaatgcgccaaattctggaaatggtcgagtttcaacgttgggtgcatctatttcacatggatgcacctaaggtgtatgaggaggaggtacaaagtttctttgctagcctctttccagttgatactgaccatgtctatgctttggtcaatggggtggacatcgtgtttgatgtaaaattgcttggagagattttaaaagttcctacagttagggtgttgagtgtacgagatgtttgtcagtataacttcagaaatgcaatggtgaaagaaaatgctaatcagaaaggggactagatccataagaaagcactactccctgtttaccagttgttatttaaattggttaacaaagtcatgttgcctcgagccgaaaggaggttagtgacttctaagtctgacctattcctaatggagcaacttgacggtttcaatcctatgattcttcctgctattatgatcgaacacatgcaaaaggtttccaccttcaaggacggtaatcatggacttccctatggattctttcttactccagtgttcaaattctttaaagttccactgggaataggtaaagtggggtctcgaaagcggacattctcatagacaactttggaagagtgtgagtgtgtggaaaagtattgggggggaggagtaggaaatacatcaaccgtttctcagcttatcaacgtccaaaacagtgcagctgaggaaattcatcggttgaaggccatgaatgttatcctggaagatcagcaagcccaaggggttcccatgtcgaatgatgaagtggcttgtttgacacaggagaatgctaatctcagggcgcaagttgagaacttgaaggcggaactgctcaacgagcaaaagtcggcaaacaccttaatagacctcgttctccaggcattttctgctgctaccaatccttttactcctagtgccctaaagtacccctttagtgaccagttttctggatatgtttcttatgtttttgtttcattgttgatggtttggcggatgtttttttgttttctttttttgatggttgggaggaaacattactactcccgttagcaagtccaaatgttgcctctagcctttttcataggcagaggtatattaaatcgttattaatattaattctagttttattatgtcagtactctatgtgttctattctctatcatgattgtgtgcacatatgtggcatgagttagcttcactggacttctttgtgctgttatttttttaatgatgccaaaagaaggaaaaaaataataatcagggggaacacacatggaggaactagttcttactactctgatcatgtaaaagataaggcatagtcttagggggaactctctgtgttccctgatactttaaaactggtactgccctaattccagtttataaatgttaagtttgtcatcatcaaaaaggggaaattgatatattttaaatactcttgccttatgttttgataatctaacaaacttactgttaagaactagatagggaacctgacctacttggattgctgcaagctttaacgtattccagctaaaggtgaactgctacagcttcaggagctagaaacccacacaaggacctgatgctcttgtggtttcgtcatagctgtacagagtcaattggacacaactagaaatgaagtgactggcgtcactgtttctgccgtactgcactgtcctcccactcattctctaacaaaacaaagtactcacatcatttcaagtgatgtgatcaagatgtacccacaatga

SEQ ID NO: 77 - DNA, 2397 bp, Nicotiana tabacum
atgcaatattctgatcagcagtcctacagtgcaccaccagctcctatcagtgcactgctgctccagagttttcggggtggttattcaggtcgccagggtcagtctcagtttcctcagccacaacacttaggtggatgttttgagtgtggtgagtatggttatattaggaggacttgtccgaggttagtgggtactcagtcgcagcagcagggtttccgcgctatggttggggcaccaggttttccacagaccacccagccagctagaggttctagatgtggaggtagaggatttagaggtggagctcagaccgctagaggtggaggccagccagctacaggccgtcccagaaatgtagtccagggtggtggggcccatccctgatgttatgctcttccagccaagcccgaggctgaggctttagatgtagttattacaggtacggttcttgtttgtgatagagatgctttagtgttatttgatccagggtctacgtactcgtatgtgtcatcttattttgcaccgtatctggacatgcctagtgattcattgagtgttcctgtatatgtgtctacaccggtgggtgattctattatggtagatcgagtccatcgctcttttatagttgtgattgagggtcttgagactcgtgtagatctgttgcttctggacatggtcgatttctatgttatattggggatggactggttatcaccttaccacgctatcttagactatcatgccaagactgtgaccttagccttatcgggtttacctcgtttagagtggagaggtactcctagtcattctacccgtaggtttatctcttatgtgaaggcttggcgtatggtcgagaaggggtatttgtcctatttggcatatgttcgtgattctagtgccgaggttccctctattgattctgtacccgttgttcatgagtttcctgaggttttcacttcagacctgccaggtatgacacccgatagggatattgacatttgcattgatttggatctgggcactcagcccgtttctattccgccgtatcgtatggctccgtctgagttgaaagagttgaaggataagttgcaacacctacttgagaagggtttcattagacccttgtttcaccttggggtgcgccggtgttgtttgttaagaagaaggacggattaatgagaatgtatattgattaccggcagttgaacaaggttacaatcaagaataagtatccattgccgaggatcgatgatttgttttatcagcttcagggtgccaaggtgttctcaaagattgatttgagatctggctatcatcagttcaggattagggcatccgatgtccctaagacagctttccacactcggtatgggcattatgagttcttggtcatgtcatttgggttgatcaatgccccaacagcttttatggatttgatgaaccgcgtgtttaggccttatttggactcgtttgtgatagtcttcattgatgatattttgatatattcttgtagctgggaggaccacgagtagcatcttagagtggttcatcagaccttgagggataaccggttatatgctaagttctcgaagtgtgagttctggttgagtttagttgcatttctggcctagaccagcatcagctacacagattcagagtttcttgggattggtaggctaatatcgtcggttcgtggaggggttttcatctatcgcagccccaatgactagattaacctagaagggtgcccaattcagatggttggacgagtgtgaggcgagctttcagaagcccaagacagctctgaatacgacaccagtgttaattttgcccacagattcagggccttatacagtctattgtgatgcatatcgtattgaacttggtgcagtgttgatgcaggatggcaaggtcattgcttatgctttgcggcagttgaagattcatgagaagaactacccggtccatgatttggagttggcagccattgtttacgcattgaaaatttggagacattatctgtatggcgtggcatgtgaggtgttcacggatcacaagagtcttcagtatttgttcaagcaacaggagttgaatttgagacagaggaggtggttagagttgttgaaagattatgatatcactatcttatatcatccgggaaaggccaatgtggtggccgatgcattgagtaggaagtcatccagtatgggcaatcttgcttatattccgggcggtgagagaccgcttgctttggatgttcgggatttggccaatcaattcatgaggttggatgtctctgagcccagccatgtgctagcttgcacagccgcttgttcttctttattggagcgtatccgtaatcggcagtatgatgatccccatttgtgtgttccttag

SEQ ID NO: 78 - DNA, 895 bp, Nicotiana tabacum
ctaattcttctcattctcttttgcaagctcagctctgagagcatctctctcggtctccatttcagccaacctcttctttagcctatcaggctcagcatcctttgccctactttcttgcaccaaaactcgcactttgctattcactggtacctttttggatgaaccaggttttttgggagtgatttgagcctcatagttacaagcagtcaaagtgttagccccaaaatgatccttgtttgtaccaacttcccatttcttgatgggtacctttaaatgtgcaagaacaatcgtgagaataaaaccatagggtatgacataagtcttagttccatttagaaccctgtcaagaagctgaattttagacccaggccaatttatttgccgcctattgtccaaacattccataaggaccaggtccatgaatgtggaaatgtgcctcctttcctaccttggcagcacacatttgtttacaaattggagcaacactttgttgggtggcttcatctcatttttgtaaatagccttgggctcaatttcctcctcattgtcacaaaattttctagtactggcaagggcagtagggagattctctaggcttgtccatttgagcttcttatagtcattgtatcctttagaatgcaccccaagatctctctcagctctttctcatcaaaagtcaccatcaccctttaccacactggtgaccctaccatcttgatctcacaatttgccataaactgcacaatatcagttatggccaaccttccatcatctgaaagaccatgtccttccatccttgcacctgtaacttctccagaagcattaccattccttcctcctctaagttcctgaggagcctacctttcaagatggttctcttcccaaacttaaccat

SEQ ID NO: 79 - DNA, 4787 bp, Nicotiana tabacum
atggtgaggaattactgcgggtggagcgagggggtaacactgcaggtgctttctccaaataagggtattacagactccactgatggagttttgagcgtatacctataccctttcgcatttggcccccctgctagggttgtgcttgatttttgcttgaagtatcgagttactctggcgcagatttatccatcgtttcggcgaatggtaatgataatgaggttcttcgtggagaaggttgggctcgaattcacgtttaatcacctcgttagactataccggccatttcattatcgaggcctgctaactctgaggtgccgtttgtccacgccctttgttgtcgatgatgaagaagacaaggaccgagagtgggccagttggtttattcaggctcaaactgctgacattatcccaacagggcttttgccatttcctgaagggtggaatcatgcacgtgagtggagtgtctggcgcttttttaaattttgcctatagcgaaaatcagttgagtaataatgttgtctaccttgttgcagcaacttcgtggatgccgggcaaagtccttgaccttcccgtctgggtccataagttggcgacccattcgacttgcgacgagcgcaggtggcgagctgtatttcgtaccaaatggggagtgaaataccaaggtatgtgcgtatgttgcctttgacttggccttcgtatattcgaggtaatattttcccctttcatttgtactggattcaccgtttgtagatacagggcggttgtttgggatgagacagtgttcttccgaagaggagaaagagtcgtcagcctccaagccgagggaggatggtgataagggggatcggcacccgcggtgtgatggagcttttagtggcattgggcgggctcagatctttgagtagagggcatcgtctgagcctgatgttcccggagtatcagattcccgggcggcgattcctccgagtgaatatgctctgcccgaggttggttctcctggggccggagaggcaggatcaacaggaatgtgttctggcttagaggaagtccatcggcttctcttcgaggtgagtttaggcgcgttttttcctgtatgtcacgccctcctccctttattgagttttccttgcataggcctgtgatgggcttatgtctaagctgctctgtcaaggggccaggctccagaaattcttgaacgatggcgagtcctttaggctccttagccaagagaatggggctaagttggcacgttggcgatatgaggcgtatcagagctcaaactatgagagttgtttgatagagcaggtaactttatatagtatgcgctttgctcctctctaaccttaaggctcaccccttttgttatatcagctgcaaaaaaaggcagaggccttggagtacctcaaaggcgacgtcaaccgcgtcagagttgtttgtggggagctaagggctcaagagcaagcttgagctttagaggagatatgtgcctcagccagggtccctgccatcgaggcccaactctgcttgactcgtgataacgccaaagttcaagcggacatgattgggaaactcgaatctgatctcttgaaggtcagagctgagataattaatgcccaggctaaagtggcgctaagccggaccaaggctgatcaggagatggcgattcatatgaaggatgttgctgatgcccaagctgagctaaagcgagccctcgaccgggagaagaggatcgaggagtatgttcgttgcagatctcggagagaggtactcgaggaggccagtgtacggggcttcgttctctcgaaagaattggctcgagcaagggtggatgagcgcgacgctctgtaacttcttgctgacgtcgcggagggagaatttgacaagttgtagccctttagtgcggagtgtagatttcgccattttgtcgctttgtttctgatatatgtagagcatgcttgtagatggagaatgcgcccttttcgcgcatataatatgtaggaagaaacttgaagctttattttttctgtacctcttttttgttattgcttttcgactgggcaggccggttttggtgtttggcgggatcctcgtaggtccggaactggtcggatagacctaggggctcttaagtgtaatcccttacgtgagctggtgctggggcctccatgcttggcccgactgttttaggcttagtctctgagtcgggcttcgtctcaagccttttgcccttgaatcttttatgcccgctcgggcaggcattaattatttttatttcttgctcttgggcatttgccgtttcgactattttggattcagtctccgagtcgtactgtgactcgagcttcaattgaccctcaagctctttcctgcctgcataggcggatgatgatggccttttgtgctccgggtcgaaatgaccttactggcacatggcccggagatttgctcggctggcgatagtggcatttatgtcgtgcccttaggcatattgtagtttaattattccgggtcaagcctccgagtcgcgttgtgacttgatcttttattgacccttaagtacctctggttttcagactgacgatagtgcctcttacgctatttcggtcgttgagacctttcaatatgtggctcggaggtttgcatagttaactattttggatccgatctctgaaccgggttacgatttgagctcattttaatcctcaagttgtcaaattttagctagtgacaatggctcttacgctgtttggtcgtagagaccttttaatatatggcccggaggcttgcttagatggcgacaatggctcttacgctgtttttgcctgtgggcttttttgtaggctttgttttctgctcgttaaggtcttttggaatatttttgcttgacccgtcttcggttctagaggaacttcgatttcaagtcgttgtcggcgatgttttgagcacctcaaaaggttcatagctcgtaggttgagtagatcaacactttggcggtttggagtcgacatggtcggggttcgtttttgcctgttaagggaaccctattttaaccggttcttttcgaagtatatttggagtagtgtcctgagattttagtaacagtcgggtgtccccgagtcatgttattttggctgtattaaccgttttgatcatagtcatgtgcgtttggccgtagccatttttaatcccgattgatagtttaggtgtctacaccgagggtatgccctttagggatttttacacatgcgacgtataacctaaacttcaggattttcatgtttgttgaggtcttacagttaatcattcctcttgaggtcttatagtttgtcatgcctgttgaggtcttacagtttatcatgcctgttaaggtcttatagtttgtgtaatatataatagatctggttacgttgaggctgcctgctaggggtctcacagtttcgatttttccagcatatgacgatcaatggcagtctctgagtcatataatttgtttaagcttgaagaccgctcctcatgagctcggagttgccttgtaggggcttgttgagcccggagttctaaccctggggtcgtgcgggtattgaattgctgatgctaagtctccgagtatctcgggatgcattcggtagagaggcccttgccatgagtatgttgaaatccccttttccgaagtacgaaatgccgaaaagatattctttattacttgtcataaatatatgttgtaaatacatgttctctcgtcgttgtgagctcggcccacgtaggtacgactcttcggaccatctgattcgttacaaggttccctcttgacactcagtctgatattttcggtccttctgagggaatggtgcccttgaaagaagatcatcgcccgtcgttcgattgtagaagaaggcatgtgattttgtcgtatcctgctggcaggaccctctttgggggtacactgctctgctaataatctttttggcgggaccctctttgggtctaaagtctgatcgagggaatagagcacaacgggccctgctaaggccttggatctccgtgtggagttagaactttcgaatgccccggctgattgcctgcatataagttagtgaaaaaataatgaaggagtgaagtagttcctcctcaccgcggggtgcgtaggtaacctttcgaggttcgggatgtttctgctgttccgaggcacgagccctaatacagccttctgctgtgttcaaccaagcttagcagaagatgcgattctgcttaccctttgatccttttgagggcggacgtattgatgccggcgatgcgttacatggtgagggttttcctctcgtcgtgtgcagctccttgtcgaatactttagtcccacccttgtcctggggtttcatccatttggtggagtagggtcgaagttgcctccggggaggcgtgcccgttgtcatctgaataagacgtacgtgccttgcgtgttcggcattccagtccgagctgatacgggttgtattaagggagtggtcttcctgatgtggcgatcggtgcctagaatctgtcaaagattcgagatgtgggagtgacttggttcgttagtccgaatcgccccattggctttggtttgacatcgttggtataattaattgaacaacctgtattcatgaacacatgttttatttggaataggtcaaatgagtgagagggttaccaacacatcaatacgaggccgaggcgaagtctcggcgtccctttccttggaagcaagggtgtcctttggaatattccccagaccagtgtttccccggtga

SEQ ID NO: 80 - DNA, 916 bp, Nicotiana tabacum
atgcggaggagtagaagaacaagcaatctcttccctcttgatcctgaaattgaaagatcacttcatagagagaggaaggagttggaagctagatacaaaacagaaagagagttgggcattttagttcaaccacagccaatagtgatggcaggtaatggagggcgttcggtgatagaagctcgaaggccaaatcttgctaatatgactcaggctattgttaagcctgatatcactgattactttgagcttaaacagtacacggtacagctaattcagtccactaggcaatatgtaggtctatctcatgaagacccgcagaggcacattcagaattttttggaaatcacggatacttacaactttccaaatgtttccaaggactatgtcaggctaaccttgtttcctttttcattgttgggggaagctaaagaatggttgcagaaggagcctgctaattcaatccatacttgggatgatttatcaaagaaatttttaatcaagtttttccccactaaaaagacaaagcctttgcggagccagattcttgggtttcaacaacgggatggtgagactcttcgccaagcttgggaaagatacaagaaactactccgagactgtccacatcattgtcaaactgatgatattgggccatacttttgttgatggattagatgagacttcaaagatgaatcttgattcagcttgtggacgtagttgcatggcgagactatatagtgaaatacaacttttgctaaacaacttcactgttaatgatcataattggcaaggtgagggagaaccaaggagagcaatgaaacagaaagcagcaggggtacttgaacttgatgatttttcagccatgagagcagatatagcaaaattggcaaatcaaatgaatagaatgacaatgaactag

SEQ ID NO: 81 - DNA, 6537 bp, Nicotiana tabacum
atgggtagaattgaaatgatgttcgaacagatgatgaagaagaatgcggattctgatgtcagttgcttcccacaatacctcatcgaaattggaggttcagttaggccaaatctcacagtcttgaatactcgccctaagggtgctctaccaagtatataggtagtaacccgaagggtgggaacaatcatgttatggcgtaactacaagagtggagaggcggtgatgtgaatgcctccaaacaaaagcaaattttgagtgatgatgttgagttgcaagaagatgaagttcctttggttgaaaatgtgattgatgaaatatgaatgaagaagtgaggattgatattcaagatgcgaggtggaaactcaaaatgatgtgaacccgtctagggaacactaatagacatgccggagccggttgtgcctaaagccaaggtcctttgccaaggccacctccccttatcctcaaaggctcgaagcagaaaatgagaatcagtttaaaaagttcattgacatgatgaagagcttatccattaatgtgcctttggtggaggctcttgaacaaatgcgggctatgctaaattcatgaaggacttggtgacaaagaagggtctatggattgtgaaactataaagatgactcaccaagttagtgcaatagtgcattcaatggcccgaagcttgaagatcccggtgctttcaccattccttgcaccattgggagtgcggattttgcaaggctctatgtgatttggggctagtatcaatttgatgccctactcgttttcaaactttgggtattgggcaacctaggccgacttccatgagattacaaatggcggatagaacgatgaagagaccattgggtattattgatgatgtgcttgtccgggtggacaaatttatcttgccagctgactttgtgatcttggattgtgaggtggattatgaagttcctatcatattgggagacctttccttgctacgggaaggccttagttgatgtggaagcaggggaactcaccttccgggtgggtgatgaaaaagtggtctttcatgtgtgcaatcaatgaagcagcccaacagtaccgagtgtgctcttttgtggacctcgtcacaagtgatattgatgacaccagtgcaatgatcaatgtggaggacctcattggaggccgtattgttgaatcttgatgtcaatgatgatgaggccgagtggagtgcgtgaatgctttacatggaatgggctcttactcttatgagcctaggaaattatctttggctcgagaataggaagactccaccaacaaaaccttcaattgaggagcctccggtgttggagttgaaaccactgcctccacacctcaggtatgagttcttaggctcaattctactttgccagttattctttctcttgtcttactaacatgcaggttgatgccacattggcggtgcttcaaaagggaaaaaggcaattggatggactttagctgatattcggggataagcccgcattctgtatgcacaagattattctggaagatgatgcaaagccctccttggagcatcaaaggaggttgaacgaggcaatgcaagaagttgtgaaaaaggaggtgatcagggttagtgtaccccatctctgatagctcttggacttcaccggtgcaatgtgtaccgaagaagggtggcatgaccgtggttgcaaattacaaaatgagttgattcctaccagaaccatccggttggagggtatgcatggactaccgcaagttgaataaagtgacccgcaaggatcactttcctttgccttttcttgatcagatgttagaccgacttgctgggtgccttctattttcttggatgggtattctgggtacaaccaaatcttgattgctccggaagatcaggagaagaccacattcacttgtccataggcactttttttctaggatgccttttgggttgtgtaatgcaccggctacatttacggtgtatgatggccattttcaccgatatggtggaagacattttggaggtgttcatggacgactttatgttgtggggattcatttgatgatgcttgaagaatcttgatagatttggcccgttgtgaagaaaccaatcttgttctcaattgggagaaatgccactttatggtggaagaggcatagttcttgggcataaaatttcaaagcatggtattgaggtagacaaagcaaaaattgatatgatttcaaggctccctcccctacatctgtcaagggagttgaagttttcttgggcatgggggttctcggagatttatcaaagacttttcgaaggtagtgaatcccttgtgcaagttgttggaaaaagatgcaagttcgtgtttgatgaaaatgtatgcaagcctttgaacttctcaagcataagttgaccaccactcctatcattaccgcacctaattagagcttgccctttgagctcatgtgtgatgcgagcgacgttgtggttggagcggttttgggtcaacgagtgaacaaaatgtttcatccggtgtactatacgagcaagacaatgcatgatgctcaagtgaactacacggtgactaagcaagagcttttgtctattgtgttcgcaatggaaaaatttcggccgtatctcatgggtgctaaggttattattcataccgatcatgccgcactccgatacttgatgacgaagaaggattccaaagctagactgatgcgatgggtcttgttacttcaagctttgaggaggaggggaggcctcgtgatggcctagaaagcaattattcatttcccgacgaacaactcctttcggtgtcgatgaatggaatgctatagtttgcagatgttgctaatttccttgtgactggtataatcccgtgtgagctctcttctaaccaaaagaagaagctcaagcgagatagtttggatttctattggtatgagacatacttgttcaagatttgcacggatggtgtgatccgaaggtgtgtcccagaggaagagaaattgagtatcttggaggtttgtcattcctctccctatggtggccataatggcggggcgaggacgacttccacagttcttagttgtggattttattggccaactttgtacaaagatgcaagtgaactcgtaaagaggtgtgacgaatgtcaaagagggggcggaatttcgaagaaagatgagatgcctctcaataccatccttgaggtggatatttttgatgtatgaggcattgattttatgggtccgtttgttagctcatgtgggaacacatacatttttgtggcggtggactatgtttcaaagtgggttgaagccgtggcttttcccaactatgaggcgcagagtgttgttgcatttctcaagaagagcagttttacaaggtttggtactcttcgtgcaatcataagtgatggggggtctcatttttgcaatagagcttttgacatttttcttgcaaagtatggtgtcaatcacaaagtttctactccctatcatcctcaagcaagtggtcaagttgaagtctacaacatggaaatcaaaaagatattgtcaacgacggtcaatgcttataggatcgattggtcaaagaagttggatgatgctctatgggcttataagattcttacaagactccgattggtatgtttccatatcggttggtgtttgggaaagcttgccatctaccggttgagttagagcacaaggccatgtgggccttatggaagctaaatcttgaatgggatattgcagccaatctctgtgtggagcagcttaatgaactcgatgaatttcgattccatgcctactccagttcttccttgtacaaggacaagatgaagtaccttcatgataaatatgctcgtagtaaggatttcaaagtgggtgatttggttctcttgttcaactcttggttacgtctgtttccggaaaagcttaagtcgaaatggagtggaccttttgaagtggtatgtgtgatcccgtttggtgcacttgatttaaagaacaaaaatggggaagttttcagagtgaatgggcatagggtcaagcactacttcggcaaaactgatgatagccacatggtggcacttcttcatctcaaatgatttgatggtaacttgcgtcgtgctgcgacgttaaatcagacgctttttgggaggcaacccatgtgtttttcttcttgtttttctttgattttcattgtaatataggatttatttttaggttgaccggttgtgagatgttacatgtttgtgtttatgcagtgcggcatatggtggaaaaattattcaagtctctgaagttttcaatgcggaccacactacattgtgtgcggccgcaaataactcagtgtggggggcacaaaatcagtgcagaccgcattgataaaggatgaaaatactagctctctgaagtttgccaccgcggccgccttgtattttgtgcggtccacggtgcctcaatgcggaccacattaccattttgtgcggtccgtggtgcaattgttcagagagtgggtagtctgaacaccacctctatgcagacagtattagcatttttgtgcggtccgcattggcctctatgcgaccgctttatattttgtgcggtccgcactgtgcaacatctgctactgtctgcatctttttattttctacaattgtgaacttaatttcttctactgatactaacaagtctaatggatgttgtttgcagacaatggtgaaacaagaggcaagggttctaaacaaccaggcaggggagagtcctcccggggagggaaacagaagatgctaagattgactccccaagcccgacaaaacattaaaaacacaaggaagctcactaaagctgctgataggtccattgaccagtctgggagtgaatacgagccctcccgagatatatcttcagactcaatcccagagtacatccctgactggccggagagaaacagactaagagacactcttccacctttccccactgtccaagcgtcagtaaatgtatcttctggttcgtctgagggctcagctgaaggtagtggggatgaatactccacctctcccacaacttcattatccgaagagggtgtagtaggggaagaagaggtagtaggagaagggggtcagccccaggttggtagggtagaacgaactagaaatccggaggtgtggcaagaccactttgtgagtgaggtggcctaccataaattcaaagaatggtggcctgtgaggaaattaatttcggagagaatttttgtagatagaaaccttttgcctcacaaccccaatgtgagaaggcaatttagagatagagtgggctgggagtatttcttaaacaattgtgaggatgcaaacgagcacctagtcaaggaattctacaccaatgttgcccacatcaagaagggcaccaaagtgaccaaggtgtgcaatttgaaagtgttgtttgataggaaaacaataaatgactacttggacttcgatgagaaggatgagtcgctgtatttggaaaagatggaattaggtgaggaggtctgtccttggttggcacagtatctggcaaacccaggtatcacccccgattggttgaatgcgggagtgaaaattttgataagaagtttgaatttcgaggccaaggggtgggaaacatttgtgtgtagcagattggaccccactactcatgaaaactcactccctcttcaccgggcagtattggtagcatcaatcatggtagggtacccaattaacgtcgggaaggtgatgtctcgggtgattacacaggtagttagtgaaggtgatagaactaacccttccctagcttcttgaccatgtactttagggaccgcaaagttgaaaagcggccatttgatatcaaggtaaaagcaaaggccccgttctcatggtataacatacagggtgatgacaacccgaaaggcaagaactacaagggaacatccactgatccaactggcaagtctgaagagccagttgtggtagtggctcctactcatcttgcctccacctcaatggacatccaccctggtccatccattttagcagctctagagataccctctacctcggctcatccagtgactgcacaatgtctaagccagacccttcttagcatcaacagttggatgcagacagcttcctctaagttgtttgccctcactactgcagtagcatctcagtcgacacctccacctctacaggtcctacagtctatgaggatgccctcaaggatattctggacaactagaaaaaaattcttgacactcaaaaatttcttacggacgctgtggagtcatatggaaaagctctcaaagagcttgctagggaggccaagaagatgagaaagacgcgggcttccaaggagtccgtgaaggagttgagggttaaggttgataggatgaaggcagaaagacgctttggatttattgctacaagaccctgtgccaacatctcaccctcagctagagcagtcccagaggcctcccaagaggaagaggatgattccccgagcagatga

SEQ ID NO: 82 - DNA, 4252 bp, Nicotiana tabacum
tcagagataaggagggaatatagaaagcttgaacctttgggttttagccccttcttgagtttgcttgtcttttttggcctgtatatcccgggcagattttgctgtttgcttggttgaatttcgcaactccataacttggaggccgcgtatatcagccaagccaatggggacctcctcaagtttatcacatgatacgagaacaagacgcttaagtcttggaaagtgatcacttgaagcattccaagaagctaaatctgacctttcgatccataacactagtagggaacgaaaacctccaacttttggttcccagtattctcccttaaatgcattgtctttcagcttcaagacttcaaggtactctaactggcccaatacagacatatcatcccactccaaccaggtatctaataatgttagcttcctcaaatttgtcggaaatatatatgttggaggaaggcgtaattgtttcccactttgaccaacatttatcagcttcaagttctcaagacattgtagcttcttaacattgttgaacaattcggacttatttggttccagaagcataaagattttaccacgaatgcccagttttttcaagtttggagcccttgaaaaaacttcttctgtgcagctttctggtgcaattgtggagagagtttgtaggcattgatttaccgaggtaaccttgctactttttggggcaacaggcgtaggcaatttagcggacgtgttagtgtgcagatgcctcagccgtggcatgttccatatgtctgcttgaatatcaagattgctctgttgtgtgttaacaatgagggtttgtacgttccatagttccccaatatgtttaggaaggatcttgataaagtcagatgagaaagcaatatacctcagaaaatacaattggaaaaactccctgcaaaagcaactgaatttgatggattcagcatccaacacccttagcaatggaaagtcttttggtatgtttgggatgtcaaccgggggcatgtcaattttttctgaagaaaaacataggaatgacctaacatgctcaccagagggcttcatagaaatgaattccagaactgaggaatgaatgcacaagcggcggtaggtggatagttgctgtatctcacgagcaaattgcccaacacctaattttacctcttggaaaagattttcttctgttgtggcctcttgccagcaaaactcatgcaacatgtcatgaacacgacatgttttgatttgtccatcagacgtcctttgaattatcatcactaagtttctgttgacgagatcattcaagtaatcctctgctttacgttcaagggataagggccctttgtattggatgaagccttcggcgatccataaacggatcaaattccaagcagggatctcaaagcctctgggaaatgcaccacaatacaaaaagcatgctttcaagtcgtaaggcaaacgatcataactcatttgcaccaattttattacaattctttggctggtttctattaatgaggtgttcaccaacactctgatccacttgctcccactcccttgttgtcttgcgtttccctattagagctcctgcaatcaccacaattgcaaggggaagtcccttacacttcctggctatgctctgtccaggtctttccaattccggaggacatttagccttgtgaaaaactttcttctctagcaacatccaactttcctcatcgctaagaaattttaaatcatgtggagtattgttgcaatgatgagccaccttgtgatctcgagtggtcaacaatactctattgcactttttgttgttcgggaaagcaatcttgatacgttcccacacatatattggtattgttttgtttttccggtgaatttgctaatgatgttgagatataattctcttgtcttgtatgattgcgagacataaacccaaactcgagtaaagaactcgtattcaaccttccgatgcttgaaaatcttagttgctagtgtggttttgccaagaccaggcattcctacaactggaataacctctaattcatctgatctgtcaagaagacggtcgattaccttctgtgcctcctcatcaaagcccaccacatcatcttcctcaaccacgggaggcttttaaattaatatcaaagatgaagattagacatatatatgaagttaacgttcattggcaagaaaagaaacattatattcaaccaaaacatattgtattacgtacgcatttgtgcagcttaattaaaagataggtgattagctttgttttgtattggaaaaattgatactcagtagtaaatagaagcaaaggtggattttcccaagacatatatagaacactaacattacaacaatatagatattgtccaagaaatgccacacatccttcttactttcacatttttacgatactcattttgttgattatgtcggcttctcatataaaattgataatcattctatgaactttgcgcaggagtatcttcctgtgcaaagtatatttaagtgcaatacagttccgttgattgtaccattatattctgctggaggctcaatggagacatctgaattggttatatttaagcagcatattgtcatctaatcttactcaccttcattcttattaaggagtctaaacctgttaaatatatatatatatatatatatatatatatatatatatatataaatgcaatgctgggtttagggctgtgcatttggatcggatatccgagaatccgaacccatccactctctttagacttattttttcttagtttatatcgaagtctctctctaacttctcttcaaattgctcttttcgcttctcttttttttttttttttttttaatatccctcccaatttaggaggatctatagtgtttccacccttctcctccagcatgactcgaacccaggacctaacggtcgtgggtagaggtgcttttatcaactgagcaagcctcacttgttagttcgcttctcttaagtcttatctttgtgtctctcattctcagtatctccttcctatcgacggacaacgacgatggaaatccgataacgcttttctttttattggtatgccgcttcgcgagcaaggagcgagctaagtaaatcttacctgaaaatgagcgagattcgattctttttcctttgtagtttttgttttgtcatttctttttccttccctctgttaaacagctcagcgacttgggaaagagcttgcccaccgcatactgattgatccgataaagcaaagcaacctggcccacagctctgagttggggcttgattcccagccgagataacatttgtttggaattttagtttattttattttgctatggagctttgttttgtctattgctataaaagacatttgttgcctttcaatttaagccttataaagtgtagtagccgattagattgttagtagccttaataaggcatactatctgattcgaaaatccgaaatatttacccgattcaaactttaaaatccaatccgatccaatttaatttggattggattcggattgcattttataaaaatcggaatccgaatttacaattcgaaatgtgttaaattcgatctgatccgatccgacccgactgatgcatagccctagctgggttactgcattcgttgtctcattgacttgtggtgttgagttacatgctaaaattttacatgataccaacaacaaacatggcaggcaggggcggagctaaagtgttccgagcgggttcggcgcaaattaagggcaaaaaatgaatgattgaaggcatatataatataggtacctttctgtcttccacgcctctgttggatggatcatcatcttgaagagcttgaaggccatgtgcattgttcagacggatttctttcaccctatctctgatacctttaatctcaagggctacatctttcactcttttataatgcgcaatgtccacaaacctgcctacccctttgtccttgtgaagctttgcctcaattacaaacttatcaatagcgtcttcagaatcattcgtcacttttctgatactcttcaccaattcttttagaacttcgttatcgctgcgggacttgtctgcttgcttcagaaacgcattgaactcactcaaatcttgaagcagattctctgcctcacctttcactccaaatattagctctgtattgtccctcaacaactgcatcaaattctctaccagaaaattcactgctacatcagccat

SEQ ID NO: 83 - DNA, 916 bp, Nicotiana tabacum; identical to SEQ ID NO: 80

SEQ ID NO: 84 - protein, 220 aa, Nicotiana tabacum
MRRSRRTSNLFPLDPEIERSLHRERKELEARYKTERELGILVQPQPIVMAGNGGRSVIEARRPNLANMTQAIVKPDITDYFELKQYTVQLIQSTRQYVGLSHEDPQRHIQNFLEITDTYNFPNVSKDYVRLTLFPFSLLGEAKEWLQKEPANSIHTWDDLSKKFLIKFFPTKKTKPLRSQILGFQQRDGETLRQAWERYKKLLRDCPHHCQTDDIGPYFC

SEQ ID NO: 85 - DNA, 425001 bp, Artificial Sequence
  Description of Artificial Sequence: Synthetic polynucleotide
ccaagttggcctcatctgcaagcaaaggttaatttcctcgatcgtggccctttgagacccatcgaaagctttcacgttcatgcttcctgcctgtatttcatgaaaacctttgtccagtgttttcagagtagccaatggacaaatattgaggcttgatcctccatcaaccaaaaccttggcaatgaacttgtctttaaattgcattgtgatatgcaatgctcgattgtgattcaaacccttaggcggtagctcatcttcgtagaagatgatcttatgactttccagtacctgccctaccatattggccatctctccgccggtgatgttgttgggtacataagcttcactcaacaccttcattaaagtattcttatgcgcctctaaattttgcagcagtgacatgatggatatctcagctggggttttgttcaaatggtcaatgacgaaatactcctttgcttgtattttcctccaaaggtcatctggccctatttcaatgataggctgcttggtagtggtatccttacttggtcctcccaagtgttcaggggtatagactcttccggtcctggtcattccatgtgcagcatcggattcttctgcctttgccttctcttttcactgagtttcggcaacataatcccaagatattgcttttgagtggaaataaggtgtggttgatactgtcattgtaaaaggtgtgacaacttctacttgaaatggagcaggggtgtccgtaggcagagccacctctacctcaaatggaactgatgcggctacctcaacatcgattggtgactgagtctgtactactataggagtaagtgtgaatgaaggtttaaagtcatcgccctcccgaataaacccaatcgacccatcagggtcccattcttcgttcgtctctatcacatgtaccccactacctctatgatcagggagagggttgttgcgacattgggtgcagcttcctttgctttatcaattagcgtctagatcttatctttcaatgttcgggactcatcagtggtgtgccccttcataccagaatggtttgcaaaagttttgtttgggttaatccattgggatggattttctaatgccacagtgggaataagggtgatgtaaccagcaactttcaacctttgatacagttgatcgatgggttcagtaatggcagtgtattatctgggtggcttgcgatcgaagcttggtcgtggtcttggaaagttttagcgagttggaggtgattggaaatgggatggttgggagttataggtatgatggacagtggctagttgggaatatctgggagatgatggttgatatgtgggtggtggtgcttgatatatgggtgggggtgtttgatatgtaggtcgaggtgtttgatatgtgggtggaggggtttgattggtaagtggagattttgggccctgggccaccattactaccccaacgtctcttttctttgatatgtcgcctgattgcaatgccttatttgtggcctgtaatgcctcaaaatttgtcaccatcccgcttttgataccttcctcaattctttccccaagcttgatgatatcggagaatttatggttttcaataaccatcaatcattcataatactacggaacctgtgctctgaagaagaacttgttcatctattcctcgtccaaagatggcctgaccttggctgcttctgacctccaatgagtagcatactcgtagaaagtctcggtaggtgtcttcttaagattctggatgtagaagacatccggtgcattctccctattgaacctgaaccggtccatgaaatccgatgccatactcacccaattggaccatttcttggggtcttggttgatgtaccaggacagaccatctctagtaagactcctcataaagagtttcatttggatcttttcgtcttcccaaccctgacaagcttgtcgcaatagatcctcagatggaccctgggatcacctgggacccttctttgatggagggttttatccttccagcagttctacatttggctgtatgcataggtcttcatagtttaaaccttctattcccttgtcgccttcgacaccctaaactcgactcgtcaatttcttgagttcttcaaccatgttttgaatgagcaggtccttctcagattattctggggtataggagattggttggatagagtgaggcacgatttccacgtatatggggttgttttggtgagtgcccggtgcctgggtgtagtggtggtcattagtagagttttgagggtcaggaatgggttgtggtgtattctggggagtatgataagtggaggttggtgggtaatgaattggttgatgatggtgttgtggcagagttgatattggtatgggattgagattttggggtggggttgcgtattgttgcggtgcaggagggttttgcggatgttggtttggtgtgttttggggaggtgctgggttctttgtgctttgctggttgatgtcagggatgttcagagtgagtgacaagtttgcgaagttgcagacctactcaagatctccttgtagctctaatatcttttgttctaacatcaagactagatcatttggtgctggggtactccgaccgtctgatgtttttgcgttctcaacattctcctttcggataccacttaaatcgtccaatttttcttttcctctatcttttgtattacttggaggaggagggggtggagggcctctagatcagatgtgatatgctgactatgccagtatgagcgaaccaaccttaggggataggaattagaaataaagaaaaacgaaagtgtaaataaggcagtaaggattctgaaattcttgcagtatttaaacacatattacgagaatgtaaattcgtgtcctaatttgggagcctcgttgtgcccgaggtaggcctagtgacaaataaacttggagaaatttagtgccaataattgactcatttcattaaagtaaaagtaaacgaaccaaaacaaaactaaataagttaatgtcattactggctcttggccttattatatttgaaaggaaagcaaataaatctaatatacctggtatcaaaaggaccctctccaggctgaatgctcttgtcgattaattcttccatcttgcgtaggttcagcagtaggaacgcccttgcaagatgccctccttcgttcccttcagcattctagcagtcggtgaccctttttcttagcttcccttcaaactccattaaactgtattccaggtattccagcctctcgctggatttaatagctcttcctttccactcgttaattatctccatatcatccttgtgtagtgccatatgctcagcttcagactctcgaactcttttccgtagcttattgtacttcacctatgctttagaaacctcgtctataaccctatttcttggctcgaccctcggctcaacgaccccagttatgttttcctctaaccacgaagtaaaggtatgagtggcccgtatggtatcggtctagctcaatagtatccttttccataataattttcaagatatacatgtgttgtgattcattcttatacgggatggtgtcaccttggaaattggctttgaagtggcacattttggcaacccgtggtatgatttgtctccttctttcttgtctcataaccttgagaggagcgtaagggtatatgcccctcaacccgatcaacaccaagtgctgaaaatccctggatctgatgatgaattcatcggtaaggaaccactcgaacatccacttgacttgatcctcagtcaaattttcaaaaatctgtacccatcctgcagcgtcctctggctgagcaaacatatctagaatataattcattcttttgggatgatggaaggctatatgatcattccacggccttcgcagaaattcttgacaatattgtcccttttggagatgttccaacaaccagaattgtagcagcaagttgcagccctcaaagaacctgaaccccttctgacatcgctccaaagtccggtacatgtctgcaacaatcatagggacgatagtgtatgtctccccctcgatcttgtccatcagagttttggttgccatggccaacctagtatggatcctatccccttggattgggaataccagcatgcccaagaagtacatgataaatacgaagaccctacgatgaatccaacctaaagaagtgattgagaactcatcatcaaagaggcggtaagaactgttatgactgtatctttcataaaggaacttaaaaggaatgtaggagtcctttaggaatttcaagttatcattcttcttcagccctaccatcttcaaaaatcccctagcagtgcgattttcaggcgccaacagattaggactatcccaaagtaacccagcaaattaccctatttcttctagaagggtgtcatttctatgttcccaaaatggaacacaactctttccttgtcccaaaacatagttacaacctcgatcaacattttcttgagttgaaggtccatcaaagaaggcaagtttcctaagactcgtttcacattgttttggtcacatgaaggaagattcctccaccaatctagcaaaagtgagggtgtgctaaccataccgaatctggggacctcgtgcctcatttttttcaaaacaaagagagttaggccttttccccctccaggtttgtctatttatacagtaatgattagcatattgacaattatttctccaaattaatgcacacaatcgtggttacatctgttgggattatggaaaatccgatggacttttggacaaggctcgtcttaatgggttattatgtggacaacatattaacccgactaggtttgaccatgatacatgtacaatttaatcaaagtagggttgctatagaggtatagactaggaccctcaaacggacaacttgagggggaaaggaacggaatcgtcgaacgcaccgctgatcgactagttttaccgcaaatacgactttctgaatttaaagggtgatatataggaagagcgtaaacactcatcaagcattgctataggattaattacacatgagtggagtatgatgttgagcatgatttatgtagcaataaatcatattgtcaagtatctgcacgtgagaaaataataaatgcaatatttaaataattgaagagacagtacagaaaaagaaaataaggagacaagtcaatttcaggaataaagaatgataaatgcttgaaaatagacagttaagttcaaataaggggaaaagggtatgtgggatagagcatgcttggactaattcacaaaagataagttcgttatggtaaaagcctaaaaatatccccagcagagtctccatgctatcacacccccttttttccctttttaacggggaagtccgggtttcgacattcatgggggaataactcgttttcttttgggaattgagtatttgcagagtttccacctaatggattatggtacgttagggcaccttgagcaattaactcatggactagtttgcattaccagagatttagggtaagggctcgaaataaccttgaggggaaggtattaggcacccctcgcggtccacaacggtgggtcccggccgaacgtaaactatgtggattagtcattctaacaaataaacagtttttaacacgtacttgcaagtaaaaggcatgttttgacattctaagcatatgtatgattcaagtaatggaacaagggaaaaggtttgaacaagttgcacatatataaagaaaattaaatttgtttaaacaacgggagttgggaaagaggggtcctaggttgtttagcctataggatcatacccacacaattcccgataaacactcctcaacaaggggatacacgtgacattagcacgtagtcatcatattccttactacccaattccctccccttggttatagcctaaaatgttctagcaaccttgaaagataccctatgcgtgcactacccgtcccttcctcgtggccctggaggtatttaggaactctaatttaggtagttgtagaccatcctaaggtttttaaaggacaaaagtgtaggcgtcaatcaaaacaattaggactgcatttaaagaggaaataattaaaggctcacatttatctccacaaacataacaagtaagtgtacgtatcaaacaacagtttaaagtatttaagagaaaatcctagaacatgatatctaggtgatcagagattatacagtattgaattagaatcaatgtgtctaaggacctattcggcttgcctactggttttatacccgttgaatgtgagcagtcttaaataacaaagcgcaattttatagttgcaagatttttaatcgccctagaggctttcctaggtgtataatagtgatgtcctatgaacatgacatctatattgattaggaatatagaaaacagtaagccgttttaaacgaacaacttgagatcctataggcatgctttctaacagtattaatttaaggcaatgttttgaaaacttattaaagaagcggacatattgattaattaaaccgattcagaataaacaaacatgaattgaactgacttttctaactaaactgttttaagtcttataggcatgatttctaattgagcaaggtaaaacaaacaacattcatttaaccaacgtgagacccctataggtatgatttctatagagctgattttaaccctgtaagcacgtgatttttgccctatatgagaattactcccaaaaaattcaaaaataaaataatttttctaggtgtgcaatttttgtgatattttgtgtaactatttgtatgtttgtctgtgcatgtttatttgttaaattattaaaaatacaaaaatatgtcgcattttgcatgtaggatttaattctacaatttttagtaattaagtttgttttacaaaaaataaaaatttacaaaaataggcatcgtttgtatttttagcatttaatgtccaaatatacaattttatgcttaattattacttaattgtgcgttaattgttatttggagttaatttgcgcttttataacttaatttagttcttaataataagttaagtatttttataatttagttttagaaaaaataaaagaagaaaagagagcgaaaatataaagaaagtcggaattgggcctcttctttgatttcaagccacaggcccaaaaaatgacccaatcttcccaaacgacgcagtccattttgaactgggtcgacccagtccagtaccaataacccaactccccctcttcatttttcatttttatttttacaaaacaaaaaaaaatgaagaaaaccctaaaaaactaagaaaccatccgcccccccccccccatttttgcttcttcttctccaaaatatcaaacaccccaaacatccatggcagcccttctgcctccccatcgacaacacatacacacacatcaaacacaaacaagctccaccaccctcgcatccaaatagaccccgtcgcgtctgccttcatcgtcttcgtcgagctcaagcttgagctcgacatccatggtcgcctctgctgcttcgtcgtctttcttcggcaccaacgaaaacgtcaagatgcatcgacttcaaaggattgcttaaaacagtccatcgccgagttcatatgctgtcatggctgatgcctcgccgtgcctcggctccttcatcgtcttctgcttcacctcccatgctgccgcgtccagcttcgacgagcagccatggttgctccaaacggatgttgctgctactatttcagtcttcttcctcatcgacgaccttagttgttgaacgcagcagcatgtcgacgaccatagttgcttcagctgcgtcgaccactgccttcctgcgaccactcgtttccatggctgaaaataggagaacaccctcgccatggccggtcgctactgctgctcacgcagctgctactgcgtcagccttctgctccgcctcccaactgcttttgttttgttcgctgctgcccgcaccctttagtcggcgttgcttcagtttgcttcttagattcgttcgtcgtcgtttggtcgagcttttgtcgaggtttgtcgaaacagtccgtacatattcgtttcaatccggtgagtatattttgagttttattttgtccgtatttttgttttgatattttcgaatctaaaatcggcaaatgtttgttttgttcatgtccatcgtttgaattaattttttttagtttgttcatgtgctttgttaaattaatttttcagatttcaaatgaaagataattaattgtttttcatgttatttcatgtttgtattgttgtttagataaatatttgttagtttaatgtttgatagattcaaattgaaatttaattaattatttcttcaatttgtttcatgttgttatatattttccagaaattattaatgttgtttgagtcatttaatccgtcatgtttgttgttttaaaaaaatggattcattcgtgttcatactttgtttggttgatcttgaatccaaaatttgtatagtttgatttcttgtttatcatttatgattatttcttgaatttgtctcataatcttgtttaagtttaatataggaattgttggttgtaatgttgttagagttgattttaagttcaatattattgaattaagaaatctaaatatacttgtttgttgttattattgttgaatctgaaaataggttgtttgttgctaaaaaaaaatattgttcaatcaaattttagttgttctttgttgttcaatttgtgttcatgtgatttgttgttgaaatgttgaagaaatcatgttcatgtgatttgttgtttaaatttctgtagaaattggtcatattggctatattttggttgaatgtgattaattgatttgttatagctgatgggttagtttggtaatttgcagtacgttcaggggtagtttggtaatttcagtaaggtcggaggggtagtttaggaattgtacatttttgtaattttttatgtgaagcatgggggacaaaatgtaatggggtgagttgtgatataattgtttaatataaaggggggacaagacaaaatttagtggggaggaatcttgtatttgtttagtgaaagcatgggggacaaaatataatggggtgaggttgatatatttatttaatgtaatggggatgaatgggaagataatgggtttggtaggagaaaatgggttaattttaattgattaaaagatttatgggatgagattatatataggaagtcttgaacacacaataaggatggacagaagagaagaagagaaagaacgaatctgaaataagagaataaaaagagacaaaacagaaaaacacaaggggagagaaaaaaaagagctgaatatttaagagagaaaaattccgaaaaatattcaaactttcaaataaaaaaaaatttaacaaaaatcttcggctttctttcattgtttgaaatcagcattaattgttgttgtttcataaaagttggaagcatttgttttgggattactactccaccggtgtgttactgggttgttattgttgctgggctgttgttgctgtcttgtactgttattactgctgctgattctcatcttcattttcttttgcttccaatatcaggtacacaactgacacacaggttattgtaatccgaatatgaagcatgaatacgaaaaatgaagaattgaaattctgaattatatttaattatattctgaattttatttgtatgtacaaattatttagcttgcaaaaatcagaatcatgtagctatttaatacatatagtggaacatccgacgataatttaacatatgaactatctacatatattgcataaaaataaataaatggtgtagtaactccgtcaagtaaaaatcaaacgaataggccatctagtaggaacttggtagaaatattgtttagttaaataatattggttaatttcagcatgtaaatggtctaggattaaaattagattgctatttttttaaatttgacaaactgagaacatgcctagtataatgtaactaggtaataacatgtaaataaattaagatattttctcttttattttgtagagacaaatttcaaataaaaaatgtaggcattttaggactgatttttttaaaaataaaatgagatgagcctcgcccaataaaatgcaccaattgcggggccctcgataaatgtttaattgagtaaatagaattcgggatagactgtttagtgaattccacggtcttacccataaataataatacgctaatcgctttaggcacgattttaacaataatacattcttaagcacgggtgcgcattcatgcgacccaaatccaaatcccaaaacattgaataaaatgtgttccggattgcgggtgcacttcatgtgacgtaatccaaagacatgttttaaacaatgttcacattcttgtaaaaataaaataaataatgataaaagcggtaaaaagataaaacttgcacataagttcatatttatataaaaatcagataatcaagccgaatataacagttgagcgaccgtgctagaactacggaactcgggaatgcctaacaccttctcccgggttaacagaattccttatccggattattggttcgcagattgtaatatagagtcattcttttcctcgattcaggattaaaattggtgacttgggacaccctaaatctcccaagtggcgactctgaaataaataaataaatcccgtttcgattgtcctttaattgaaaaaaaactcccttgtaccctagcggggcggaaaaaggaggtgtgacagctctggcgactctgctggggacaacaacccagaatctctggttcagggttcagaattcgagcttagataaattgttgtattgaattgtatctgattttcctacatgttttatgctaaatgtgctaaatgttaccgcttttatattatctgaactgtatataaactgtgccgacacccttctctcttcacctccggggatgcgcttactggttgagactccctattctgttagtgtcataccttgaaataagaaagaggtcggacaagttacgaagtcggatggccttttggttcccggtaagttgccccctcctcgactcgagttgtccgctcgggtacacagtctagtactccgactcaggttttgaacataaaataacatgacttcatgccggatccctagtaggaacgattatttgcatcatgttgcatttgacttaggggactcaacacaggggttgggtctgtctagggctagcaacctgaaatgaaaaagaccatcttgatgcatcctatgtgctacatgttgcattccttcaagggtaaaagtgtcatttggcggaccaatgataattgagagtgaatgaaaaggaaaaaaaaagagggtgaagtgcgaagataaagcaaatagggcccggttatgttttgttacatttttatttaaaaaaaacaaatttaaaaaaaaatgaaaattttttaaaaaaaaattctttgcactttttatcatttttgaaaaatcaaaaataaaaaaaagggaaaagaaaatccaaaagattttacatgtttcatcaccttttaagaaaaagcaaaagaaaaaaaagatatgttttctctgaattagttatttttttaatttctcacccgtatccaatcggcccgaactacgtgggtttgattctcaccggatgtgagatacgtaggcaaccctcatcgggtccaaccccaccttttgctaaaatagccaaaaaccaataaataaataaaaaacgtgtcaaaattttaattttgtcataaataagtcgggcggtgtccaacctccccttttgctaaaatagccaaaaaaaataaaatatgtcaaattttaattttgtcataaagaagtcgggtgacgctgttttatcaagacatagccgaatgttcccgaaggggacgccggaaggctgactttgcataaacagccaccttttgggtcatgtttaggatttttggtccagttgacccacacaaccttaaaaatctttgtccccgaagcgttgaaaggtcgtgtttgcaacaccaggtttttattgtaatttgaaaaaaaaacaaaaaaaaaacaaagagtgagcggtcaggtatttttagtcaaaaataagccaagccagcttcgaccgcgtcttaaaccgttcttgccgaaatagccttagagtatctttcagtcgttgaaaggctattttcgtaaaagaatgagaagtttgtaaagtgtcataaaataatcctccccggcctcaaaattcatatgaaattgggaaggggccacatttgagaaataaccgtttggttgtctttgccaaacgggaaaagaagctggtcgtttgtttttggagtttgtaaatcttttaattagaatatgtgggttgtttgatttttgagtttgtaggtcatcttcaaacctttgaaacccagttttgtttaatatgaaaattgaaaaaaaatgattagtattgtttatcttttattggtccgaactacgcaaggtctaattcatgcggggtcatgatacgtaggcaatctccataagattcgaccatgacaaaaaaaatatgaaaaaatttttgaagaaaaaaatcaaaaaaaaaatcaaaaaaaaaatcgaaaaaagaagaaaaatgaaaaaaaagggaagagtgttgttaataatgaggaccgactgagtccattctaacctgttttgctttgaatcacaaagaaagttaggtggttggtttgtggtaagccggaaatacaagacccagaagcacactttgcggggatcaggccttataacagaagcactcgaatcctattgggacttgttgactaaggttgatgatatcgaagttggaaatggtctggacaatactgatgcaaaactcagtggctaaagatgtcaattttgataaagtgggaggacactccgttccttggttagcaaaagagaagctggtggtggcttattttgttgtcatttctgttgtccggattattcttcgggttgtaatccgaatatggtcttgtgtcaaaccttcttatctttccattttgtcatatcagtttgtttaagttttgtctaggctattttaggattttattctggtttgttttgtttgttttattattcaaaccatttcgccggtagtctaaaacaaaagccggtctttattattttcagtcatcctttttgtttagtccttttatcatttttgttcaagcgccgattctcgtgacatgacatgcgcacacagtttgggcctaatcttaaaatgttaatcataaaaccctgggaagatgatcaaagcatttaaaggaaataagaacggtttgagattgtttgaagcccgagtcatgtgaaaccggggcaagtaaaacataaagaaaaccgttaaatgcaagattcgccaaattagcatgagggtcgttcatgagagtgagagtgtcgcccagcagtgctttaatgacaaatgaaaaagcaagtgtttaacataattgtcaagtccagcaccatcggaagagactataaatctatgttcaattgtgtcgtttgcacttggcatgttttgaagactggaatgacgaaggcattttgttctgctacctaaacactttatccttcgttaccccttttgagccttatttattttctttcataccccttgtccggaatcaatagcaacgactaggaaatacgagcctggaaggtaaagaaaaaaaaatcaaaaaaaaaattgataacaaaaaaaaaacaaaggaaagtcaaatgaaaacagaggaattgggaactacgtttgacctgattcctcaaagaggatacgtaggcttttcacggctcggtcatagttttgaaaaatgaaaaatcaattaaaatatccctaagcaagaaactgggacaaaggttgcaaataaatctagtttccgaaagttgtaattttgaacccagaatttattttgtatttttgagccttttataccctttctttctagccctatccaaaaacctacattacggtccaaagaaagaccttctgatcagttttcaaaagatgctaagttagacaaacgagagtcttaccggcgaacataacattctgttccacagcagaaaggactctaatctccagcagagagggtcataccggcaacactccaaatccccagctggaaagtgatacaaatgagagagtcttatcggtgaaaaccttcataggcaccataaggcgatgaaagctgagagaaaaaccaaaatgagagaggcttgatagtgaaaacccttcgggcactacaagtcgaataagattgagaaccagatgaggaattgccaattgaaggtcttgaaagacgactgacagcagaggataggccacatgtgcatgtcatgaccattagagtcggtatctgcgtttgataggtttttatttaaagtttcttttgttaaagagtcatcgttttcctttgtcttttattctgttccttttatctttttcctttcatagaaaaattccccagtagagcctgtttggtcaaaaccagtgggaaatgacttcaaaatgggccatcaactctccaatcatgcaagatgagatctgactagtacatccaagtggtatagtcagcaaggaacaagcgcgaggccagtgtcaaaaaaaaaatatccccagcaaaagggagttgacaaaaggattgacgagtgtcaagaaggatatcccagccgaaatcaaaggttgttaaacctcaagaccaaggcctgtggacaaagcaaggagagcagtgagcatgatttgggaaattcatacgatactaaaagatcggtgaagtgcaagtttccaggctatgtcacaaaagaaagggattatccccagcaaataatatcatccccaacaagttgtggaacaaagagcaaggaaggagaaagggaaaaccagcccaacaggagtatcacaaccaaccaccgcgttttgaactaacaaattttgtttgatttgaaacaggtaaaggaaatggcattgatgacaaaaatgcatgccacaagggatgttgtcaaactggggcagaaaattttcttttcatttagaaaattttctggaagtcaggtacccattcggggaagaataaagataatgccagtctcaagggaagtggtcttagaaccagtgttgcccccaacataataagtttcaatggaggaagttgttccccagcaaagggatgaaacttgagctcagaaaaagcaagaggccagcatcattcccaacagcctttcgaagagtgaagcactagttctgaaggaatcaaaatcccccagcggtgttatcctcgacagtgttatccccagctgataatattttaccccccaacaggtaagtaaataattccccaacagtgttatccccagcagtttcgaggagtccaacacaagtttgatgaaagtcggtatcctcagcggttcctttcggggaaagacaaaacgagtcttaagggaggtagtcttcgaaggaagaagctatgcaaaaaaaaaaagagaataaaaaaaaaagtttcgggcaacctagagtgggtaagtaaaaaaagggggaaaagtcatccccatcaaaataatccccagcagtttcgagggaagacaacacatgtaagtaaataattcaggaagaaggaaatggttcacgcataggaaatgcatttcctcctaagtttattttttttacccataggagatgcatttcctcctaaagtttagttttacccataggagatgcatttcctcctaagtttatttttacgcataggaaatgcatttcctcctaagtttagcttcattcataggagatgcatttcctcctaagtttaatttcacccataggagaggcatttcctcctaagtttgtttttacccataggagatgcatttcctcctaagtttagttttacccataggagatgcatttcctcctaagtttgtttcacccataggagaggcatttcctcctaagtttagtttcattcataggagatttcctcctaagtttaattttacctctaggagatgcacttcctcctaagtttgtttttacccataggagaggcatttcctcctaagtttgtttttacccataggagatgcatttcctcctaagtttagttttacccataggagaggtatttcctcctaagtttagttttacccataggagaggcatttcctcctaagtttagttttacccataggagatgcatttcctcctaagtttgtttcacccataggagagacatttcctcctaagtttagtttcattcataggagatgcatttcttcctaagtttagttttacccctaggagacgcacttcctcctaagtttgtttttacccataggagaggcatttcctcctaagtttagttttacccataggagatgcatttcctcctaagtttgtttcacccataggagaggcatttcctcctaagtttagtttcattcataggagatgcatttcttcctaagtttagttttacccctaggagacgcacttcctcctaagtttgtttttacctataggagagacatttcctcctaagtttgtttttacccataggagatttcctcttaagtttgtttcacccattggagaggcatttcctcctaagtttagtttcatttataggagatgcatttcctcctaagtttagttttacccataggagaggcatttcctcctaagttgttgttgaaatcaggagtccgcctggagaatagagacattcaattttcaatttagcaatcaggctcccacctggagaataagggaatacagttgaagtatcagcaatcaggagcccacctggagaataagggaatacaattcaaattttaagtaatcaggagtccgcctggagaacagagacatacttttcaagtctgatgtcaggagtccgcctgaagaacggagacacacagttcaagtattggttgatgtcaggagcccccctgaataacagaatggcgatttattggttgaagttgggagcccgcccgtataacagaggaatacattcagcattaattttcaagtattgaagttgggagcccacccatataatagaggaatacatttcagtctttaattttcaaacattgaagttgggagcccgcccagataacagaggcatacatttcagtctttatatttcaagcattgaagttggaaacccgcccagataacagaggcatacatttcagtctttacatttcaagcattgaagttgggagcccgcccatagaacagaggcatacatttcagtctttatatttcaagcattgaagttgggagcccgcccagataacagaggcatacatttcagtctatttcatttcaagtgttgaagttgggagcccgcccagaaaacagaggcatacatttcagtctttatatttcaagcattgaagttgggagcccgcccagataacagaggcatacatttcattctttacatttcaagcattgaagttgggagcccgcccatagaacagaggcatacatttcagtctttatatttcaagcattgaagttgggagcccgcccagataacagaggcatacatttcagtctatttcatttcaagtgttgaagttgggagcccgcccagataacagaggcatacatttcagtcttttcatttcaagtgttgaagttgggagcccgcccatagaacagaggcatacatttcagtctttacatttcaagcgttgaagttgggagcccgcccagataacagaggcatacatttcagtcttttcatttcaagtgttgaagttgggagcccgcccatataacagaggatcaagtcagaggacaataaaacagagggttacaataggaatccccagcaggaaacaataaaattccccgacactgggaagcagaaggttgcaataagaggtcccagcaaaaactcaaatgcatgtgtcgaaaggaagaaaagcatcggaagaaaagcaccggaaaaaaaatgcaacagacaagaaagcaaggcaacaaaaacaaattgcaatctagcctagcttcttgttttcttttaagcacagtgtaacaaggagatcggtaagcagtagtaatagcatgcaacaacagtaacattgcagtcccacggtagtcccagctaccaaaacttcccgaactacattgacctgattcctgtttagcccaggatatgtaagaaacctttgaagcaaaggttcggtcaaatctttttcaaaaaaatgcttcacacggagtactcggatgggcaaaaatcgctcgctttatctttgcacgaaaacccttcgtgtcttcgggcaaagaggggcagctgtaaacacgtgatttttgccctatatgagaattactcccaaaaaattcaaaaataaaataatttttcttggtgtgcaatttttgtgatattttgtgtaactatttgtatgtttgtctgtgcatgtttatttgttaaattattaaaaatacaaaaatatgtcgcattttgcatgtaggatttaattatacaattgttagtaattaagtttgttttacaaaaaataaaatttacaaaaataggcatcgtttgcatttttagcatttaatgtccaaatatacaattttatgcttaattattacttaattgtgcgttaattgttatttggagttaatttgcgcttttataacttaatttagttcttaataataagttaagtatttttataatttagttttagaaaaaataaaagaagaaaagagagcgaaaatataaagaaagtcggaattgggcctcttcttcgatttcaagccacaggcccaaaaaatgactcaatcttcccaaacgacccagtccatttcgaactaggtcgacccagtccagtaccaataacccaactccccctcttcatttttcatttttatttttaaaaaacaaaaacaaaaaaacaaaaaaatgaagaaaaccctaaaaaactaagaaaccatccccccctatttttgcttcttcttctccaaaataccaaacaccccaagcatccatggcagcccttctgcctccccatcgacaacacacacacacacatcaaacacacacaagctccaccaccctcgcatccaaatagaccccgtcgcgtttgccttcatcgtcttcgtcgagctcaagcttgagctcgacatccatggtcgcctctgctgcttcgtcgtctttcttcggcaccaacaaaaacgtcaagctgcgtcagcttcaaaggactgcttaaaatagtccatcgccgagttcatatgctgtcatggctgatgcctcgccgtgcctcggctccttcatcgtcttctgcttcacctcctatgctgccgcgtccagcttcgacgagcagccatggctgctccaaacggatgttgctgctactgttttagtcttcttcctcatcgacgaccttagttgttgaacacagcagcatgtcgatgaccatagttgcttcagctgcgtcgaccactgccttcctgcgaccactcgtttccatggctgaaaacaggagaacaccctcgccatggccggtcgctactgctgctcacgcagctgctacagcgtcagccttctgctccgcctcccagctgcttttgttttgttccctgctgccagcacccttaagttggcgttgcttcagtttgcttcttagattcgttcgtcgtcgtttggtcgagcttttgtcgaggtttgtcgaaatagtccgtacatattcgtttcaatccggtgagtatattttgagttttattttgtccgtatttttgttttgacattttcgaatctaaaatcggcaaatgtttgttttgttcaagtccatcgtttgaattatatttttagtttgttcatgtgctttgttaaattaatttttcagatttcaaatgaaagattaattaattgtttttcatgttatttcatgtttgtattgttgtttagataaatgtttgttagtttaatgtttgatagattcaaattgaaatttaattaattatttcttcaatttgtttcatgttatatattttccagaaattattaatgttgtttgagtcatttaatccgtcatgtttgttgttttaaaaaaatggattcattcgtgttcatactttgtttggttgatctagaatccgaaatttgtatagtttgatttcttgtttatcatttatgattatttcttgaatttgtctcataatcttgtttaagtttaatataggaattgttggttgtaatgttgttagagttgattttaagttcaatattattgaattaagaaatctaaatatacttgtttgttgttattattgttgaatctgaaaataggttgtttgttgctaaaaaaaaatattgttcaatcaaattttagttgttctttgttgttcaatttgtgttcatgtgatttgttgttgaaatgttgaagaaatcatgttcatgtgatttgttgtttaaatttctgtagaaattggtcatattggctatattttggttgagtgtgattaattgatttgttatagctgatgggttagtttggtaatttgcagtacgttcaggggtagtttggtaatttcagtaaggtcggaggggtagtttaggaattgtacatttttgtaattttttatgtgaagcatgggggacaaaatgtaatggggtgagttgtgatataattgtttaatataaagggggggcaagacaaaatttagtggggaggaatcttgtatttgtttagtgaaagcatgggggacaaaatataatggggtgaggttgatatatttatttaatgtaatggggatgaatgggaagataatgggtttggtaggagaaaatgggttaattttaattgattaaaagatttatgggatgagattatatataggaagtcttgaacacacaataaggatggacagaagagaagaagagaaagaacgaatctgaaataagagaataaaaagagacaaaacagaaaaacacaaggggagagaaaaaaaagagctgaatatttaagagagaaaaattccgaaaaatattcaaactttcaaataaaaaaaaattgaaaaaaaatctttggctttctttcattgtttgaaatcagcattaattgtagttgtttcgtaaaagttggaagcatttgttttgggattactactccaccggtctgttactgggttgttattgttgctgggctgttgttgttgtgttgtactgttattactgctgctgattctcatcttcattttcttttgcttccaatatcaggtacacaactgacacacaggttattgtaatccgaatatgaagcatgaatacgaaaaatgaagaattgaaattctgaattatatttaattatattctgaattttatttgtatgtacaaattatttagcttgcaaaaatcagaatcatgtagctatttaatacatatagtggaacatccgacgataatttaacatatgaactatctacatatattgcataaaaataaataaatggtgtagtaactccgtcaagtaaaaatcaaacgaataggccatctagtaggaacttggtagaaatattgtttagttaaataatattggttaatttcagcatgtaaatggtctaggattaaaattagattgctatttttttaaatttgacaaactgagaacatgcctagtataatgtaactaggtaataacatgtaaataaattaagatattttctcttttattttgtagagacaaatttcaaataaaaaatgtaggcattttaggactgatttttttaaaaataaaatgagatgagcctcgcccaataaaatgcaccaattgcggggccctcgataaatgtttaattgagtatttagaattcgggatagactgtttagtgaattccacggtcttacccataaataataatacgctaatcgctttaggcacgattttaacaataatacattcttaagcacgggtgcgcattcatgcgacccaaatccaaatcccaaaacattgaataaaatgtgttccggattgcgggtgcacttcatgtgacgtaatccaaagacatgttttaaacaatgttcacattcttataaaaataaaataaataatgataaaagcggtaaaaagataaaacttgcacataagttcatatttgtataaaaatcagataatcaagccgaatataacagttgagtgaccgtgctagaaccacggaactcgggaatgcctaacaccttctcccgggttaacagaattccttatccggatttttggttcgcaaactgtaatacagagtcattcttttcctcgattcgggattaaaattggtgacttgggacaccctaaatctcccaagtggagaatctgaaataaataaataaatcccgtttcgattgtcctttaattggaaaaaactcccttgtaccctcgcggggcggaaaaatgaggtgtgacaaaccctataggcacgatctctattattaaagccattttagatcctataggcatggtttctaattgtgtgggagtaaagcaaacataacaaatacatttgaatccacatggaccctatgggcatgatatctacccaatttgcccaatatacataactaccctccctttttcacttatcaccccactgtttatttacaaataattagtacaggccaatgaattgaatagaaattacatataaaagaaattaatctatagggagcctgaagtaggcccaagtgatttccaagcctccagtagtctcaaatacccaaagttacatagccaaattcatgtctaggtgtatcagagttccctaaggacctcaatgatcccgagcaatactcacacctagacctttttcaaaaataattggtttaggtgcagtgtggaaatgccagctctgacatgccagagttcagagagatctcaagggtctcaaggcagtacacatatcagaggggcaggacatagtattctaatagtaaatggaagtgcatagtggtttgaaagagtttaatagaaaggttttaggactgaaaagaacttctgaaaaccattggtgataaaatagtttgagggaaagtataaagaagcaattttgtaatcagaaaacaagacaaagatcaaacaagctttaggaagcaactttggcaagcagctttcacacaaagggaagagggattgggaagatagagagtacaccttaatgaaccatacaaacaataggatatagagagttttgagggggctctacagatgtagcaaagatcacatcagaaacatgctaaagacatctaaaccacacaactagaaccactttaaggagactgactggcttagtaggagtgaaacagaacatgcaaggacttaaatggacatactaggtaagtgctaacaagtgtaggcatgctagttacatagaagcagagtctaaaaagaaacagtagctagttaaacacgcttaagttgtatatgtagacatgttaaacaagatagcaaacatgcaagtaaagtggaagtacactaatcacaatttgaataggcagtattagacatgcttgaacaagcagtaaacagaaacaagaatggacattaggccacttgaactaaagcagtaagtaaagacataggttttgatttaaaaattaatcagaagcatacctaattaaagaatgaaaaacacaagatgtgagaaaggcagtgtgcaacttccagcctgggcttgcagccggctagaatggcaaatatcacaagtagcaaagagagcagaaatagagcctttttgagtgaaaaagtagtagttttgaactattgttcgttctccagaagttaaaataagagggagtttatatagtaatcaaaagctttaaaaaataaggcaagggatcaattaagttgcaatcatgaaattcatggaatcaatcacacatgtaaatcagtaagtcttttctttaatcacgggataaccaattaacgataaaagcctgatagatatttaaggaaaagaatcaagtaaagtttggggtatagagtaggtaattaaaggtaaatgaacagaattttctattaagggaacaatcgataagaatcgacaaataacaaaaaaggcaagggaaaactaattaaggcaagaaattcaatcaaactgagtagagaggtaagaatcaaaagttttgttaagaaaaagagttcaaatcaacccaggaaataagaacttcagaacagtcaagggtgaaatcaaagagaaaatcacgtaaagatcagcaagttttgctgacaacttaaataaagcaagaaataatagttagaataaatataggcatatagaatcaatggaaaagttgaaccaagtactcagtagaggcatattagggtaagtaaaccacgagacatctatatggctaaagaacaattacaggaaccaaggcaagaatacaattagtacacgagtactcagaaaccaaacaaagaatgtcaaaaaattaaggcttttagaataaacgagttgaaattagagaaacctaatgaaatcggttaaacatacatgaaacagaagattaaacacccaaatcatcaaatgttttttggaaaaagagatttctggaaaccctagtttagagaaagatgaaaaatcattcgaaaatcagacgatccttgtaaataatcaaaggttattgtaaaaatcatatgaaataggtccaaacatctcagatcagtatagatctaagaagttcagaagaaagaaaatatggtttcgagaagaacaatcacagagatgaagaatcaaaccaagaaacccatagatataggaatatctcacttggaatcaaactaggacatgctgaaataggcgagaaatggccatagatgcaatcaaactaaccctgatcccttaagaaccctgaagatggtgataccagtacaagagaggatactagaggcctcggggtggtgaggaacaacatggaaggtagcaaacgactggtgatgtaggtagattagggttagctttaagagcatttgagagagaagagggatttccgggcggcggacggtggcaaaatgaaaggattttggggggtcgtttggtttattttaggtaagggtcaatctggaccattgatcacaatgatcaacgaccaggatttgcccgggttattgggttggggcagatgggtattaggctgcgtatattttggatttaaaattgggcttgggtagtgggttgaattaggaccaaaattgaaataaaaataggacagattttaaatagccacttttaataactaaataaattataaaaataataagtgagttccaaaaatatttttttgtatactaaaatgattaaaaatagttatttaatattttaaaaatataaaagactattttatgcataaataatgtaattatacattagtaagggatattattgcaaagatgtgcaatttagcttaaaaatgtaaatataattacgaaaaatgcacaaaaaataattaaacactatgttggaataaataataaatttaaatggataaatcaccacaaaagtaatttgaaggataattattggattatataaataaaagagaagaaataaattgatttggagcttttaaaattatagaaaaattataaaaatacttatgcatgcttataactgcatatgtactattttgaaagtatatatatatatatatatatatatatatatatataatatgtgaaacaaaattgggtatcaacaataagactcctcatagcctttgttgcttacatggaatttactcttaccagatggacataaagagtgccttcctcaatggctatttaaaagaagaagtgtttgtcaagcaatctccagggtttgaaagcaagtagtgtccgaattatgtgtacaaacttgataaagcactctatgggctcaagcaggctcctagagcatggtatgaaagattatcaaaattcctgcttgagcatgactacaagagaggtaaaattgataacactttattcttgaaggaaaaaagtaaagaccttctagtagtacaaatatatgttgatgatattatctttggagcaactactgataaattaagtaaggaatttgctaaatcgaaatgagtatgatgggtgagcttaatttctttttaggcttataaattaaacaaaattcagatagaactacgatccatcagtagaaatatgtgaaagagttgcataaaaggtttaaaatggaagaataaaaagaaatcgatacttctatagcaacaaccataaaattggatatagatgaaccaggttcatctattgaatagaagttgtattgggaaatgattggttctctttttgtatcttactgctagcaaacatggcattgtttgcagtgtaggtctttgtgctcgatttcaggtaaattcaatggagtcccacttgcctaatgtcaagagaatattgagacacttgaaaggcaccactaacctttgcctttagtatccaaaaggtaataattttaacctagtgggatatgctgatgctaattatgcaggttttcttgtggataggaagagcacctcaggtatgacacactttcttgatttatgtcttgtgtcatgggatattaaaaagcaaagttcagtagccttatctactgctgaagctgagtatgttgctgctgcttcatgttgtgctcaattgttgtggatcaaacaacaattaatggactttggaatctatgttagttgtatccccattttttgtaataacactagtgcaataagtatgacaaagaagtcaattcatcataagaggactaagcacatagatgttagtcatccttttttgagggataactatgagaaaggcttgattactatacaattttgtgctactaacaagcaaattgctgacatcttcacaaatgccttaagtagagatgattaaaatcacctaaagggccagttcaaggttaaacaaaaaaaaacaaaaaaaaacaacaaaattttggttagaaagtctgtacattgtacataagtagattaaatcttgatcagtctcatacattcaatagtatatcttgttccatgtgttaaaataactcattaatctctaatgttattttctttattttacaaatttagatttacacaagaaaattattagagaagaacctggtttatcaagataacacggtatgctttctacactctgcatattttgaaataataatatttgaatcatgagcaaagtcctacctaagctaaatttcctttgaacttatccaataagtgaaccagttcagtgcatagattcccacccaaattaagtcacctagattctaaggaatactccatcgtctagtcaaaaactgaaatttcagtttcattagacttctaagagtctgaaaaagcctattgttacccattaattactctctttaaattgatcatcatcatccctgccttcactccctaattttcaaaccgtcaaaaccttctccatcttctctcattctccaaaattcaatctatctttcttcattcttccaaatccaagatactaacccctctgataatcatggtactcccccaccaaactcttcatcttcaaccactccttagcctaagaaatggagagttaagatgcttgctcacaagaacattgctgggaaggaattatcaaagaaattgaatgcacaattaaaatctagccaagcccaggaaccctagaaatttgacaactccttcaagtcagctactgagggggaagaaacggggtcttctaatactgaacaggtaacttctggaataaatactatgaatgaggttatttctgtgttagttgaaaatttggagaataggtttgttttagttggatctgttgtggatgtagaaactccaaagtctagaaagagaggtgctaaaaatagaaaggaaaaagactaggagagtgagggtattcgaagtgaagaaatgggaatggtaacaaaagtggttgactcttcacccacttctgatgaaggaagaatgactaattgtggagcagaatcagataatttagaggaaaacgtcaagaaaatagggggaggtgggtctagcgaagccgttgaagggctggctaaaattgggtaaaatatagataaacctggttcaacagttgatgaaaccctcacagacctattaaagaaggtgagtgatagctacaacccaaagaattagagaacttcactggctaagacccgtggcactgctagggctaacaagaaaaggaaggttgtccccctctgacactgttgaagttcctccaatggcaagagccacaagaagtcaattaaagcagaatgaggaagatctacagagagccttagaataaagcaaaaagaaaaggatggataaagggtagaagaagataggaaagtctgttgagactattgatgtggatgagatggatctggtccatcaagatgaagatgtgactgctgaactggaggttcagactcctaagcccaagaaatccaagactttctccaagaagtctacttctatgtcaaagtctgctgaactatccaccctggcaaaaaggaccaggtccacagtgaaaaccatacaagcaaaagttactgaaggagaggcgtggagtagtgaagaggaagatgaatcagacagtgaaaaggacaagatggctaagtttggcaaaagaactattctgaagggtagattcctcaaggatttggaggaggaagggatagtattgctgttggaaaaattagaagtacaaggctggaaggacatggtcctttagatggatggcaagttggctagggatgaaatagttgaatttatggcaaatgctgcagtgctagatggaagggatactagcttagtgaaaggggtgcaaatctcttttgatatgaaggagttgggtggaattctaggtgtacatgatgaagggtacaataattacaaaaagcttaagtggcaaagcctagaaaattttcctactgcccttgccatcaccagaaaattcagtgatcatgagaaggaaagtgtgcccaagactgtgtacaagagtgaaatgaagtcaccccacaaggttttgtttgaatttgtcatcaaatatgttctgcctaggtatgagaggaggcacactgcaaacttcatggacttggttctaatggagtgtctagattgtgggaagtagataaattggcctggatttataatccagtttcttgatagggttatcaatggtaccaagtctcattctattccctatggtttcattcttacaactgtgctttcttgttttaaggtgcctttgaataagtgtgaggtggctacaagcaaagatcactttggggcgaaaactttgattgcttgtgactatgaggtccatgccactcctaatgaacctggttcacatccaagaagataccagtaaatagctcttggtataggaaagtgaggcaaaggaagctaagatagcaaggatgaagacacggttggctgaggtagaatctgagagagatgctctcagaacaaaacttgcaagacaaaaggagaagaatgatggaatttttcaagacatgctgaaacttctccaagaaaataacccagcacctcgttcttccaagcctaaagttcctagcctagtgtagttccttcagtgacccagcttgggatgtttcttttgttgatgtttgctcatgttttcaatatttttatttccttttatgtattgtggaagaatcatatcaactatcaatgaaatcaatgaaatctactggtttttgttctaactgtttgtttttatttctttgatggttgaaattcttagcttaatcaatgatgattaatccatgattgcatttgggatagcccgagtgtacatgagtaagttttacaatccgggtattgcacatttttatgcactttttctatgatgccaaaagggggaaaataagttgtgctttaaacaagcgatatttagctttgaacatgtgatatttataaccttatgaacctggtccttgatgataagtgataacaaggaaaaatatttctaacattttgttgatattaagctgagtttaaacagggcctaagcttatgaaaagcacatagtttgtcatcatcaaaaaggaaaaatttattggcccaagtgaaggtttgttttgaagactgacaaaggaactcaggcatgagccaggtctatcctttgtgaacacgggcagagttgtgcatgtgggatgcacgtgatggagataaacttaacttggcacaattgatatctcctgatcggaaaggttgtataattgattaggagaaggacttcttactcaaagagaacattatccaagatagggaaggagtcagaagttgggatcaactagaacttttccactaaggaagagtagtattagaactctagttatttgttcatatactaactctatatattgtaggatgttctcatttacaggtaatgtacaaatgcagaagttaaacaagaattgagagcaaaatagcaaggcattttgcaagcagtttgtgtgtgattcaagtgtgcaaatatgaatctacatgaaccagatagaagaaccagttccaagtgtctctcttttattctagttcaattatagtaggtgttttcatattgtacctttcagctttatgtagaggcaattgtaatatatactcaaaatattcaatttagagttaacttgaagttgccacaataattagaggttgtgtgctacaacgtgattagagttagtcctaggtttacaaatatttttttgtaaatgcagtttttggttcagtgattttagtggagagtttggaaaaatcctactggaaagtaggtcgtggttttttcaccctttgagccaaatattttcacgtaaaatacttgtgttttttacttttcgcatttactatttctgcaatagtaggttaaggatcacttagaagaatcacgttcttccataatcagtttaagtaaaaaattggacaccacacaaattatcctttgtgtggtattgaagttgaaacatcaatgttatgcgtatgatcttcccacaaagtttaacaaggatctgttcaaaaaattaccctgatttagacccgtggagttctatctccttgttttgtatgacttttcttgtgggaaggtggatggtgttgcgtgtggcagtgttggtggggagagataaggagaaagtagatggtggtgaaaggtgttccatgtctgcaatgtgtgcatatctaatagtaatatacgttaacttaggttcaggtgttcaataggaataaagtttagtttaggtatctaaattaaaaaggcggacaagttccaggggagcatatgtatttgaccttggataaagatgcagattctattttatacaattatgacatgtatcaatcgcctattttgtacattgcacttcctttctgtagtagtaagtgtattcctagcagtttctcttttacgtatttagttttctcattgtcttaagaggtctttggggaattcagttttcctgcgaggatactctatggagtatatgtaatgtttatgatcactgcgactgtttcttaacttaatactagtaaggcaagcccgtgctacgcacgggtccaacactattaacataacttttctgatacaaaagatattttctgtattaagttcaattaacacataaaaacttgagagtttgaaaattggatacaacttctaatgcaattttatttttcgtcatctgaagccaccttcccgttgcaatctcaataaagggaaacctttgaagaaaaaatgagttgaaatctctttatttcatgacggagtaatataaaattataaattataaggttggaaaatcattctaaataacaaaagtgatgaaattcacttgcttgaaaaatgcggaagacaaaataaaagaataacagggttctggttcaaaacattgcgtatacttaaaaaggaaataatacattcaataaatatcactttctcaactttcctaaaacatttggacataaaaaagatacatttactatctcatattaaattcttctaggcacttgatgcgattatataccgcccttttgttggtttcctttacactacaatcacgtaagaacagatcaatataacgcatcaactcttgatgccttaacattatcctctgaactcttatggcagatcaaaggaaactattccaaaaatattttattgaccattatcttcgtattttggagctttgtaaatttgctttatagatgacacaatgttattcctcttaacattattccaaagtttggcgaacttgatattttcacttattaagtccttatatgaagagctagcttacaaagatcaaatgatttgtcttcaacctgcagtaaagagcaacaacttaatgagagaacacaagtgaactcataaagagccattttacaactttcaacaatgtggccgtttagaaatcaaatattccatgtccaaaaaaaccttaaagtacaagaactatttgattatctaataattttggattttatatttcatccaagagtttctaaataaagatataaaatgtcagaatgaaaattcgatgaccaacaacttatgacagaatatgtgtattcattgtgtgtgatgatccaaagggtcataaccggttttctacctttttctgggctttcgaggtcttgaaaacctcatctttagttgcctcgatttgcgtgcatagtccaggcgcgtagccggaaaagcttatgtgttaaattatgtgaaatttgataaattgtggctttaaaatggttaaagttgattttggtcaacattttgggtgaacgaacccggacccatgatttgatggtcccgaaggatctgtagaaaaatatgggactcgggcgtatgcctggaatcgaaattcgaggtcccgagcccgagaaatgaatttttaaaagaaattgttttttgaaatttaatatgaaaatttgaaataaaaatgaattagaaagcattggtatcaggcccgtattttggttcaggcactcgatacaggtattatatgtggtttaagcgctttctatgaaatttggttgaaatcggacgtcatttgacgtgtttcggacctaaaactctaaatttgaaagtttatgaagtttgatagaaaaaaatgatgattttgaggcttgattcattgattttgatgttattttggcgatttgatcgcttgagtaagttcataggatgttattgagttagtgtgtgtgtttggttaggagccccgagggctcgggagtgattcagaggcggttcggggtgtttttgaccttaggaagtgttgcagaatttctgcagtcagtgcccagtcattttcttctatgcgatcacataggtatgtctgcaatcgcgtagagttattttggagtcgcccagttttgttctatgcgatcgcgttataggccatgcaatcgcgtacctctgtaaactcattctatgcgatcacacactcccttctgcgttcgcaattcacaaaaggcctagccccgctttgaccctctatgcgatcgcactcgtcatcccgtgattgcagtgaccagcctaccttcccctatgcgatcgcattccctttcccgcgatcgcatagggcaattccgcccagttattttaaaagtccaaaacagacccattacgggagttctaccatttttcataaaacttgtcttctccaagctctaggggcgatttttgaagctcttcttcattaaagtcttttgggtaagtaatttcccacctatttccttcactcttcttcattaattactgaaattctaaacctaaatcatgaaatcaaagtagaaattaggagttttgggtagagttatgtttttggaaattttgagtgattcaacctgaatttggggtcggatcttaaaataaattatatatttgaactcgtggggttatgggtaatcaggttttggtccgaccctcgtgtttggaccatgtgggcccggggtctaattttggtatttttggaagaatgctaggaacttcatatctaagctatgtgattttgttatcgagtctttattgatattattgaattaattatgcctagatatcgttgtttcggagtcgggttataaaggaaaggcaatatttgagggttgattgctattctttggaccgaggtaagtgtttgttctaactttggcttgagggaatatgattaaagtattgtttgctatttgctaattgttgagtacggtgtataggcatggtgacgagtatctatacaccggagtctagcatgaccgtgcctcttatttgttttttttcggatttaatgatacctcttccttgttaaattcataaatttcatataatgtgaagagtttgaggaagagttatgatttgtacattcttggagcgttggctcgagtgtatcataaatcatgaaagtatatgaaatgattaaacccctttggagcgttggctcaggtggtaaagtgagataagaggtaaaagtgaaagaaagagaaagaattattgaattgctcccttgccgggatgcttgttgctttgttgactatctcccttgccgggatgcttgttgttttgttgactatctcccttgccgggatgcttgttgctttgttgactatctcccttgccggaatgctgagattattgttattgttcccttgctgggttttttttaactgcttaattgtgctcccttgccgggagttagctgtttatttgtattcccttgccgggatttctatcattatttgtctactcccttgccccttatttgtgattgtttcttgggtgaggaagagtgataaagcacgaagggtgatgtcgtgcattgtttgctattgtgaggaaagagtgtaaagcatgaagggtgatgtcgtgccgcatgatgtactattctgtgccgattttattgattatatggtgagtaaagagagtaaaagcacgaagggtgatgccgtgcatatttcatttatatgattgctttggtgaggacgagagcgtaaagcacgaagggtgatgccgtgtatttgttgctttctgattctttgttgatattcgagttatgttgtttctttcattacttgttcttatttgatttacttcgaggttatagatttccttaccctatttgccttgtgattgttgtttgggtgaggaagcgcgtaaagcacgaaaggtgattccatgtattgttttggtgaggacgagagtaaaagcacgaagggtgatgctgtgcaaattgttgactttttattcttcttgacattctggctttgttacttctttctgttattgaggatttctatttgaaacttttagctccccatagcatgctccccccttcttagctgtttaaattctgtatatttccttttattgcatatatctgcataggttgtttttggtaggtcctgtctagcctcgtcactacttcgcctgggttaggccaggcacttaccagcacatggggtcggttgtgctgatgctacactctgtgcatctttttgcacagatctaggagcagcttttggaccttaacaataggatttgatcgggagctgacttcagtccagagacaccaaggcagccttgctgacgtttgcaggcccgaagtcactctctctttattcagtttgttatcttttgtaccgaaacaaacaatttataattttctttcagacgattgtatttagtaaatcttagaagttcgtgagcattgtgacaccaatcttgggtagaggattatgttaaactttccgcatttctattcagtttttatataagttaagacttccgcttgaaattttaattatgttgcctctattacatgttgataattatggaaaagaatatgtgttaaacggaaggtaatttaagttggcttgcctagctcctattagtaggcgccatcacgaccccgagggtgggaaatttgggtcgtgacaagttggtatcagagcactaggttacttaggtctcacaactcacggacaagctcagtagagtttgagggattggtacggatacgtctatatttatccctcagaggctactgagttaggaaaacttcacatctgttctttcttgtcgtgcggttctgtttccccaatactgattgaatttctactccgttctttcgcaaatggcgaggacacgcgcttccttatcgaccgagcagcagcccgagcccccagcagcagctcctattaggggcagagggcgaggccatgctagaggccgaggtaggggcagagctcagccccgagcagcagttccagaggtggagcctcatgttgattatgatgaggaggttccagctccagtaactttggtgggcctaactcaggtcccagagggttttattgccaccctagttcttcaggacgccctggttcaattggtgggccttatggagagagtcacccgaatatgttttcttcctgtagcaccagccacttctctggctggaggaggggctcagactccttctacacgcactccggagtaggtagctccccagattcagattccagcggtttagctagttagggtagttcagccgggtgccatagctcagaccggcgatggagcggctatgttcgtcgatgctttgtggagactggataggttcaccaagctcttcacttctacttttgccggtgcatttactgaggatccccaggattatctagaaagcttccacgaggttctgagaaacatgggtattattgagaccaatggggttgattttgctacatttcgcttgtctggatccgccaagacttggtggagggattattgcttagcgagaccagccggatctccatctttgacttgggagcagtttacagtgttgtttctagagaagtttctccccgttacttagagagaggcctatcggaggcactttgagcgcctccagtagggttctatgactgttacccagtatgagaccaggttcaacgatttagctcgccatgctctcatcatacttcccaccgagagagagagggtgagaaggtttattgatggtcttattctgccaattcgtcttcagatggccaaggagggcgggagcgagatcacatttcaggaggcggtcaatgtggcccgcatagttgagatggttatgtcatatggaggtggtcataggtcggataagaggccccgtcattcaggaagattctgtggtattgcgtctggaggtagagattcgtatggtagaggccatcctcctaggctcgttcagtcagctcaccaggtatcacatggtatctcaggtggtcgtggttctcagatgcattatttggatcagtagtctttcagtgcaccaccatctcccatcagtgcaccgccacttcagaatttctgaggtggtcattcagggcaatagggtcagcagtctcagcagccgagggcttgttacacttgtggtgatatgggtcacatttctaagttttacccttgagcttcgggtagttctcaacaacagggtcctcgccttatgattcaggcaccagttgctccatagcctgcccagccagctagaggcgggggtagaggacatagaggtggaggtagaggtcatagaggtggagctcagaccgccagaggtaggggtcagccaacagccgatcgtcccagggttgtgatttagggaggtagggcccaaccccgatgttatgctttgctagccaggccagaggctaagtcatccgatgctgttattacaggtactattttggtctgtgatagagatgcttcagtgctatttgaccctggatctacgtattcacatgtgtcgtcctattttgcaccctacttggttatacgtagtgaggccttgagtattcctgtgtatgtatctacactagtaggtgattctatagtggttgattgggttcatcgttcctgtgttgtggtgtttaggggacttgagacccgtgttgatttgttgctcttagatatggtggattttgacattatattagggatggattggttgtccccgtatcatgcgatcttggattgtcatgccaagattgtgactttagccttatcggattttccccatttagagtggagagggactcctggtcattctacccgtagtgttatttcgtatgtgaaggctcggtgtatggtcgagaaggggtgtttggcctactcagcttatgttcgtgattccagtgctgagattccctctattgattctgtgaccttggttcgtgaatttcctgtggttttcccatcagacttgccaaggatgccacccgatagggatattgatttttgcatcgatttggctccgggcactcagcccatttctattccaccatatcacatgtccctgctagagttgaaagagttgaaagagcagttgcaagacttgcttgagaagggtttcattagacccagcatatcgccttggggtgcgccgactttgtttgtaaagaaaaaggatggctcgatgagaatgtgcattgattaccggcaattgaacaaggttacaattaagaataagtatccactaccgaggattgataatttgttcgatcagcttcagggtgccaaggtattttcaaagattgacttgagatgtggctaccatcagttgaggactagggcatccgatgtccctaagacagcattccgcactcggtacgggcattataagttcttggttatgtcatttgggttgaccaatgcccctgcagcctttatggatttgatgaaccgagtgttcaggacttatttggactcgttcgtgatagtcttcattgatgatattttgatatattcccgcagtcgggaggagcacgagcaacatcttagattggttcttcagaccttgaggtatagtcagttatatgctaagttctcgaagtgtgagttctggttgagctcggttgcatttctgggtcacgttgtatcagcagagggtattcaggtgggcccgaagaagatagaggtagtcaagaattagcctcgaccagctttaactacagagattcagagtttcttggggttagaaggttactaccgtcggtttgtggaggggttttcatccattgcagccccgatgaccaggttgacccagaagggagcccagttcagatggccggacgagtgtgaggcgaactttcagaagctcaagaccgctctgactacgacaccggtattggttttgcccgcaggctcagggccttatacagtctattatgatgcatctcgtattggacttgatgcagtgttgatgtaggatggcaaggtcattgcctatgcttcgaggcagttgaaggttcatgagaagaactatcctgtgcatgatttggagttggcagccattgttcacgcattgaagatttggaggcactatctgtatggcgtggcgtgtgaggtgttcacggatcataagagtctttagtatttgttcaagcaaaaggagttgaatttgaggcagaggaggtggttgaagttgttgaaagattatgacatcactatcctatatcacccgggaaagtccaatgtggtggccgataccttgagtaggaagtcagccagtatggtcagtcttgcttatattccggtcggcgagagacctcttgctttggacgttcaggatttggccaatcagttaatgaggttggatatttctgagcctagtagagtattagctagcacggtcgcccgttcttcgttattagagcgtatccatgatcgacagtttgatgatccccatttgtgtgtccttagggacacggtacagcgtggaggtgccaagaaggttaccttagatgctgatggatttttgagattgcagggtcaagtttgtgtgcctaatgtggatgggcttcgagagttgattttagaggaggcccatagctcccgatactctaatcatccgggcgccgcgaagatgtatcaggacttgcgacagcattattggtggcgtagaatgaagaaggatatcgttgcctatgtggctcggtgtttgaattgtcaacaggttaagtatgagcatcagaggcctggtggtttatttcagaggattgagcttcccgagtggaagtggaagcggatcactatggacttcgttgttgggctcccgcaggctcggaggaagtttgacgcagtttgggtcattgttggtaggctgaccaagtcagcgcatttcattcctgtggcagtctcctattcatccgagaggttagctgatatttatatctgggagattttttgccttcatggtatgccagtatctatcatttcggaccgaggtacgcagtttatctcgcgtttatggaaagcagtccagcgagagttaggcacctaggttgagttgagtacaacatttcgtcctcagacggacgggcagtccgagcggactattcagatattggaggatatgctccgagcttgtgtcattgactttggaggttcgtgggatcagttcttacctttagcagagtttgcctacaacaacagctaccagtcgagtatccagatggctccttatgaggctttgtattgtaggcgatgtcgatctccggttggatggtttgagccgggagaggctcagttgttgggtacagatttggttcaggaggctttggacaaggtcaggatcattcaggatagacttcgtacaactcagtccaggaaaaagagctacgcagatcgaaaggttcgagatgtggctttcatggttggtgagcgggtattgctccgagtgtcgcctatgaagggcgtgatgagatttgggaagaagggcaagcttagacctaggttcattggtccatttgagattcttgatcgagtgggagaggtggcttatagacttgcattgccaccgagcttatcagccgtacatccagtgtttcatgtgtccatggttcagaaatatcacggcgatccatcccacgtgttagatttcagcactgtccagttggataaggacttatcttatgaggaggagtcggtagctattctagaccggcaggttcgccagttgaggtcgaagagtattcctttggttcatgttcagtggagaggtcagcctcttgaggcatcgacctgggagtccgagtccgatatgcaggaccgttatcctcaccttttccccgactcaggtacttccttcttatgtccgttcgaggacgaacggttgttttagaggtggagaatgtgacgacccaaagggtcatcaccagttttccccctttttctgtgcttctgaggtcttgaaaacctcacctttaattgcctcaatttgcgtgcatagtccaggtgcgtagccggaaaagcttatatgttaaattatgtgaaatttgataaattgtggctttaaaatgattaaagttgactttggtcaacattttaggtaaacgggctcggacccgtgatttgacggtcccggagggtccgtagaaaaatatgggactcgggcgtatgcccggaatcgatatccgaggtcccgagcccgagaaatgaatttttaaaagaaattgttttatgaaatttaatatgaaaatttgaaataaaaatgaattagaaagcattggtatcaggcccgtattttggttccggcgcccggtacaggtcttatatgtggtttaaggactttctgtgaaatttggttgaaatcggacgtcatttgacgtgtttcagacctaaaactctaagtttgaaagtttatgaagtttgataaaaaaatgatgattttgaggcttgattcattgattttgatgttattttcacgatttgatcgctcgagtaagttcgtaggatgttattgagttagtgtgtgtgtttggttaggagccccgagggctcgggagtgatttagaggaggttcggggtgtttttggccttaggaagtgttgcagaatttctgtagtcagtgcccagtcattttcttctatgcgatcacataggtatgtctgcgatcacgtagagttattttggagtcgcccagttttgttctatgcgatcgcgttataggacatgcgatcgcgtacctctgcaaactcattttatgcgatcacacactcccttctgcgatcgcaattcacaaaaggcccagccccgctttgaccctctatgcgatcgcaatcgtcatcccgcgatcgcagtgactagcctaccttcctctatgcgatcgcattccctttcccgtgatcgcatagggcaattctgcccagttattttaaaagtccaaaacatacccattacgggagttctaccatttttcataaaacttgtcttctccaagctctaggggtgatttttgaagctcttcttcgtcaaagtcttttgggtaagtaatttcccacctatttccttcactcttcttcattaattactgaaattctaaacctaaatcatgaaatcaaagtagaaattaggagttttgggtagagttaggcttttgggaattttgagtgattcaacctcaatttaaggtcggatcttaaaataaattatatatttgaactcgtggggttatggttaatcgggttttggtccgagcctcgtgtttggaccatgtgggcccggggtcgaattttggtatttttggaagaatgctaggaacttcatatctaagctatgggattttgttatcgagtctttattgatattattgaattaattatgcctagatatcgttgtttcggagttgaattataaaggaaaggcggtatttgagggttgattgctattctttggaccgatgtaagtgtttgttctaactttgacttgagggaataggattaaagtgttgtttgctatttgctaattgttgagtacggtgtataggcatggtgacgagtatctatacaccgaagtctagcatgaccgtgagtcttatttgtgtttattcggatttagtgatacctcttccttgttaaattcataactttcatataatgtgaagagtttgaggaagaattatgatttgtacatttttggagcgttggctcgagtatatcataaagtgtgaaagtataatgattgaacccctttggagcattggctcaggtggtaaagtgagataagaggtaaaaatagaaagaaagagaaagaattattgaattgctcccttgccgggatgcttgttgctttgttgactatctcccttcccaggatgcttgttgctttgttgactatataccttgccagaatgcttgttgctttgttgactatctcccttgccggaatgctgatattattgatattgttcccttgtcgggtttttttaactgcttaattgtgctcccttgccgggagttagctgtttatttgtattcccttgccgggatttctatcattatttatctactcccttgccccttgtttgtgattgttgcttgggtgaggaagagtgataaagcatgaagggtgatgtcatgcattgtttgctattgtgaggaaagactgtaaaacacgaagggtgatgtcatgccgcacgatgtaccactcggtgccgattttattgattatatggttaggaaagagagtaaaagcacgaaggatgatgctgtgtatatttcatttatatgattgctttggtgaggacgagagcgtaaagcacgaagggtgatgcagcgtatttgttgctttttgattctttgttgatattcgagttatgttgtttctttcattacttgttcttatttggtttacttcgaggttatagatttatttaacctatttgccttgtgattgttgtttgggtgaggaagagcgtaaagcacgaagggtgatgccgtgtattattttggtgaggacgagagtaaaagcacgaagggtgatgccgtgcaaattgttgacttttgattcttgttgacattctggctttgttacttctttcagttattaaggatttccatttgaaactggtagctccccatagcatgctcccctctcttagttgtttaaattctgtatatttccttttattgcatatatctgcacaggttgtttttggtaggtcctgtctagcctcatcactacttcgtcgaggttaggccagacacttaccaacacatggggtcggttgtgctgatgttacatctgtgcatctttttgcacagttccaggagcagcttttggacctcagcagtaggatttgatcgggagctgacttgagtccacagacaccgaggtagccttactgatgtccgcaggcccggagtctctctctctctctattcagtttgttatattttgtaccgaaataaacagtttataatttactttcagatgattgtatttagtaaatcttagaagttcgtgagcattgtgacaccaatcttggatagaggattatgttaaactttccacatttctattaagtttttatataagttaagacttccgcttgaaattttaattatgttgcctctattacatgttgataattatggaaaggaatgtgtgttaaacggaaggtaatttaagttggcttgcctagctcctattagtaggtgccatcacgaccccgatggtgggaaattcgggtcgtaactttgtgattttactttctcaagcaattcaatatcttctagagcttgatgtgacctattgatgtttttggtggtgacataacttcttttatcatgtttgaagaaaaattattaaatgagataaagtggttgtaagatggttaattagagtaaaataacaatggacgaggaacataatctcgttacctatactcaatcataaaaataagaaagaattttacctcttcccttttttttgtaccagcaagtgaagctccaaggcaagctttgtatagacaaaaagagaagaaaacttgttatgctttaggaaccactttcttcttactgttaccaagtagttatgctctaggaactctttctttttactgtaccatgtaagaatatttatagaagataaatggccatccagttccctctgcaagcaaaaaaacttgaaagtacctaacttatttaactaaattctggagccaaagcgaagcctaacttactgactaaaatcattgggaatacagtttggtgttgaatttattaaacatctcctaatgctgaacttgatcatccatctcctgtaacatgcatattcacagaaagaggcttctatgaatgctacaataatatctatgaatactacaataatatatgaaaattataatgatcgaacagtcggattaagcatctacttaactgatataagaaaaataaagtatattaattagaagaaattcaaggcaatattcagttactcatcgtgaaagacctttgctatgaggctttatttagcttggactttatgccaattactatttctttttatcctttttctctttttttatatttaagtagatttagaatatatacttttcaacaccaaatctcattagattctgacattagcttctaatcctctatcatacttttcttaatcaagagaatttcaacaccaacttctttagattctgatgaaaattactaaccctttatcccacttttcttaatgagatttagaatatttttcgacaacataactcgtaagatttcaatagaaagatcaaattatttcttctacaaaaaattgtgaaacttctaaatctgagcaggtaaggaggacagggcactgctaaaacttttctcaaaccagggtcggctccatagtgatgagaggtaaaggcatgtgccttaggcccccaaatttgggggtcccattttaaaaaaataataagttcataagtattttaaaaataatatttaatatttttaatacaaaaatagagtatttaatataaaagaaaagaaaactttttagatatataaatgaggtaataatttgacttacttaaaaataggtagatgaatactttttccaattttttactttttcactttttacttctttaaaaatttgctctctcttccttaatttgtccaagtcactctttcttttttctaatctcttcatatctcggaaaatcctatatattttctgtctttctatgtgatattcttactcactttctttcttcaagatttcattactcacctttttctcaaagatgtcattagttcaagtgttcaacaatacttttaagttttcaatagttctatacttctattgctctgtaaaatctcatctaatatcagcaatatctcaagaaagattaaataagctagttatgttatcaattgaacatgaactattagagaaaatcgattataaaagaattattaacaattttgtatctcaaaaagttagaagaataaacttcaaataaaaagatatcttataacttttttttaaaaaaaaattaggcctcatattaaactatggctttaggccccgtatgtgcttgagctgcccctgcctcaaacatcaaaacaccaatccattaaaagtctataaaagatattaaaagaagcaacattggactacatgaaaatcttaaaattgttctactatatcaaagcacaattaacctcaaactctcaaagaatctgaagatatctctgatttattttgataaaaattgtctataatgagacacatccacaataaaaacacaaatctagcaaaaaattacaactaattacatttgttcttattaacaataatgcacaaaaatgtagacaacatataagtcaaaagcatgagtatgatgaattaattttggtagtaacaattatatttaacccataaaatttatcttacgctggatgaaaaaatacaacaaaatatgcgaattgagttcaccttggcgtgtgaaactaacaaaacctaaggtgaattagtggagaatacatcatgtagttctgcaactgattttgtaggagaaccaaaaacaaattaacaaaaaggatgtactccaagttgcttcaataattgtgacgacccggatttctcaccctcgggagtcgtgatggcgcctactaatgtgagctaggcaagccgactgtttgaactaattacctttttaccccttttatattctttaacaattttaaagcaataaagtgtagacaacggaatttacaataagcggaagaaaagcaatgaactatctaaatatgtatccaatacaaccgcttgaacctcgactacccagaactggtgtcacagtttcacagacggtctaagaatactatatacaaagtctgaaagataaaagatacactgattctgaaataagtaaaggaaacaggataaagaaaagataggaggtgatgccaaggcccgcggacgtttgcaggactacctcgggtcacctgtgtgaactgaagacagcaccctcactacggtccaagcgctccggaatcagtatctgcacacagtgtagagtgtagtataagcacaaccgaccccatgtgctggtaagtgcctagcctaacctcggcgaagtagtgacgaggctaggaccagactaccaaataaacctatgcagttaaatcatatacaacagaaatataaaagcagataattacatttaaagatgggagggggaaacatgtttcggggaataacagacaacaacagaatatcaagaggaatataaataaaccaaaatccaattactaacaaggataaggaaaacaaatgcagaattcactttcatttcacatcttgttgtaggcgtgcaacccgatcccatttcatatatctcgttgcaggcatgcaacccgatcccatttcatatatctcattacaggtgtacaacccgctcccatttcatatatcttgttgcaagcatgcaaccccttcctatttcatatatttccgtggtggcgtgccacccgatcccatttacaaatcaataataatcacaaaagaatcctggcaagggaacaagagcaatatagcatcatcccaacaagggaacaataatattttaacaacatcctggtaaggaaacaataatatcaaaacaaacatcccggcaagggaacaataataataataacatccgggaaagggaacaatattggtaatcctcatatgaaatacaataaaccacaacgtgtcataacaattacaatacaagactcacgggcatgcttgacaccaacgtatagatactcgtcaccatgcctatatgtcgtactccacagttacctcatagaaaataagacacgactcctaatccttcaagctaaggttagacaaaacacttaactcgatgccacgaacacaattcaagtctcaattattgctttacctcttgatcccaccaccaattcgctcgtatctagccacaagttacttaattacgtcaataaatgctaaatgaattaattctaatgtatgaaaataagttttccaaaggtttacccaaaaagtcaaaaatcgctctcggacccacatggtcaaaattcgaggttcgaaccaaaacccggctacccattcccctaagaacccaaatatataatttgttttaaaatcggacctaaaattgaggttcaaatccccaatttttaaaaaatctaggttctaccaaaaacacctaattttccccatgaaaattattgattttgagttgaaatcatgtgaaaagatgttaacgattgaagaaaacgacttaaaattgacttacaatcgatttggaagaagagttgtctttgaaaattgcccaagggtgttttggttttgaaagactgtgaaaaatgaaagattttcggctaagttataaaattggaggttgcagatgttgcaattgcgacaagtgttcgcaattgcgaacccagacttctgctaagctcacatttgcgaagtggccctcgcatttgtgaggttggaattgtgaacatacaatcgcatttgcgataacaggcccaaatggggagtatcgcatttgcgaaggaaaaatctcgcatttgcgaagaagggctagcctgagatgtttcgcatttgcgactcagcctttgcatttgcgaaggaaaaatctcgcatttgcgaagaagggctatcctgggatgtttcgcatttgcgatgcgaagcctgcaggcctgcaatgaaacagctgaagcctgcaatttctcaagtccaaaatccaccccgtggcgtatccaaaactcacccgacccctcgggactccaaaccaaacatgtacaccaacctaaaaacatcatacggacttgcttgtgcattcaaatcaccaaaagaacgtcaacaactacgaatttagcatcaaaatcataaaatttcttaagaacatcaaatttcccaatttcctcaaataaggtccgattcatatcatatcaagtccgtttcttaccaaatttcacaggttcgactcaaatcatatataagacctataccggggtccggaacctaaatacgggcccgatactatcaaactttaaacacatttcactttcaaaaactcataaatattccagaaaataattttcttcaaaaattcaatgctcgggcttgggacctcagaattcgattttgggcattcgcccacgtcccatattttcctacggaccctccaggaccgtttacccaaaatgttgacagaagtcaacttaaatccattttaaagtcaaaattcatcatttttcacagattttcacataatggctttccgactacgcgatcggactgcgcacacaaatcgaggcaagacaaaaagaggtttttaaggccgcagaacacataattcatttttaaaacaagtgatgacccaaaaggtctacattctccacctctaaaacaaccgttcaccctcgaacggacataagaaggaagtacctgagtcagagaaaagatggggataacgccttcgcatatcggactcggactcccaggtcgatgcctcagcaggttgacctctccactgaacacaaatagagggaaaactcttcgatctcaactgacaaacctgccggtctaggatagctaccggctcttcctcataagacaagtccttgtccaactcacagtgccgaaatctaacacgtgagatgtatcaccgtgatacttccgaagcatggacacatgaaacactggatgcacggctgataagctcggtggcaacgcaagactataatccacctctcccactcgatcaagaatctcaaacgggccaatgaacctagggctaagcttgcccttcttcccaaatctcatcacgctcttcataggcgacactcgaagcaatacccgctcactgaccatgaatgccaaatctcgaaccttacgatcggtataacttttttgcctggactgagctgtatgaagcctatcctgaatgattctgaccttgtccaaagcatcctgtactagatacttacccaataaccgagcttcccctggctcgaaccatctaaccggcgaccgacaccgcctaccatacaaagcctcataaggagccatctggatactctactagtagttgttgttgtaggcaaactctgctaaaggcaaaaactgatcccacgagcctccaaagtcaattacacaagcttggagcatatcctccaaaatctgaatagtccgctcggactgcccgtctgtatgaggatgaaacattgtgctcaactcaacccgtatgctcatctctcgctgaaatgctctccagaaataggaggtaaattgcgtacctcagtatgaaatgatagacatgggcacaccatgaagacgaactatctcccagatatagatctcagctaacctgtcggaagaaaaggagactgccacaggaatgaaatgtgctgacttggtcagcctatcaacaataacccatactgcgtcgaacttcctccgagtttgtcggagtccaacaatgaaatccatagtgatccgctcccatttccactcgggaatctcaatcttctagaacaaaccaccaggtctctaatgctcgtacttaacctgctgacaattcaaacaccgagccacatatgcaacgatgtccttcttcattctcctccaccaataatgttgttgtaaatcctgaaacatcttagcggcacctggatgaattgagtacctggagctatgggcctcctctaaaatcaactatcgaagcccatctacattaggcacacaaacttgaccctgcaatctcaaaactccatcatcccgtaaggtaacttgcttggcacctccgtgctgcaccgtgtctctaaggacacataaatgaggatcatcatattgccgatctcggataagctccaacaaagaaaaatgagcgactgtgcaagctaacacacggctggggtcagcaacatccaacctcatgaactggttggccaaagcctgaacatccaaagcaagcggtctctcactgaccggaatataagcaagattgcccatactggctgacttcctactcaaagcatcggccaccacattggcctttcccggatgatataagatggtgatatcatagtctttcaacagctccaaccaccttctctacctcaaagttatctccttctgcttgaacaagtactgtagactcttgtgatccgtgaacacctcacatgccattccatatagataatgcctccaaatcttcaatgcgtgaacaatggctgccaactccaaatcatgaaccggatagttcttctcatgaatcttcaattgtcgcgaaacataggtgatgaccttgccatcctgcatcaacaccgcaccaagtccaacacgagatgcatcagaataaactgtataaggccctgaacctgtgggcaaaaccaacactagtgccatagtcaaaatgtcttgagcttctgaaagcttgactcacactcgtcagaccatctaaattgggcacctttctgggtcaacctggtcattggggctacaatagacgagaacccctccacaaaccaatgttaatagcctgccaatcccaagaaactccgaatctctggagctgatgctggtctacgctagtttttgactgcctcaatattcttcggatcaacctgaataccctctgcggatacaacatgacccaggaatgcaactgaactcaaccaaaactcgcacttcgaaaacatggcatacaactgactatccctcaaagtctaaacaaccactctaatatgttgctcatactcctcctggctacgggaatagatcaaaatatcatcaatgaagactatcacgaacgaatccaagtaaggcctgaacattcggtccaccaaatccgtaaaagttgctggggcatttgtcaacccgaatgacattaccaagaactcataatgcatgtaccgagtgtggaaagttatcttagggacatcggatgccctaatactcaactgattgtagccagatctcaagtcaatcttcaaaaataccttggcaccatgaagttgatcaaacaaatcatcaattctcggcaatggatacttattcttgattgtaaccatgttcaactgccggtaatcaattcacattcttatcaatccgtccttcttcttaaaaaacaccaccggcgcaccccaaggcgagacactaggtctaatgaagcctttttcaagcaagtcttgcaactgctccttcaactctttcaactcaggcggggccatacgatacgcggggtagaaataggctgagtgctcggagccaaatcaatgcataagtcaatatccttgtcgggtagcatacccggcaggtctaaaggaaatacctcagggaactcacgaacagcaggcacaaaatcaatagaaggaacctcagcactagaatcatgaacataggccaaataggccaaacaccccttctcgaccacacaccaagcctttacataagagataacactacgggtagaatgaccaggagtccctctccactctaaacgaggtaaacccgacaaggctaaggtcatagtctaggcatgacagtccaagatagcatggtaaggtgataaccagtccatccccaatatgacatcaaaatcaaccatgtccagcagaagcaaatctatacgagtctcaatacccccaatcacaactatacatgaatgatgtactcgatctaccgcaatagaatcacttaccggtgtagacacataaacaggagcactcaaagaatcattaggcatgaccagatacagtgcaaaataagatgacacataggagtatgtagatcctggataaataaaactgaagcatctctgctacaaactagaacagtacctgtgataattgcatcggaagccacaacctcgggcttggctggaagagcataacatcgggactgagccccaccaccctgaactacatctctgggatggcctgctactggctggcctccacctctagctacctgacctccacctctaatacctctacctccacctctaatacctctacctccacctctagcacctctaaccctacccctagctggtggagcaggcggttaaacacctggtgctagaaccatagtacgggaaccctgctgctgagaactgctcggtgctagagggcaatatctagcaatgtgcctcgtgtcgccacaagtaaaacaagcccctcgactgcttggtctgatgacactggaaactctgaagcggcgatgcagtgataggagttggtggtgcactataggactgttgatcagaatactgcatatgagaactacaactatctgaagcaccgtaagaaacttgaagtgctgactaaaaaggcctaggacgatggcctctaccatacgaatccttaccttcagacgaggtaccactgaatctgcctgaatgatgaggcctcttgtcagacccctgaccgcctccctacgatagaactatctcaactctcctggccacattggccacctcctaaaaagaaatgtcactccctatctcctaggccatctgaagtcgaataggctggataagtccctcaataaacctccttactctctctctctctctcggtgagaagtatgataagagaataacgtgccaagtcgatgaatatggtctcatactgagtaacaatcatagaaccctgctggagatgctcaaactgcctccgatagatctctctctgagtgatagggagaaaagtctccagaaatagctgagaaaactgctcccaagtcaaagctggcggtccggctggtctagccaagaaataatctctctaccaagtcttggcggatccagacgagcgaaaagtagcaaagtcgaccccaacagtctccattgtcaccatgttccgaagaacctcgtgacatctgcctaaatgatcctagggatcctcaaaagatgcaccgctgaaagtagtagtaaagagcttggtgaaacttatccaacctccacaaagcctctgaagacgtagctgatctatcacagatctgtgctgcttctcggctgaagaagaggtacgtgacctcgccattcgcgaaaggacaagagtaaagatttcgatttagcattgagagaacaaaaattgcatgacaggaaagaatagaagtgaagctttttcctaactttgtagcctctggggataaatacagacgtctccgtactgatcccttagactctactaagcttgtctgtgaactgttagacccatgtaacctagagctttgataccaacttgtcacgacccagatttcccaccatcgggagtcgtgatggcgcctactaacgtgagctaggcaatccgactatttgaaccaattacctttttaccccttttatattctttaacaattttaaatcaataacgtgtagacaacaaaatttacaataagcggaagaaaagaaatgaactatttgaatatgtatccaaaacaaatgcttgaacatagactacctagaactggtgtcacagtttcatagatggtctaaaaatactacataaaaagtctgaaagataaaagatacaatgtttttgaaataagtaaaagaaacaggataaagaaaagataggaggtgacgccaagccccgtggacgtctgtacaactacctcgggtcgcctgtgtggattgaagatagcaccctcaacgcggtccaatcactctggtatcagtatctgcatacagtgcagagtgtagtatcagcacaaccgaccccatctgctggtaagtgcctagcctaacctcggcgaagtagtgacgaggctaggaccagactaccaaataagcgtgtgcagttaaatcatattcagcggaaatataaaagcagaaaattacagttaaagatgggagggggaaaaaatgcttcggggaataacagacaacaacagaacatcaagaggaatataaagtaaccaaaatccaattactaacaaggataaggaaaacaaatgtagaattcactttcatttcacatcttgttgcaggcgtgcaacacgatcccatttcatatatctcgttgcaggcgtgtaacccgatcccatttcatatatctcgttgcaggcgtgcaacccgatcccatttcatatatctcgttacaggcgtgtaacccactccattttatatatctcgttgcaggagtgcaacccgatcccatttaatatatctcgttgcaggcgtgcaacccgctcccatttcatatatctcgtttcaagcgtacaacccactcacatttcatatatctcgctgcaggcttgcaacctgctcccatttcatatatcttattgcaggcatgcaacccactcccatttcatatattttcgtggcgacgtgccacacgatcccatttacaaatcaagaacaatcacaaaagaatcccggcaagggaacaagagaaatataacaacatcccgacaagagaacaataatatcaaaacaaacatcccggtaaaggaacaataatatgacaataacatcccggcaagggaataataatgataataacatcccgccaagggaacaataatgataatcctcatatgaaacgcaatataccacaacgtgtcataacaattacaatacaagactcacgggcaagcttgacaccgacgtatagatagtcgtcaccatgcctatacgtcgtactccacaattatcacgtagcaaataaggcacgactcctaatccatcaagctaaggttaggcaaaacacttacctcgatgccacgaacacaattcaagtctcaattattgctttacctcttgattacaccaccaattcgctcgtatctagccacaagttacttaattacgtcaataaatgctaaatgaatcaattctaatgcatgaaaataagttttccaaatgtttacccaaaaagtcaaaaatcgccctcgggcccacatagtcaaaatccgaggttcgaaccaaaacccgactacccattctcctaagaacccaaatatataatttatattaaaatcggacctcaaatcgaggtccaaattcccaatttttaaaaaccctaggttctacccaaaacacccaattttcgccataaaaatcattgattttgagttgaaatcatatgaaaagatgttaatgattaaagaaaccgagttaaaattgacttacaatcgatttggaaaagagttgtctttgaaaaatcacccaagggtgttttggttttgagagagtgtgaaaaatgaaagattttcggctaagttatgcaattgcaggttgcagatgtcgaaattgcgaccagggttcgcaattgcgaacacagacttctgctaagctcgaattggccaagtgaccctcgcatttgcgaggtcggaattgcgaacatacaatcacatttgcgataacaggcccaaatggggagtatcgcatttgcgaaggaaaaatctcgcatttgcgaggaaaggctggcctgggatgttttgcatttgcgagtcaggcttcgcaatgcgaagcctgcaagcctgcaatgaaacagctgaagcctgcaatttctcaagtccaaaatccaccctatggcgtatccaaaactcacccgagcccttggggctccaaaccaaacatgcacaccaacctaaaacatcatacatacttgcttgtacattcaaatcactaaaagaacgtcaacaactatgaatttaacatcaaaatcatgaaatttcttaagaacatcaaatttcccaatttcctcaaattaggtccgattcatatcatttcaagtccgtttcttaccaaatttcacaggttcgactcaaattatatataagacctataccggggcccggaactaaaatacgatcctgatactatcaaactttaaacacatttcactgtcaaaaactcataaatattccagaaaataattttcttcaaaaattcatttcttgagcttaggaccttggaattcgattccgggccttcgcccaagtcccatattttcctacggaccctccgggaccgtcaaattacgggtccgggtccgtttacccaaaatggtgaccaaagtcaacttaaatccattttaaagtcaaaattcattatttttcacagattttcacataatgactttacgactacgggcccggactgcgcacgcaaatcgagccaagacagaaagagttttttaaggcctcgaaacatagaattcatttttaaaacaagtgatgataggtcatcacaataacaaacaaaagtcaataacattagctagactccacaaactttaattgaaaaacattagagctaattccagcaaagtttgacatccgcaacagggaaacaaaatgaaaatcttttactacctatggaattgagaattcgttatgatagtaatcttgagaataaactaaagaagttattgttcagttcctttcttgaagtttagaaatatcactattgatatgttgccatatcagattcaattttgttaggcagcagttccctgatgcaccttcttatcagctacgtcggggggggggggggggtgactggacttagcagcttcatgggtatcatcatcttctttaaaaataaataaatcaacgaacacttgatatatttagctaaagaaaagaaataatgtcttaaatattaatatgttaggatttttttatcaacttcaagaaacaatattatttaccttgagattctccgatatgatctacgatgagtttatatctttgcatcctgagtggatgcaaggtgatagaagaactattatcccaatataatgtaggtgcttcctaccacgggaaatcataaagtaggacgcaaaaagaaggcaattaggaagcttttgggagagactatatctattcaaaattcagaggaaatagtcaaactcaactgaacaattgaaaagagaaactcggtagtggctaattatctaaagttctttctgaagtaatgcggataccaagcatacaaaatttataagtacaaaaattacctgtctttttcccctttagttctttttggttttcatttcttcttactctgttttctcctcctcttttccagccacctcttttactatcagccatgctcggattctcccactaacattgttccctccacccattttattttaattttattcaatttcttttagtttttttcacttgattcctcaagcatagtctattttttaaatttattttatccaaaaaatattcatgaaggttacatttgaaactcttcacactctttaacaggaggcaaaatattttttcataagtgctaaaaccaataaaaaaaaagttaatagtgctactgatatttagtattagttttgtattcacataatagaaacatccaaaatagaatagatgtcttggcgacatctactattgatcttaccaaatttaccgaagtgaaataaaaaggaacacattagtgtttaatcattcatatatcttctgatatggcatgtgaagagctcaagccatgctgtatctagaataatatcattataatcatgaggctacaataaaattgaaagcttactgggcaatcaatccaatggaaaatccacatcaaacgaaaacatttgaaaccataagcatgtgcaaaatgtgataaaagtcatatgtgcacttgcaggaatattttctccttttattcaaggagtcaatatatccatgctcgtgaattcctttatcttatcaaaaattgcagacaaataaaaataaacttctaggtatttttgtcttttatttaaatttttcctaattttattatcctgcacctcaagcaatatgaacgaattttcctactcaagcgctccattttggatgtagaggaaactaattctaagttttcataataatagtcagaaaaatcagaaggattttaagatagttgtactggataaagaatagctaaagctctgactacattagaggttattacgaacattgtatctgaagaattcacatgataatcaagcttcataagctcaagtttggctaaccaagaattctaaactaaaaatactaaacaggacttacatattatatattcttgttcgtggttctagtttcagcatcacccatatagtttcaggttttataattgcttcttccatttcttgttcaactatgattggaaacttcatttccttttatttctttcacccgcacttgttggaaacatatgttcctttttcaacataagataaaccaaaaagtctggcatgcatgttgtcataatttctccatattgattttttaaaattgaatttgaaacaattggtcctacagtttgtcacgaccccggttcgcgctccgtgaactatcgtgatgacacctagtctctacgacgaggtaagcctaaaatgcggaagataaaccaaatttgcggaagaaaataatttaaaacagaaatagagtaataaaatagtgtttaaaagtgtcgctcggcatacacaatattaactcttaaaaccaataaattttcccaaaacccggaaacccatgaatcacaagctaagagatacataagaagctctaactccaaaaatgtctaaccaaaaatggaatactgaagggctatactattacagaaagatagaaagggactcctcagtttggggacgcggaagatatacctcgaaatctctacagaagcgcctcgcctcaaggatgataagacagagtggaagtatctggatctgcacatgaaaacatatgcagaaggggcatgagtacaccacaacggtactcagtaaatgccaagcctaacctcggtcgggtagtgacgaggaaggtcagggccctactgaggttaaataaaatataaggtataacagtgtagaataagacagtataatgaagtgcaacagtaagaaataacatagaatagaaagaacaacgataactagaacagagacaaaataatcacgaaaaggaaatacaactcaagacagagataacaaccggggtaccctccaggataccgtcctgtagtcccaattacatctaaccagtggatctcccgggatactgtctcgtagtccatcatatgtatttgaacgatctctcgggatcccgtctcgtagtctaactatcagtgcgtggggatctatcgaaattccgatccgtagtcccaaatataaatacccagtactggaagaatctaccatgtgcagtctcgtagttccatataactgtgcagggggatctaccggaatctcacatccgtagtcccaattaaacaaacaagggagatctactgacatcccacatccatagtcccaaataaacagacaaaggggataatccacatccgtagtcccaaataaacagacaagggggatctatcggaatcccatatccgtagtcccaatgtaaatacacagcagcaaaaggaaaatattcagaaatggcaaatttcatattaaggcaaacaagtaattctagcctagcatgctgcacagaattcaggtaaggcagtttgagcaagtaaaccaatcaagtcacttagacatgctttcctaagctaacagcaggcttaatagtgcaagtaataaaaaacaggaaagaaatcatactagtaattacttaataaaaatcgaatttacaacaattagcacaagtatacactcgtcacttcacgtacaaggcatttcaattatcaaatacaccaaatcctaagggaaggtcccccacacaaggttagacaagccacttacctcgaaccggctcaataatcaatatgaaaccatgctcttggcatgagtactcgactctaaatgacccaaatctattcaattcaatatcataacgtaaataacacttcaagtaattgattctacaaagaaattctaagctaatacgcgaaattaagtaaaatgaccaaaacgtcactcgggcccacatcttggaatcgggtaaaatttatattttcagaaacctcgtaccctcacgagtctatacataacaagaatattgaaatcatagttcaattgacccctcaaatacccatgttaaggtctcttaatctcaagccctaattactcattttttccaaatttctcaccaccaattaggtctttaatcacatataaacgagttgtgaaatcaaaaatattacctccaagtgattcccgttgaatccctctttaatccccttcaaaaagcttcaaaatcgcccaaaaatggaggaacttaggctcaaaatcacggaataggcattttaaatcattctgccgaggcatttaaattcttcttcgcggacgcggtcaaagcctggcgttcgcgaagcacaaattgacgttgaccacttttccttcttcacaaatgcatccccttattcgcgaacgcgaaggctcagcttcccagctcatcgcgaacgcgtagttcaaagaccctagctcttcgtgaacgcgggacctccatcacgaacgtgaagtccataccttcagctccacatcctaacccttcgcgaatgcgagggtccattcgcgaatgcgaagaacaactggtctgcaacacacatagtagttttctgcaacttcaaacatcatgaaatggtccaattgaccacccgaaactcacccgaggccaccaagacctcaaccaaacttaccaacatatttcataacttcattcaaacttgttccaaccttcagaacacacaaaacaacatcaaaacacctatttttcatcggattcaaggctaagaattccaaaaactctaaaaatatgctttcgatcaaaaagtctatcaaacctcgtccgaatgacctgaaattttgcacatacgtcacattaaacactacggagctattccaacttctggaattacattctgaccctcagatcaaaatttcactatcgaaccggaaacttcaaaattcgacctttctacatttcaagcctaaattagctacagacctctaaaacacaatccgaacacgcccctaagcccgaaatcacccaacgaagctaacgaaaccattagatttcccttctgatgtcatctttgcactgttctgactacggtaaactttccaacacttaagctcttatttagggactaagtgtcccaaaactcttcgaaactcaaaaccgaacatcccgacaaatataaatagcagaaataaattcggggaaagcagttaatagcggatcagggcgttaattcttaacacgaccggccggatcgtcacacagttgttcttggacatgcttaacacacataatcttcattgaagatgaaacaattcaagttctttagatataaagagtaggagaagaaagctataaagagcatacatcgaaaataagaatactttgattccccaaagtattaattatatcccccaattggaagataccaaaaaatctcaaagtagctaaagaaattcaaagccctgctctgcagaactagtttgactactaaattaagtcagaaatatgaaaaagaattgatcaaccaattaaagatgaatattttatccatcaaactaacatcatctacagatgaagtagccatgaataagcaacctccccaacatgcctcaatatctcaaaagggcaaataaacctcagactcaacttctctttcttcccaaatctcataacgccctttataagagaaacccgaagcagaacccgctctccaaccatataggaaacaacactaaccttccggtctgcgtaactcttctgtctggactgggatgtacgaagtctatcctgaatcaccttaatcttctccaaagcatcgtgaactaagtttgtgcccaataatctagcctcacccagctcaaaccagcccaccggggatctacaccgcctaccatataaagccccatacaatgccatctaaatgctggactgatagctgttgttgtaagcaaactccgccaatagcaagaattgatcccaagaccctctaaactcaatcacacatgtatagagcatatcctcaagaatctgaatagtgcggtcggagtgtccgtccgtctgagggtgaaatgttgtactcaaccccacccgagtacccaactcatgttgaatggacctccagaaccgtcatgtgaactatgtacctttatctgaaatgatggatattagaataccatgcagacgaacaatctctcggatataaatctttgccaaccgctccaaagaataagtagtacacacaggaatgaaatgagtggacttggtcagccgatccacaatcacccaaataacatcgaactttctcaaagtccgtgggagcccaactacaaagtccatggtgatctgctcccactttcactccgcaatctctatctgctgaagcaacccactcgatctctggtgctcatacttcacctactgacagttgagacaccgaactacgaatccaactatatctttcttcatacgcctccaccaatattgctgcctcaaatcctgatacatcttcgcggcacccggatgaatggaataccgcgaactctaggcctcctccagaatcaactcccgaagcccttcaacattgggtacacaaatacggccctacatcctcattaccccatcatcaccaatagtcacatctcttgcatcaccgtgctgaaccttgtccttgaggacaagcaaatgagggtcatcatactgacgttccctgatacaatcaaataaggaagaccgagaaaccacgcaatgtagaacccgactgggcttcaaaagatccaatctcacaaactggctggctaaggcttgaacatccatcgccataggcctctccgatgctggtaaataagcaaaactccctgcccaacgactcaaagcatcggccaccatattggccttgcctggtgatacaaaatagtgatatcatagtccttcagcaactctaaccacctcatcaggcacaaatttagatccttttgcttgaacatgtgctgcaagctccgatggtcagtctaaatctcacagggaaccccgtataaataatggcgccagatctttagggaatgaacaatggaagctaactcaaggtcgtggacagggtaattcctctcatgtaccttcaactgtctggacgcgtaggcaatcaccctaccatgctgcatcaacaccgctccaaggacaatcctcgaggcatcacaataaaccgtataagaccccaaacctataggcagtatcaaaattggggctgtggtcaaagctatcttgagcttctgaaagctcgcctcacactcctccatccactggaatggagcacccttttgggtaaacctggtcatgggggctgcaatcgatgaaaatacttccacaaaatgatggtagtaacccgccaagccaaggaaactgtggatctctatagctgaggatggtctggtccaactctgcacgacctctattttcctcggatccacctgaataccctcactcgataccacatggcctaggaatgccacggagtccaaccaaaactcacatttccagaacttagcatataacttctcctctcttagagtctgaagcatagtccttaggtgctgctcatgatcttcccgacaccgggaatacactagaatatcatcaataaagacaatgatgaacgattcaagatacaaccggaacacactgtgcatcaaatgcataaaggctacgggggcattggtcagcccaaatgacataacaaagaactcgtaatgactataccgagtcctgaaagcagtcttcgtgatatctggctcccgaatcttcaactgatggtaacctgagcgcaagtcaatcttagaaaacacccgtgcgccctgaagctggtcaaacagatcatcaatacaaggcaaaggataacggttcttcactgtaactttgttcaactagcgataatcaatacacatacgcatagaaccatcatttttcttaacaaacatgataggagcaccctaaggtgatacactaggccaaataaaacccttatcaagcaattcctgtaactgatccttcaactccttcaactcaggaggatccatgcaatacggaggaatataaatgggttgagtgcccggcaacatatcaatgccaaaatcaatatctctatcaagcggcatgcttggaagatcagctggaaacacatcgggaaaatcccgtactactgggactgaatcaactgaaggggtatcaatactgacatctctcacataagctaaatacgcgtcacacaccttctcaaccatatgctgagatttaagaaaagaaataaccctactgggagtgtgatctaaagtacccctccactcaacacgcggtacacctggcatagccagcgttatggttttggcgtgacaatcaagaatagcataatgaggcgacaaccagtccatgcccaagataacgtcaaaatctatcatactgagcaataataaatcggctctggtcccaaaaccactaagagcaaccaaacacgaccgataaatgcggtccacaataagagaatctcccataagagtagaaacgtaaaaaagaaaactcaaagaatcttgaggtacacccaaatgcggagcaaaataagaagacacataagagaaagtggagcctggatcgaatagaaccgatgcatctttgtgacaaaccagtataatacttgtgatgacagaatcagaggcaacaacctccgtacgtgtaggaagggcataatatctggcctggcctccccctctagggcgaactctaactccccgacctccacctctagctggctgggcaggtggggtagcaactggagctgtaaccatatcctgagaactctgcagggcacgctgtggctgagaagtctgtggaggtgcacccctcccaagtctggggcaatccctcaccatatggcgtgtgtcaccacactcaaaacaagctttgggaagacgtgggggctgtgactggctcaggctaggactgctggactgacctctgaaagcaccccgtagaggaggcgcgctagaaatcggaggtgcataataaggctcctgaggcctaggaggagctggaccactattggctgctgcaagagctgaatgaactcatataacccctaccatgatgacctgcagttggggcacgggcaccagaataatggcccgactctcgagacctcttggcctccctctcctctctttccctagcatgcataccctcaatcctcctagcaatgctcaccacctgctgataaggaaaatccatctccaactcacgagccatgctagacctgatactaggaataagtagctcaataaactggtgaaccctctcgcgaacagtagaaaccaaggctggtgcatgtctagccaagctagtgtaacggacatcatactctgagatagtcatagcacccaggcgaaaatgctaaaactcagtgcgccacgcatctttgaggctttgaggaacaaactctattaagaatagatctaaaaactgggtccaagtcagcaaagaagcctcgtccggactgtctaactcataggtgtgccaccactcataggcggctcctcgaatttggaaagtagtgaaggaagccccgctcgattctgatatacccatggtacgaagaatgcggtatcactcctccagaaatcccaaggcatcatatgattctaacccactaaatacgggaggatcatacttcttgaacctctcaagtctccgctgctcatcctccgaagtcgatgccctatcctcgggttggcctggggctacaagaataatctctaggacctgatcaacgtgcactcgctgctcaggagtgcgggcagcaggagtctgtgctcctcccccggcctgagatatggctgcagcaagggaaagcaaccctgcctgagccaaagaggtgtacatgctcatgaactgcgctagagtctcctgaagtgctggagtagtagtagcaatatgcgtatcaggtgcctggactccagctggaactgctggtggtacctcggcggtagctcgcgcaggtgctctggctacaccacatgcgcgtcctcgacctcttccccggccccgaccctgacctctaacgactgcagtaggggcgcgagtgcctggtcatctcgggtagcacgtgtactcaccatgtgtgagagaatataagacaaaagtttagaattgtgatgtcaaaatatcgcacgacaaggaaatccaatgaagtggaaattttcctaacagtgacatagcctctcatagataagtacaggcatctccgtaccgatcagcgagactctaataaaccggcttgtgatccatgactcctatgaacctagagctctgataccaacttgtcacgaccccggttcgtcgttcgtaaaccattgtgacgacacctagtctctacgattaggtaagcctaaaatgtggaagataaaccaaatttgtggaagaaaataatttaaaacagaaatagagtaataaaacaacgtttaaaagtgtcgctcgacatacacaatattaactcttaaaaccaatacattttcccaaaacccgggaacccatgaatcacaatctaagagataaataagaatctctaactctagaaatgtctaaccaaaaggggaatactgaagggctatactattatatcaagatagaaagggactcctcggtctgcggacataacaaatatatctcgaagtctctacagaagcgcctcgcctcaaggatgataagacagagtaaaagtacttggatctgcacatgaaaaacatgcgcagaagaggcatgagtacaccacagcggtacttagtaagtgccaagcctaacctcggtctggtagtgacgagaaaggtcagggccctactgagtttaaataaaatataaggtataacagtgtataataagacagtataattaagtgcaacagtaagaaataacatagaatagaaagaataacaacaacaactagaacagagacaaaataatcacggaaaggaaatacaactcaagagagagataacaaccggggtaccttccaggataccgtcttgtagtcccaattacatctatccagtggatctcctgggataccgtcccgtagtccatcatatgtatccaaaagatctctcgggatcccgtcccgtagtccaactatcagtgcgcggggatctaccggaatcccgatccatagtcccaaatataaatacctagtactgggagaatctgccatgtgcagtcccgtagttccatataactatgtagagggatctaccagaatcacacatccgtagtcccaattaaacagacaagggagatctaccggaaacccacatctataatcccaaataaatagacaagggggatctaccggaatctcacatccgtagtcccaaataaacagacaagggggatctaccggaaccccacatccgtagtcccaatgtaaatacacagcagcaacaggaaaatattcagaaatgacaaatttcatattaaggcaaacaagtaattctagcctagcatgctgcacagaattcaggtaagacagtttgagcaagtaaagcaattaagtcacttagacatgctttcctaagctaacaacaggcttaataatgcaagtaataaaaatagaaaagaaaacatactagtaattacttaatgaaaaacaaatttacaacaattagcacaagtacgcactcgtcacctcacgtacaaggtatttcaataaccaaatataccaaatcctaagggaatgtcccccacacaaggttagacaagtcacttacctcaaagcggctcaataatcaatcctaaaccacgctcttgccacgagtactcgactccaaatgacccaaatctattcaattcaatttcataacgtaaataacacttcaagtaactgattctacaaagaaattctaagctaaaatttacattttcagaaacctcgtaccctcacgagtctatacataacaagaacactgaaatcagagttcaattgaccccctaaatacccatgttaaggtctcttaatctcaagccctaattacccatttttcccaaattcttcaccaccaattaggtctttaatcacatataacgagttatgaagtcaaaaatattacctccaagtgattcctcttgaatccctctttaatccccttcaaaaagcttcaaaatcgcccaaaatggaggaacttaggctcaaaaccgcggaataggccttctaaattattctgccaggtatttaaatccttcttcgcgaacacggtcaaagactggcgttcgcgaagcacaaattgacgttgaccacttttccttcttcgcgaacgcgcccctttattcgcgaacgtgaaggctcagcttcccagcccatcgcgaacgcgactcccttctcgcgaacgcgtagttcaaagacctcatcccttcgcgaacgcgggacctccatcgcgaatgcgagggtccacttatgaacgcaaagagctactggtctgcaacacacacatcagttttctgcaacttcaaacatcatgaaatggctcgattgaccacccgaaactcactcgaggcccccaggacctcaaccaaacctaccaacatattccataacttcattcaaacttgttcgaaccttcggaacgctcaaaacaacttcaaaacacctatttttcattggattcaagcttaagaatttcaaaaactctaaaaatatgctttcgatcaaaaagtctatcaaatccaacggagcacacacgtcacattaaacactacggagctactccaacttctggaattccattccgaccctcagatcaaaatctcactatcgaaccggaaacttcaaaattttacctttcggcacttcaagcctaaattagctacggacctccaaaatacaatccgaacacgcccgtaaaacaaaatcacccaacggagctaaggaatcatcggatttccattccgaggccgtctttgcattgttccgactacggtcaactttccaacacttaaactctcatttaggaactaagtgtcccaaaactctccgaaactcaaaaccgaacatctcggcaaatcaaattagtagaaataaactcggggaaagcagttaataggggatcggggcattaattgttaatacgaccggccagatcgtcacacagttgttcttggacatgcttaacgcatataatcttcattgaagatgaaacaattcaagttctttagatataaagagtaggagaagaaatctataaagagcatacataaaaaataagaatactttgattccccaaagtattaattatatcccccaattggaagctgccaaaaaatctcaaagtagctaaagaaatgcaaagccctgcagaacttgtttgactactaaattaagtcagaaatataaaaaagaattgatcaaccaataaaagatgaatattttagccatcaaactagaatcatctaccgatgaagtagccatgattaattctaaatttataggtactgaaattttagtagacaatatgtataattggttgaatatataccttgacgaaaattgttgggtagatttcttaagctgtcattgaaagcaacttttctccaagatcaccagaaattgtagcgattgttaactcactttcatcagtaagatcaatttggaataattactcacgggacaaagtaaaaataatcactcacatgaacaatataccactgaaactactttctaaagaacatcattttagcatcgactctagtccttcgagaaattgaaaaaaaaaacatacagttaactcgccgaatcaaattacaaaaggaattatacagagttaaagaaagtaagttgatggtttccaataattgaatggctggttcttcaacagtaagcaactgaattacaaaaacaaactcaatccatacaacataaataataacacatattaatagcataaaaatctcaattaatgttacacactcaaccatcattcgtttctcccaaattctagcaagtctaactaataggtcaataaagatgggaagaaatcaccagcaaaataaatctcctaaagattactgatctgtgaggattgaatcacatgcataaaatataagttagagacgcaaaatgtaatcagggaaaacaatcttcaatctctgttgcactaaggatcaaataccagacatgtatgagaatatcagaccaaattactgacatgcatgtagaaaatccaacaataaactaccaaaaagaacccaaaaagggagtgagacagaatgagagagagagagagaatataggaaactaacatacatccagcagatagcgattagcaacgaaaaaggtgcaacaaacaataaaacagatgcaaagaaaaactcaccaaaacaaagttcacactttgaattagtgaacatcggatagagaatcagaaaatatttgagaaactctcaaaaaggagaaacggatcagttagatagagaagtaaaagaaaaggggataggattcgacaatgaccatggtagagtatcaaaacaagcaagacgcgtgtttatagcgtatcagtaaaagtctttagaactaatattataagtattaccaatttaaccttagaagagttcgcaatgctaagagtacaacgcttaaaactttttgtacaaccacctagagcagtgttcgtcctttcaaactctcatttctaaatagtagaaaaatactagtatctacttcatggaaaaaaaaaaaacataaatgatcactagagataatacatttgaactccaaagaaaatggacataatcagtaacagaataaaaatactccataaaatatctaaatttcctaagaaaaaacttaaaaaatatatttaaaaaaatatacattgaaaacatattaaaaataggaaaaatagttttaaaaaacagaaaacatacctctaagaaggaggaggaccggtcgaaatgaagacgaaaggggtttttgccttttattttccgacgatcgatgacttattatcgccaaatataattattttaagaaatttagtgaaagtcgagtgattttgtgtttagaaaaataagtttaggattttcgtgcaattataaactgagtgactgtgtaattaacccttttgtaagagttgaactctctgaagatataagtgtgtgtatttatttccctcttacatcctccaaaatgataatgtaagatgagcataaggacaactttcacctaattgtgactgaaatatgtaggagctgcctgtactgtagtaagtccatatgctagctattgataatgttaggatccgaaactcaggtagtgcggaatttagccaaataatattataatgtcaataataaagacaatgtaagttgataacaacgacaaaaaaaagataccaatttaatatggttcagtcagtgtgacctacgtccacaagcgaagaagagcaatttcaccataccaataagagtacaaaattagaataaatactctaattaatcccaaatacccgaagagaataacccactagatcactccaaagaaagggttcacataaatatttcctaacacttaactctcatacaaaatactcttaataactaaaggaggagaagaagaaacaagaaatgaagactcaagtcttgttggtgtgtctaaaatgaactaatggtctttggttttgtaggcaaaaaagccttggcctccaaggtgtaagagaaaagatacagcttgtgcaaatgatatctattacacaatgcaatatttttgggtcccaaagaatattatcaacaaggtctactttgcaaatatacttatgcttatgtgagatggagttcactaaccaaaatattggttatattacaaataataaaccacaaaaggaattccaacaattaaaaaatcttttatatatatgatgagagacaaaggaaaggaaaggaaatgatgagattccaatgttcgtactgcaataacatctgaaaaaaggaaatcaatacatgtcaaagttgaactctatataggagttttaggctaagaacgggaaaaaaaggagaattttagaaacagtaataagaaaaatgtaaaaagagaaagaaggatcaaattactatttacagctaattagaatattacatgtagtatcagcacaaagaattaagtaatataaagaaactagtctgtgaaatcgtttcagtgaactgcttcttggatcttggaaaatacagcttaattcctggtactagacggaattcaaacgcgttctttgacgtaatcgtagagatctgcaataagaaagaaaagccaataactcctattatattctttaattttccaacaaaattaattatattcttggtggaaaaactaaataaagtgttacttatataggatgccaaagtatgagaaagggaagggagcctataaaatatgaacatatatacagttgaggagaaaataaaggaaagtgaaaaacaacaattaattctgaaagtcgttaccttcatatatatatatgcgaagagcaagacaatcacttcccgccatggcagctacttcctcctgaatttctctggctgaatccacaattagaccgcatttatacaactcaattgactccaaggtgtatgtatctgcaaaggctataggaattcgcctaagaatcttgattttctccaatacgaggcgttgaagatttggaaagttaacattggtagcctcccagagttgtgtctctgtgtcatcaagtagaaggaactttagctgcttgaactcatcttcctcctttaatttccatacctcacctctgaatgcatgacatctaagtttgagtagttggagatttggtaacttggcaagatttgccatgtcttcccagggaagccaacttccagatagggtcaatctctttagcgatattgggaaacaacatttagccagagagagttcccttcatcaaaggaacactctaatactcggagtttattcaagtagagcaggctccaacatgtttcctctaatgctttgtatttttccccgatatcatagatacgtaatttctttagatgaggaaggccaagaaatacctcttttgtacagctagcaagacagagactggaaagctcctgcagatgttgcagacccaactcgtctaccacatatgggttgggcaaataagtgctaccatgtagacggagatgcctcagctgcttcatattccagatatggttaggtaaagttaaaattccacgccactccagattgtgatgaacaaaactaaaggtttgcaggttatgcatatattcaagtgattcagtaaaatgattgtctatgtgaatctcaagatagctgaatctaaggtcatgcgacgcctgaagatgaaatgatacctaggaatggcagccaacaccctcaaagctttgaattccaatggttttcctattgttttatgaggttccttgaaaagatacaagcaacgcaaaaattttgctgacttggtaaagttttcccctgaaatgcgtgtatgcaaactaaagcgaggagtctcataatgaaaattaggaatttgattagttctaaacacatccggaagcgctcacatccccaacaagtcatgcatacggcaaatttttgatccggccattgagtttcccccttttgaccattattaaatttctgctagccagatcttccaaacaatcctctgccactttttccaggcttctcagcttatccctcttcagaaaaccctctgcaacccacagacgaattaaccgccaagcatcaatctcagaatcctcagggaatgctcccatatggaggaaacaaggtttgaggtgaataggcaggtgatggtaactgatcgcaagcactgctatgcattcattcggataacttgtaacaacttcattcacattttcagatacagttacccagttttccctttttggggaaatcctagagagatgcccagcaaccaccaaaattgctagaggcagtccctggcatttttgtactattttcttcccgatatcttctaattcagaatgacaattaatgtggcttttccccaacaacttattctgaagtaacttccaactctcatctacccctaacggcagcacttcaagaggagggatatcagggttagcatactcagccacatcttttagcctcgtagtcagaatgattcgacttccattattgtcatcaggaagggttctcgcaatcaaatcccaaatctttgtactccaaatatcatcaactacgataagatacttccgacccttaagtgctttatatgactggtccattaactggtcatcactcattccctgaaactcgtatcctgtaaggctacgtgcaaggcttggcaacacttcgtttaagtgatattcttgagatatagtaacccacgtttggatgtcaaaatgtgatctaattgattgatcatcttgagcctttttagcaagtgtggtattgccacatccacccattcccaaaataggaatgacgttctgctcagaagctaatccaagtagtgcatcagtgagttttctcaaggaattcgccaaaccgactgtatcatcatcatcatcatcatcacctagaagggaagtaggagcaaggtttgaagaagaaccagctaccagagaatgtccctttttgaagaaatgatcctcatcatcaggggggccaaggcaacgagcataggtttcagtggagaaggagttaatccgcctcacctatttctttacagcatcaatcttgtctaccgcttgaggcaagactcgaagaagaacccctacttcatcctgaaaagtctcgtcaatattattctcttcttgttgcctccatcattctctcataatttccgcaacatttgattcaagcacatcttcagcttggtgcatcgctgatcttatctctgcctcaaaatatttgaatgtatcatattcctgtttctggtggctagcgttctcaagaatattttgaaaatattcagcactggcatggagagagtcaatcatctctgcagtttgaccatggatcaatgctggataagtcttttggaatagctccaaagtttgaattaaagagttcactgcaggataagccattactttcaattactcagtgggagagaaatgctttcaagatttactataagctctttcgaaacttatactagctagctagcacttaattttcagatcagcttggtcaaacagcaatttggaaagccaaatgggtgttcatggaggatggttctattttcaacattagtgcaaaagaagcctatttaaactaattagtgcaaaataagtctacttaaactaataagcgaaagagaagtggccttctatttaaaaattaaaataaattgatctatttaaactaaccagcgcatgcaagagaagtttacttaaactagaagtctatttaattacgacaaatggccaaatatacctttgtactgtaacaaaaaatttaaatataccctttgttataatttggatccaaataatactattgattctaatatactcctcttcttttaaaaatgttcaaggtggacattcaatcctacgtgacactgatatttgatgaggtggatgacacatgacataccacctcagcgcccataatccatatataaaagactaaaatttgaaatacaatattttttatggtagcgataatggtagcaatggtggtgggggggaggaaattttagtggtgaaaacaaaataggaggggtaaaatgggttaggggcgctgaggtggcaagccatatgacatccgcctcatcaaatatcagtgccacataggattggatgtccactttggacaaacttaacagaaaaacagtatatttgaaccaatagcataacgatatgggtatatttggactcaaagtataaagacagggtatatttggactcaaagtataacgagaggtacatttaagagcccgaaaccaaagtgtggtctttttggagtcaaacaaccaaaataggtgaaaaaaataacggattaccattttatatatagcggggttattcacggcgctataccttaacgacacgtttatccgaaaagcttttatgtgaaaatatgagatatagaaatttctagagttaaaatttgaatatggttgactttggtcaacattttgagcaaacggacccggatctgtgttctgacggtcctgggaggtccgcagtaaaatatgaaacttgggcgtatgcccggaaatgaattccgaggtcccaagccttagaaataagtttttgaaaaaaattattttgctgaattatttatgaaataaagaaaagaattaatgattgaaaccattggtatcgggcccgtattttggttccgtagccctgtacaaacttgttaaagtatttaaatgataattgtgaaatttggtgaaaaatggagttatttgacgtgatttggacctcaggttgaagagttatgaactttaagtgttcttgatgaaaatgatgagttttgaggattaatacatagttttacatgttattttcatgatttgattgcatgagtaagtccgtatgatgtttttggattagtgtgcatgtttggtttggagccccgagggctcgggtgagttttggataggccatagagtgaaatttggacttaggaagttgcaggttttagctggtatgttgtaggtctgcaggcttcgcaaatgcgataatcgacctgggctaccttagtcgcaaatgcgattgttctatcgcaaatgcgaaggtgatcgaaaattaaactgggtcgcaaatgcgaagggctcagttttctgaggggttcgcaattgcgaaccctgatcgcaattgcgacacctgtaacctgcaaaatcataacttagacgtatttcaacaatttttcaaaccctttcaaaaccaaaacactcttgggcgatttttcaaagacaaacactcttccaaatcaattgtaagtcatttctaacttgtttttattaatttttaacatcttttcttatgatttcaactcaaaattaaaggttttcatagaggaaattgggtgttttgggtagaacctaggtttttcaaattttggggatttggacctcaatttgaggtccgatttcaaaataaaatatatatttgggttcgtggaggaatgggtaatcgggttttggttcgaaccttgggttttgaccatgtgggcccgggacgattttttgactttttgggaaaaaactttagaaaacatattttcatgcattggaattgattcatttagcatttattgatatagttaagtaacttgtggctggagacgagcgaattggtggtggaatcaagaggtaaagcgatagttgaggcttgaattaactgcacaggtttatttggtagtttggttctagcctcgtcactacttcgctgaggttaggctaggcatttactagcacatggggtcagttgtgctgatactacactcttcaatgtgtgcagatacttataccggagcatttggaccgcactgagggtgttgtctttagtccattcaggcgacccgaggtagtctattcaggcgacccgaggtattcagagacagacttatgtatttcattcagaccttatttgtagtattcttagatagtccgtgacttgtgacaccaaattctgggtagtattgtactttaaattatgtagcagtgtttggttgaattattaagttttcgtattccgcatttctggttatttaatttatttcgctgtttaatcacttattattttaaattgtcgaacatttttaataaaaagtgtaatgattttataatattcggcttgcgtagcttccacgagtaggcgccatcacgactctcgagggtggaaaatccgggtcgtgacaagttggtatcagaactctaggttacataggtctcacaattcacagacaagcttagtagagtctgagggatcggtatggagacatttgtatttatccccagaggctacagagttaggaaaaacttcacatctattctttcctgtcgtgcggtctggtttctcaatgctaattaaatttctactttgttctttcctagatggcgagaacacacgcttcctcatcaattgataagcagcccgagcccccagcagcagctcccacgaggggcagagggcgaggccgaggtaggggcagagctcagcctagagcagcagcaccagcggcggagcctcaggttgagtttgatgatgaggttacgacccaggaagttccggtgggcctagctcatgtctcagaggggttcattgctaccccagtactccaagatgctctggtccgtctagtgggccttatggagagtgtcacccgggcatacttgcttcatcgtagcaccaaccatctctcaagctggaggaggagcccaaactcctactactcgcacttcggagcagatggctccccagtttcagactctaacaactcagccagttggagcagttcagccggatgtggtagctcagaccggtgatagagcagctatgtctgtcgatgccttgtggagattggacaggttcaccaagctcttcactaccacttttagcggtgcatctttggaggatccccaggattatttggacagatgtcatgaggttctcaggaacatggggatattggagaccaatgggatcgactttgctactttttgcttatctggattcgccaagacttggtggagggattattgtttggccagaccagttgggtcaccagctttggcttgggatcagttttctcacctttttttggagaagtttcttcccgtcactcagagagagatctatcgaagacagttgaatgtttccaacagggttctatgactattactcagtacgagaccaggtttattgatttggcccgtcatgatctacttatactccccattgagagagagagtgaggaggttcattgagggactcattcagcctattcgacttcagatggatgaggagacagggagtgagatttctttccaggaggtagccaatgtggctaggagagttgagatggttctatcgcagagaggtggtcaggagtctgataagaggcctcgtcattcaggcagattcagtggcgcctcatctggaggaaaggatttgtatggtagaggccaaccttctaggctttttcattcagcacttcaggtttctcacggtgcttcaggtggctgtggtcctcatatgcaatattctgatcagcagtcctacagtgcaccaccaactcctatcagtgcaccgtcgctttagagttttcagggtcgtcagtcccagcagccgagggcttgttttacttgtggcgacacgaggcatattgctagatattgccctcgagcaccgagcagttctcagcaccagagttcccatgccatggttcaggcatcgagtgttccaccgcccgcccaaccagctagaggtaggggttgaggtgctagaggtggaggtgctagaggtggaggtataggtattagaggtggagctcaggccgctagaggtggaggccagccagtagtagtccatcccagagatgtagttcagagttgtggggcccagcctcgatgttatgctcttccagccagacctgaggctgaggcttccgatttagttatcacaagtactattttggtttgtagtagagatgcttcagttctatttgatccaggatctacgtactcctatgtgtcatcttattttgcaccgtatgtggtcatgcctagtgattctttgagtgctcttgtatatgtgtctatcgctataggtgattctattatggtagatcgtgtccatcgttcatgtatagttgtgattggggggtcttgagactcgtgtatatttgttacttctggacatgattgattttgatatcattttggggatggactggttatcacctcaccacgcgatcttggactgtcatgccaagactgtgaccttagccttgccaggtttacctcgtttagattggagagggactcctggtcattctacccatagtgttattttatacatgaaggctcgaagtatgatcgagaaggggtatttggcttatttgtcatatgttcgtgattctagtaccgatgttccttctattgcttctgtgcctgttgttcgtgagcttcctgaggtatttccttcagacttgccgggtatgccacccgacagtgatattgacttctgcattgatttggctccgggtactcagcccatttcaattctattgtatcgtatggccccgcttgagttgaaagaattaaaggaggagttgtaatacttgcttgagaagggcttcattagacctagtgtctcgccttgggcgcgctggtattgtttgttaagaagaaggatggatcgatgcgaatgtgtatagatttccggcagttgaacaaggttacaatcaagaataagtatccattgccgaggattgatgatttatttgatcaacttcagggtgccaaggtattttcgaagattgacttgagatctggctaccatcagtggatgattagggcatctgatgtccctaagacagatttctgcactcggtacgggcattatgagttcttggtgatgtcattcgagttgacaaatgccccggtagattttatggatttgatgaatcgagtattcaggccttacttggatttgtttgtgatagtcttcattaatgatattttgatctattcccacagctgggaggagcatgagcagcatctgagagtagtcctccaaactttgagagatagtcagttgtatgctaagttttcgaaatgtgagttctggttgagttcatttgcattcttgggtcatgttgtatcagcaaagggtattcaggtagatccgaagaagatagaggctgtgaagaactggcctagaccagcatcaactacagagatccggagtttcttgggattggcaggctattatcgtcggtttgtagaggggttttcatctattgcagtcccgatgaccaggttgacccagaagggttcctagttcaggtggtcggacgagtgtaaggcgagctttcagaagctcaagacagctttgactacgacgccagtgtttgttttgtccacaggttcaaggccatatacagtttattgtgacgcatctcgtattggacttggtgcggtgttgatgcaggatgacaaggttattgcatatgattcgcgtcagttgaagattcatgagaagaattatccagttcatgatttggagttagcagccattattcacgcgttgaagatttggaggcattatctatatggcgtgtcatgtgaggtgttcacggatcacaagagtttacaatacttgttcaagcagaaggagctaaacttgaggaagaagatgtgattggagctattgaaggactatgatatcaccatcttatgtcatccgggaaaggccaatgtggtggccgatgctttgagtaggaagtcagccagtatgggcagtcttgcttatattccggtcggtgagagactgcttgctttggatgttcaatctttggccaatcagttcgtgaggttggatgtttctgagcccagccgtgtgttagcttgcatagtcgctcattcttctttactggagcgtatccgagattagcagtatgatgatcctcatttgtatgtccttagagacacggtgcagcacggaggtgccaaacaggttacattaggagatgatggagttttgagattgcagggtcgagtttgtgtgcctaatgtggatgggctccgggagttgattttagaggaggctcacagttcccgatattctattcattcgggcgccactaagatgtatcaggatttgcggcagcattattggtagaggaggatgaaaaaggacattgttgcatatgtggctcggtgtttgaattgtcagcaggttaagtacgagaatcagaggcctggtggtttgttccagaagattgagattcctgagtggaagtgggagcgtatcactatggacttcgttgttggactcctacagacttagaggaagttcgatgcagtgtgggttattgttgataggctgaccaagttagcacatttcattcatgtggcagtctcctattcttccgagaggttagctgagatctatattcgggagattgttcgtcttcatggtgtgcctgtgtctatcatttcggaccgaggtacatagtttaccttacatttttggagagcatttcagcgagagttgggcacatgggttgagttgagcacaacatttcatcctcagacagacgggcagtccgagcagactattcagattttggaggatatgctacgagcttgtgtcattgactttagaggctcgtgggattagtttttgcctttagcagagattgcctataacaacagctactagtcgagcatccagatggctccttatgaggctttatatggtaggcagtgccgtcgccagttggatggtttgagacggaagaggctcggttgttgggtatagatctagtacaggatgccttggacaaggttagtatcattcaggatatgcttcgtacagctcagtccaggcaaaagagttatgccgatcttaaggttcgagatttgtcattcatggtcggtgagcgggtgttgcttcgggtgtcacctatgaagggcgtgatgagatttaggaagaggggcaagcttagccatagattcattggcccatttaagattcttgatcgagtggaagtggtggcttacagacttgcgttgccgccgagattatcagtcgtgcatccaatgtttcatgtgtccatgcttcagaagtatcacggctttccatcccacgtgctatatttcagcattgtccaattggacaaggacttgtcctatgaggaggagccggtagctattctagaccagcaggtttatcagttgagatcgaagaatttatcttctattcgtgttccatggagaggtcagcctgttgaggcatcaacctgagagtctgagtccgatatgaggagcccctatccccatcttttccccgactcgggtacttccttcttatgtctgttcgaggacgaacggttattttagaggtggaggatgtgatgacccaaaaggtcatcacttgtgttagaaacaaattctgtgttccgaggccttaaacttcctttttacctcacctcaatttgcgtgcatggtctggacgtatatccggaaagcttttatgtgaaaatatgagagagagaaatttctagagttaaaatttgaatatggttgaccttggtcaacattttgagcaaacggacccggatctatgttccgtcgatccccggaggtccgtagcaaaatatgagactcgggcgtatgcccggaaatgatttccgagatcccaagccttagaaattaatttttgaaagaaattattttgctgaattatttataaaataatgaaaagaattaatgtttgaaactattggtatcaggcctgtattttggttctagagcccggtacaaacttgttaaattatttaaataataactgtgaaatttgttaaaatagagtttatttgaggtgatttggaccttcggttgaagagttatgaactttatgtgttcttgatgaaaatgatgcgttttaaggtttttttttttagttttgaggtttaattcatagttttacatgttattttcatgatttgattgcacgagcaagtccatatgatatttttgggttagtatgcatgtttggagccccgaggactcgggtgagttttggataggctacggagtgaaatttggacttaggaagttgcaggtctgcaggcttcgcaaatgcaaagcttggctcgcaaatgcgagagagcatcgcaaatgcgataatcgacctgggttgccttagtcgcaaatgcgactgttctatcgcaaatgcgatatcgcatttgcgaaaggtccctcgcaaatgagaaggtgaccggaaattaaactgggttgcaaatgtgacattatcttcgcaaatgcaaaggtgtcaattttctgaggggttcgcaattgcgaaccctgatcacaattgcggcacttgcaacctgcaaaatcataactaagacgcacttcaaccattcttcaaaccctttcaaaaccaaaacactcttgggcgatttttcaaagacaagtactcttccaaatcgattgtaagacatttctaacttgtttttattaatttttaacatattttctcatgatttcaactcaaaataaaaggtttttatgggggaaattgggtgttttgggtagaacctaggtttttcaaattttgggggtttggacctcgatttgaggtccaatttcaaaacaaattgtatatttgggtttgtgagagaatgtataatagggtttttgttcgaaccttgggttttgaccatgtggacccgggggtgatttttgaatttttaggaaaaaacattagaaaatttattttcatgcattggaattgattcatttagtatttattgatataattaagtaacttgtggctagatacgagcgaattggtggtggaatcaagaggtaaagtgatagttgaggcttgaattgtgttcgtggcatcgaggtaagtatttggtctaactttagcttgggggattaggagtcgagtcttaatttctacgtgttaactgtggagtacgatgtataggcatggtgataagtatctatacgtcggtatcaagcatgcccgtgaatcttgtattgaaattttatgactccgttgtagtttattcgtgcttcatatgagaattatattattattcccttgccgggatgttgttgtgatattattgttcccttgctgggatgttgttataatattattgttcccttgcaggtatgttgttattatactattatttccttgccagaatgttattgttacattattgttcccttgccgggatgttgttgttatactattgttcccttgccgggattcttttatgattggtgttgataaatgaaataggagcgggttgcacgcctgcaactgtaatatatgaaatgagagtgggttgtacgcttgcaacggtaagatttgaaatgggagcggcttgtacgcctgcaacagtaatatatgaaatgggagcgggttgcacgcctgcaacggtaatatgtgaaataggagcgggttgcatgcctgcaacggtaatatgttaaatgggagcgggttgcatgcctgcaacggtactatatgaaatgggatcgggttgcacgcctgcaacggtattacatgtgtacttgttttccttatttccttatcttttgctggtaattgatttatggcgttccttacatttttctactgttattctgttattatctgttactccccacaacatgtttcccctgcccaactttaacagtaattatctacttttatttccattgtatatgatttaactgcacatgtttatttggtagtttggtcctagcctcgtcactgcttcgccgaggttaggctaggcacttaccaacatatggggtcggttgtgctgatactatattctgtactgtatgcatatactgataccggagcgtttggaccgcagtgagggtgctgtcttcagtctatttaggtgactcgaggtagtcctgcatgcatccgcgggccttggcgtctcctcatatcttttctctttctgtttttacttattcagagacagacttatgtatttcattcagaccttatttgtagcattcttagatgctccgtgacttgtgacacaaaattctggatagtattgtacttcaaattatgtagcagtgtttggttgaattattaagttttcgtcttccgcattttcggttatttaagttatttcgatgtttaatcacttattattttaaattgttgaacatgtttaataaaaagggtaatgattttataatattcgacttgcctagcttctacgagtagatgccatcacgactcccgagggtgaaaaatccgggtcgtgacaggatctcgtctattgctcgtttcggctaccaaatactcaattttttcatatttcaaaaaaaattaaatctaggtgtcacgacccaattcccgaacccggtcgtgatgacgcctctcttgaagacaaggccagctaaaccaaaacagaatacctcttttaaacagttaaatatcattaatcgttctaaagcatgatataatatccataatttgcgaaattaacgataacaacagtaaaagccatcccgacatagcccaaattggggtgtcacaagtcatgtgcaactaagagaaaatcgtgatacagtctactaatcactaaactcgatacaatagttctaagaacatgaaaatgataagataagggaggcacgggggctgcggacgccaacagctacctcgtgatctccgaaacactgcctggacgggaagatcagcactcaggagcggactttgcgatgcctgaatctgcacacacagtgcaagcagtaatgtgggtactccgacctagtgagtaataatcataaataatggctgaaagcaagaaaacacataaaggcacaaagcaattctatatcaagtagtaaaatcacttaaagcaatagatcggtgaagaagtcaaatggaatccctttaaaccaagtaaaacaggtaatttagcaggtaattaacaagtagaaatccacccctcgggcacagtatcaatcactcaaaacggtatcagctcctcgggatcactcttatcacttagtgctcattctaagctcttgacccatatatctctcataataatagaaatcagaataaccgctgcggcatgcatcttgattcgtacatcgttgtggcatgcagcccgatccttatagatagtcgactgcgctcactgggggtgtacagactccggaggggctcctacagcccaagagctatattgctgcagcgtgcagcccaatccatataagtgttgcttcggcgtgcagcctgatccataacatatataatatcctcaccattgggttctcaacccctctctgtcatttacctcacagcctctcgggcacaataatagaagatacggatctcagcccacaaattcctctcatttaggaatagtatgataaaattcgactcgaatcgtttaaaacagatagaaacatgaccgaggatatgatttttaacaagtatagtgaggaaaaatcagtcaaaatccccgaagggttcagatagttcgcacgaagcccaaatatgacaattagcccaaataatgatgataacaaataagtttcagtcaaatatgcggtaaaatcatcagtcgggacggaccaagtctcaatccccagtagtaaaagaccccacgctcatcatccagcgcgtgtctcacctcaatatagcactacggtgtgcaattcggggtttcaaacccacaggacatcatttacaatcattactcacctcgaaccggctaaatctctagctcgcgacgcctttgcatctcaaatcggcctccacgtgcgtcgaatctatccacaatcagaatgaatacatcacaatatgctaagggaacaaagcccaagcgaaaacaatcaataacaggcacaaatcccgaaattgccaaaacccgagccccggacccacttctcgaaactcagaatttttcacatcattagatgtcttatctccccacgagttcatatataccaaaagttctcaaatccgaccccaaatggtttttcaaatcccaaataaatgtccaatttctcaagccctagtacttcaatttttaggtttagtttccatgaatttctaggtggatttcacaatataatcgagttttaagaccaagattcttacctcaagtcgattcctcttgaatccctctttaatttccttcaaaaatcaccaaaaacgagcagccataggtgaaaatagacccaaaatcgcggacaagacaacttaaaaccattctgcctaggcctgactttccttcttcgcgaacgcggtcaacatctcgcgaacgcaaagcacaaaattgcgttgaccagctttaccttacgcgaacgcgacatgccaattgcgaacgcaatgcttccatggccttgaccttcgtgaacgcattcgctccttcgcgaacgcgatgaataactgaccattagaccaaatcctccttcgcgatcgtgtatacacactcgcgaatgcgatgaagtcccctaacaagccttcgcgaacgtggcatggaccctggagaatgcgaagcttacgaaacccggcccttcgcgaacgcgaaggccaaaatacctgcaactgctggaacaagatctgcaattttccaaactctaaaatggtccaattgaccacccgaaactcacccgaggcccccagaacctcaaccaaaggaaccaacacatcctaaaacctcattcaaacttgttccaatcatcaaaacacctcaaacaacaacaaatcactcataacatatcggattcaagcctaagttttctaaaaacttccgaaatacgctttcgatcaaaaatccaaccaaaccacatctgaatgatctgagatttttcacacacatcctaaatgacataacgaagccactgcaactctcggaattccatttcacctcctggattaaaatctcacctaccaaccggaaatcgccaaaatctcaacttcgccaattcaagcctaattctactccaggcctccaaagccaattccgatcatgctcctaagtcataaatcacccaaggaagctaaccaaatcataaaaattccgatccgagctcatatacaaataagtcaactcttggtcaaacctttcaaattcgaagctttcatctgagactgttctttcaaattccttccgattttcctgaaaaccaaaaccaacgatctacatcattcataatacattacacggggaaagtcatgcccgagaactggcgatcaagtgaaaaagctcaaaacgactggtcgggtcgttacatcctcccccacttaaacacacgttcatcctcgaacgtacctagagttgttctagaagccaatcaataactgaataactttaccatgcatatacccgggggattatcccacgtcaccctatctcatataggtccgataacatattgaaactaaaattacgcaatccagtctggcccctaagccatagaaccacatttccacttctgaaaccatcaatacgatcaaagcctcacacctatactctgaatagactcgaaccagctgtaataacccatgcctgcaacctcgggagcaatcccatgatataccacataactcaaacactcgtagcgataacttctattcacagcagttgtccacaacaaccgaatactggtagaaaatctcttaccagccaaagtctcattccaaaactatcaaatactgccaacgataaatgaaatacgcaataaaccataaccattttcttagatcacccattcatgaagcaacttctcctctgacaaataccatagcaaatttccgagccgaacctcgatattaaccttccaacatgctgaaatcgaatccgttcgtattcattgatgatcccaacgatctcctctaatccaacacaccactctggtgacatgacacatcaatagaggcctaagccacaactcaagctcactagtaccaccacaacacaaggctgagaacctgtctcacatcatataatagaacatatgaatctagcccgcaagttcatatcccatatagcttcattgcaatgtgcgatcctatcaaacactgctccacatgagacacctcaagtcactatgctcgaaattgacaaccacgcacaatttgatgtctggaaccaaagcagatcattacacccacggtgaaacaagtaacatataccacgcaaacccgataggacataaccaatacgccgttcaccgagcaacatctaattactcttcccgctcgacttccactatgaaccccaatggaaccgcaccatgtgtgctcataaccaacaaatcataacgtcttgcaacacataaaggcaacccatagatcttcccagatcactaataaactcaataatagttgaatcaacctatccctcaacaatacaattaggggccaaccaagccgactcaagatagaacacgtatccatattggcctgctaacgaactccttaccaaggaagcttaaagctgccccttacactactataactcccgctgaagccatacgatacggtgcccgacaccaaattaataccaaaatctgcaacctcgcccggtgacatgcccggccataagaaacacatccgaaaagttcctcaacactggaactgaatcaatggtagaaacctctgctttgacattcatcacgaaggcccaattaagaaaggcaatccttcctagacgtccgctgggtccttgaaatataaaccactatactagaacataatccgatgcacctcgccacttaacccgtggcatttccggcatagccaaaagcgcaatagttcggaataacccaacatggagacaaccagtctaaaccccaacatcacatccaaaatctaatataccaagcaaataaagatccactggggcctccaaatcccggtagttgctaaacaatgccgatacacacaatctacaaccacaacatagcctgaatatgagaactttcgtctccacatccaaacgacacatgaatcaccatatccgatcccaattttgccatccgaacacatgccacacctttaatacccaatcattccatgatagatactctaaaattcttttgtgcttccaagcaaactcgaatatcagcagccgatctgacaagaagtgctgcaatactaccggagtaccatcaacttaatcacattgcctctgtctgaatatatactctcgtccaatcacctcaattaacattaccctttctttaatcatctaaagatcatttctcaaatcatctgaaggtcatttcttcaatttatctaaactgcccatactacataagaatttatgacctttctttcaaatttgaaccgtgaccttacacatgccaatctcactcctatacaacataccgcataaaccgtaccattctaggataacaacaagaaccttgtatctcttccgagccacaagaaactatgtactcaaccaaccaagaacttcgattgttcccatctagaagaaaatcactatacataccatgctcctcatgcccatagaaaatatatatttccaaccgaggtcgaaaccatcaagaactctccgagttccccttgcacaaaccagacctgccaggactaaatccttctaactcaaccgagctatgcagatcactaaaacccaagagaattgccgagaaacacatgtagaaactcattatctcgcaagcatccgaagaactaatcatatccttaccataccaactcggcctactaccaagctatcccgtatattcgaatttccttctgatttaccttcaacttgatactcattcttgctataacatcacaattcctcaaaccagacttaccacacgggacccaagcataaagccataccgtctaaggctcataagccgctgaatactttctcagatattcccacgagcaccactatcaaagtactttgctctgaagagacttcctgcgaatctaaatctgttacctttaccttcccggtactgatacatagaatttcataatttataaagataataccacaagtctcgacatcttctaatgaaaactcaggttctaaccacatatacaactttaaaatacccaattgttatatgtaaaatcttgaacacattagaaccattctcgagagtcattcactctattcaaactgcaattagcctgatcaaatgaacagaagcacctgtgcttcaatagcactccgacaccgcagggtgtaatctcatcctagaacaaccaagccacttcctgctctatgcaccgagcatccattaccacaacagctcaagacactctaagattcccatacatctatgaagcatgacataacctctgtcaaaatttttcctttactcaagacatccacgatctcaatctccgtaatccatgactgattcaccagtgcacctcaaactggaaccaacatagcacataactgtgcaatcaacaaatcaatagcagactcccccacttggctcgaagccatagatcaaaacacatttaatatctcgtaacacatatactctattaatgccataataccatagtgagattaaactcaaagccattgtaagcttgcgaaaacacagatcatctagtactttaactcttccgcaaatctcgcattcactctcacaatagttaggtcccctctcttaagcgacccatttaaattacaagacatatctttcacttgcaaatgagatcttctaacagacagcataaagatcgcacaacttccgaactcttcgtaggagataacccacctgatttgcctcaaactaacattcccgcataccttccaccgtcgtaaactttacgcagtcacttagtcttcctgagtctgaactcataccgcaacatgaaatttacttcacttccaactaggaaaaatgaaaagattcttcacacgccaacaactcgggctatacctcaaaccgagatggaattcaaacactaatagttcttctatcctccagcggacctttcttgtcgcttctaaatcatatagatacgtctcgcaatactaacacactcatcacatagccatccagtcgtcgctcccactaacagggacagtaccaaacatataagttcaaaaacacttgctcacataatcagcacctcggtgctcaagccatagggaaagatctggcctcaagtcctccagactggctcaacatcaactcacagagatcacatctcgccccccgatctaggactcataagccatcattgcaaatctgatactgagcgctcatgcgtgcatacgaatgcgtggaaggaattcaaagagttacagttcaagctgaatcaaggacgcacgataaggattcaagaacatgaagttttcctaaaggttctgcaacctctcgaggataaatacaaacgtctccataccgatccatgagactctactaaacctgctcatgactcgtgagacctatgtaacctagactctgataccaacttgtcacgacccaattcccgaactcgctcgtgatggtgcctctcttgaagacaaggccagccagaccaaaacagaacacctcttttaaacagttaaatatcattaatagttctaaagcatgatataatatccataatttgcgaaattaacgataacaacagtaaaagccatcccgacatagcccaaactggggtgtcacaaatcatgtgcaactaagagaaaatcctgatacagtctactaatcactaaacccgatacaatagttctaagaacatgaaaatgataagataagggaggcacgggggctgcggacgccaacagctacctcgtgatctccgaaacactgcctggacgggaagatcagcactcaggagcggactctgcgatgcctgaatctgcacacacggtgcaggaagtaatgtgagtactctgacccagtgagtaataatcataaatagtggctgaaagtaagaaaacacgtaaaggcacaaagcagttctatatcaagcagtaaaatcacttaaagcaatagatcggtgaagaagtcaaatggaatccctttaaaccaagtaaaacaggtaatttagcaggtaattaacaattagaaatccgcccctcgggcttagtatcaatcactcaaaatggtatccgctcctcgggctcactctcatcacttagtgctcattctcatctctcgacccatatatctctcgtaataaaagaaatcagaataaccgttgcggcgtgcagcccgatccgtacatcgctgcggcgtgcaacccgatctttatagatagtcgactgcgctcactaggggtgtgcaaactccgaagggtctcctacagctcaaacgctatattgttgcggtgtgcagcccgatccatataagtattgttgcggcgtgcagcccgatccatataagtattgctgcggcgtgcagcccgatccataacaaatataatatcctcaccattaggttctcaacacctctcagtcatttacctcacaatctctcgggcacaataatagaatatagggatctcagcccacaaattcctctcatttaggaatagtatgataaaaaatggcttgaatcgtttaaaacagatagaaacatgacagaggatatgtttttaacaagtatagtgaggaaaaattagtcaaaatccccgaagggttcaaatagttggcacgaagcccaaatatggcaattagcccaaatcatgatgataacaaataagtttcagtcaaatatgtgttaaaatcatcagtcgggacggaccaagtctcaatccccaatagtaaaagatctgacgctcatcatccagcgcgtgactcacctcaatatagcactacgatgtgcaatccgaggtttcaaaccctcaggacatcatttacaatcattactcacctcaaaccggcgaaatctctagctcgcgacgcctttgcccctcaaatcagcctccactcgcgtcgaatctatccacaatcagaacaaatacatcacaatatgctaagggaacaaagcccaagcgaaaacaatcaataacgggcacaaatcccgaaattgccaaaacccgagccccggaaccacttctcgaaactcagaatttttcacatcattagatgccttatctccccacgagttcatacataccaaaagttctcaaatccgacaccaaatggtctttcaaatcccaaatcaaaagtctaatttctcaagccctagttcttcaatttttaggttagtttccatgaatttctaggtggatttcacaatataatcgagctttaaaaccaaaattcttaccacaagtcgattcctcttgaatccctctttaatttccttcaaaatctcctaaaacgagtagccatgggtgaaaatagaaccaaagtcgcggacaagacgacttaaaaacattctgcccaggcctgactttccttcttcgcaaacgcggtcaacatctcatgaacgcgtagcacaaaattgcgttgaccaacttttaccttacacgaacgcaacatgcccgtcacgaatgcaatgcttccatggccttgaccttcgcgaacgtgatgaataactgaccattagaccaaatcatgcttcgcgatcgtgtatactcactcgcgaacgcaatgaagtcccctcacaagcctttgcgaacgcggcatggaccctcaagaacgcaaaacttatgagacccgtcccttcacgaacgcgagatccacttcgcgaacgtgaaggccaagatacctgcaactgctggaacaaaatctgcaattttccaaactccaaaatggtccgattgaccacctgaaactcacccgaggcctccgggacctcaaccaaaggtacaacacatcctaaaacctcattccaacttgttccaatcatcaaaacacctcaaacaataacaaatcactcaacacacatcggattcaagcctaagttttctaaaaactttcgaaatacgctttcgatcaaaaacccaaccaaaccacatccgaatgacctaagattttgcacacacatccaaatgacataacgaagccacttcaactctcggaatttcattccgactcccggatcaaaatttcacctaccaaccgaaaatcgccaaactctcaacttcgccaattcaagcctaattttactccgggcctccaaaacaaattccgatcacgctcctaagtcataaatcacccaacgaagctaaccaaatcataaaaattccgatcctagctcatatacaaataagttaactcttggtcaaacctttcaaattcgaagctttcatctgagactgttctttcaaattccttccaattttcctgaaaaccaaaaccaacgatatacatcagtcataatacattacacgaggcaagtcatgcccgagaactagcgatcaagtgcaaaaactcaaaacgatcagtcgggtcattacacgaggtattctgacttactttttgataaaactcatgtatataaaattcttatttgttgttttttaccgtggtctatattttttgtgatcattttgtgatttaattaatttgttatttttttatcccgattaaaatatttatgtgctaaaaaagtagtaaaaaggtatattattttatgaataaatattgttatatgtgattttatttttgtacgtatattaatatgtgactttattgttgtttagtgccttttagtgttatgttgtgttcttaattgttatgtagtgccctttagcatagtaaaactgatgataaattttagcttatggtaattgactttgtttatggccatttagagtagtgttattgtagtactctttaagattatttagtgtagaataaaaaattatgtgctctccttaacaaactcgggtagagtacttaattatatatttaatgtatcagtatataattatcaaatattagataggaatcataaaattatcatttgccgagaactggcaaaatatgaagttaacaaacaaatcgttgagaatggaataaattcaatattatttactattaagtttgtggtattttttatatgattaattattgagtatatcttgattacttatgaaattgtaatatattataattctattataattcaaaattaactttaaaaagatgatagttcaaacaaaaccatgtagaattttagtacaaaaatgttggaaactaacatatgaaatattaatacataaaatttatcaacctaagtatttgttaaatgaatagttattaaattatatttatagttattgaaattaatcatttaattatttgttaaccccaaaaatatacgaaaaaagattaaaaacaacatataaaatatagagaatttgtcaaactaagtattttctatatgaatacttattaattataacacgtatatttatgaaaattaattatctaattctattacatccaaaaatagctgagtaagaaaaaaaaatataaaataacaaattaacatataaagtaatgtaataaactaacatataaaatagtaatatataaaatgtatcaacctaagtaataatagagaaacaatatcgattaaatattaatataaaagatattgaaatatatttaaagatgttaaacaattaaacagaaaatactttaattaatattgttcaatttacggacatcgtcatggaggttccccctgtgcatcctggacttgcatctcgagagctactcttgctacagggcaaccataggtctttacacatctgagatggacagtgtctgccccggatattccgccccagacgtatagacgatatgtgggagttcactagggaccacccactgcatccccttatagttagacacctccagaatacgggtttctacaagatcatagagatcggccggttgcagttcgactgggctttaatgggttcatcataccattctttaaaagcacattgatttttgtcctaccaatggggatgataacacaacactattaattaacatgttatataaaaactattaacaaacattttttcaaaaaataataacttactagttgttgatacgtctagcgtctgcgccctagattgtaatttgaccaacatggcttcaaaattgcatgttttccacagtaacacattggtatgccattgcgtccagacatgatgtaatgctcgaaaaataaaaaattaatggaaagttgttctattcgttttgttacaatacaaataataactaaaatgtgcgaggtttttataggcagctaagagtgattttaggttacataacacatattggtgatgtgctatgttacccgtgctaatgtttctttagggtacaagtgggtgcagctttttagatcgacaactttttcagctccacaattttttcaggccgatatgacaatacacataatgcatattggtgacgctctatgttacccgtgataatgattctttagggtacaagactgctttttcaggtcgacagctttttcaggttaacatgacaatacacataacgcagattggtgacgcgctatgttacgcatgataatgattctttagggtacaactgggtgcagcttttcagatcgagagcttttccaggtcgataacttttttaggtcgacatgacaatacagataatgcatatcggtgacgcgctatgttacacgtgatatgattctgtagggtacaaatagatgcagctttttcaggtcgatagctttttcaggacgacatgaaaatacacataacgcatattggtgacgtgatacgtttaatatacaagttcatgcagtttagttcttcttaagttgaaccaagaaatcagtattcaaagactatttgaagaatcattgcaacattcatttaaaaaatgctactaacatttaataagtggttcaagaagaggtaaaaaggtaaaggtagttcatcaaatccacatggaacacgtcataatacaataaattcctacctgaaaaacatatgctaggttgttatactggtttggttgatgacaagtggtatggtattctacgtcccttggaaaataagcctatcaatatacacagtgatctcaaagttgcagggcacattattgagggcaaaacgcattctatagagcctgaaggtatgcgaatttagggagaaaaactacaataagttcccctttactcaaaacggtgtaattatggagtactatgtcactggcatggtctaggtgcaccacaagcactgtctgcaaccttccaaacaaacacacacaaagatgaactagaagtgattcggcctttgatgtagagattttagagatgaaaaaggcactagccgttcatcatgcactggatgaacttaactacctggaaggaatggaggatcaatgttggaatttattagaaaataaaaaattacgtagagacaataattatcctatttacccaatagctgtcgagtgggagggactacctaagtttctaccacagacgttggatgtaagagtcccatattattgtagaaatcaagcaagtggttttactaatgatatcgatgaaatacgagaaatgtgtgtcaaatagggcctatattatgatgccctcgatccgaagggtgcatacaagatgttgacgaagaagatgaagacaatgataatgaaatagtgccagatagtgacgataatggcgaataaaaattgttatttatttcttgtggtatatgttaaattgttgggttgaatctttaatgctaaatatcaattagatttaatcctattggaaacataattatattttagaaattttgcaaactgaacatttacagacatttagtacaacaaaaatactgcaataaaacactacatttatccttgataattgggaacattagatgaactgccacctggagctgaattaccaccattttccaaactagctgaaggacatttacggcggtcgtatcctgtttgggaacatataccacatttacgcatataaaagggtatcaccaacatccatttggttctgtatgcacgttcttttttgcacttaccgttgacgcacataatccttattacacaccattttaaatgattccggtggccaataatgctcagtacccactagctgcaactgtccactatatatgtttaagtatgcaacaacattatattctttatcaatgtacctcgttgctgcgaaacctgtatgttgaaagtacttcatggtatgtgagcatgaaaagtgatagattgaccattttccataggagcaaaatcttttggatttattgacaacatgtatattattctcgcggttgtcatgcagaccaatgcgaacttcaaaaatatttagcttgctgcaatactacaaaaattcatgccaccgtactcgcttcttatatttctcaaatcgtttcattgattgtggtataagttcaacacccctttccatcaatgacgatgcacctctagatctttcaacaaacctctctgccatctacttgaatgacatacgcaccatggcagtgacatgcaatccacgtgcaaacttcaataacctgttgaaagactctgatatagttgtagtcaaaatttcgtcaaaatttcccatcttctactaccattcatatgcaaagtccactagtcaagctcatgtcgcatcaaccaacgataggcttctaggtcttcctatctaatcaattccttttcctcctgaagttacactcttggtgatctgttacagccatttaaatcatgtaattccttgtttggataagccccctagaagttggccttcaagtaccttacatagtaacagtggtaggaatacggttcctgtcatacacgcaaattttgtacagaacttaaaataccgccatgccgatcagatattagacaaatacctgaacattgtttgacaacgtgctccttcaagtggttcaacaataatgtccatgtctcttggctttcattggaacaaatagcaaatgctaggggaaatatacttccattagcatctactgcaacgacgatcaacaacttaatatcctactttccatagacatgagtgccgtctatggatattaccagcccacaatgcacaaaaccatcaatgactggtttaaatgcccagaatacatatctgagtatgtattctagtattttcggactccgctcaagcttccattcaaccacagtcctgaggttaagtgttgcaatgcagccatgtacttgggtagagcagaaaaggacttatcccaattaccataaacaatttcaaacgcacgtttatgctcgagaaatgcttttttgaggtgatggtacatctatattcctggtggacagattgtcacgaccccaaaccggactcggtcgtgatggtgcctctcataaagacaaggctagctgacacaattcccaaatcaaccattttccatttaaaagtggtttttataccatctataaaccattaatgtcataatgaacattgaaaagaaaaatacggaataattacacaagctcgacatcgggtgtcactagtcatgagcatctaccaaggtctgaatacaacaaaaacagtcaagtgtactaagtacagaaatggaaatgagctgaagaagtagtgttgcgaacgtcgtgcggccaccttgctaactctgatgactccgcgtctgagcaatcaatacccgctaccgggttctgaaatacctgaatctgcacacgaggtgcagagagtaatatgagtactccaacccagtaagtaataagagtaaataaagactgagcagtaggaatcaatgaatccacattcatgataactcaataagcacgtaggttgctaattcagaatacgagtcgatcgtcttatttaaaatctagccttttggtaaaaattatttaaacaggtgaaaatactttttgacagtttcagtaggcgttcaataccatttataataaaagagatgaaaaccataatcggcccctcaggcaaaacatagttcataaactgcccctcgggcaaaaaaataaacaggaatcataaactcttcataacatgaaaatctcagtggaaataacaaagccaaatcagtgattaaattctgaacatctcacaaaccccagcttaaatgaaagttgttttaaaacatttgttcaacactttcgatagaggctcaatataaagatgagtgaaaacagtcaataatcaacatattcgatagaaactcatttttaaagaggagtgaaaaaaaataaataagttcataaagaggccccttatgcaaagcatcactcatatgcatgtatatatctatcgcccctcgggcaagcctctcagtcactcacgactcaactcttactaatcagcgctcacacttagcactcacactcaataggtaccatatagtaaccgctacggcgcgcagcccgatccatatgtcgctgcggcgtgcagcccgatccatatatatatatatatatatatatatatatatatatatatatatatatatatatatatatatatatatatatatatatatatttgcggcgtgcagcccgatccatagatatataatctctaggcccccggcctctcttagtcattagcctcaccattagactctcagtctatctcagtcatcaatctcacaatcagaccctcagtctatctcagtcattatctcatgatcactcggatcatcagtaaaacaggaaaatagtttccacatttttaagaatatagtgataaagccagatttgagcagtaaacaggtaaaacataattgaggatatgctttcaaataaataaagggaggaaagatagtaaaaatacccttaagggtctcaacaagtcggcacaaggccccaaacatggcatacaacctaaagtacaataacatcaaatggttaactatcaaatacgcattaaaatagtcgttcgggatggactaggtcacaatccccagtggtggtctaccccacgcttgtcatgtagcatgtaagtcacctcaaagtaacacaacgatgtgtaatccggggtttcaaaccctcaggacagtatttacaatcattacttacctcgaaccggctaaatctctagctcgcgatgcctttgcccctcaaatcagcctccacgcatcgaatttatccaaaatcagaacgaatacgtcacaatatgcaaaggaaacaaagcccaagcgaaaacaattgaaaaataccaaaaattccgaaattagcaaaaactcgagccctgggcccacttctcgaaactcagaaattttcacatcattagattccttatcaccccacgaattcatacatatcaaaagtcctcaaatccgacctcaaatggcccctcaaatcccaattcaaaagttcaaaatctcaagccctagttcttccatttttaacttaagttccatgattttctaggtagatttcacaatagaatcacgttgtaggttcaaaaatcttacctccaatcgattatccttgaatctctctttaatctccctcaaaaagatctcaaaatgatcaactatggaggaaaaatgacccaaaattgctgatgaaataacttaaaaactttctgccccgcactgctcgttccttcatcgcgatcacggcacaagcatcgcgatcgcgaagagcaaatcttcaagacctcagcagtacactacacgaacgcaacaaataccatgtgaacgcgatgcttcagcttaccatacctatgcaagcacgagccctctagtgcgaatgcgaagagaaattcctcttggaccccatttcttatacgcgaacgcggacagcctcatgcaaacgcgaagcaccagctcccagccttccatgaacgcgaggccacctatgcgaacgcgaaggtctaaattctggccttccaaattccttctacgtgatcgcgatataccccatgcgatcgcgaaggcttaaatgtctacaacacctgaacaatttttctacaacattccaactccaaaaatagcccgattgaccagctgaaactcaccctaggcccccgggacctcaaccaaaagtacaaacacatcctaaaaccttgttcaaacttgttccaatcatcaaaatacctcgaacaacaacaaatccaccaattcacatcgaattcaagcctaaatttctaaaaacttccgaaatacgcttttgatcaaaaacccaaccaaaccacgtccaagtgacctgatattttgcacacacatcccaaatgacataacgaagctacagcaactcggaattccattctaacctctatatcaaaatctcacctatctaccggaaaacgccgaaatctcactttcgccaattcatgcctaaaccttccagggacttccaaaatgtattccgatcatgatcctaagtcccaaatcacctaatggagctaaccaaatcataaaaattctgatccgagatcatatataagcaagtcaaatattggtcaaacctttcgagtttcaagcttcaaactggaaactgttcttccaaattcattcagattttcctgaaaaccaaaaccaacgatttaaataagtcataatacatcacacggggctagtcatgcccaagaactggtgagcaaagtgcaaaagctcaaaacgactggtcgggtcattacacagatgttataaactctttgatcttgtaccttatggatgcttcaatgtatgtaatcaagacaagagaaatcaagccaacattaaagttaaaatgattcctactaaatgtgtccatttcacaagtgtgggtgccaatgtgtttccccacaatccacatatttgttttcaactttctcgcacgcagcatccaattacaaccttgaaaccatctatgacaaataaccttgtatacgtccgtagatgactcatgaaccacgatatcataacactcttttatgttgtactttcgcaccgctctgcttaggcacgctttatcagcaaaaaatatattctttgatagcaccgttactctagattcatcccccattgttgtccaaattttgtcaagatcccttgtgagggtatccatatccggcatacttggaaaataatcaaggtagaaaatctcccttgaatgaaacgacacatgggactcgtacactcttggtctaacgggaggtggagcatgctccctcgtcaaatttggttcatcattctcgtcctcatcatcatcaccctcatcagggaagggtgtgtcatctctaaactcatcaacattgttgtcataatcactatcatcttcccgactctgcgcatctgccagatcccaattaaatatgtcgtctccgggtaattaagtaaggacatgaccttcaagttgctcgttttcacttcacaaccaataaaataatgagtttctcaaattcatccaaacattacatataaactgtatcacttaacttacaaatcataatatgttgatatcccatgatgcacattatcctgttgctgatgactcctggatggaccaccatgatccaacataccaaaactaggcatattccaactgtccgttggttcataacttgtaaaattcatatctagtcggtaccccctgtggaatatatcagtgttaatacaaacataatacataaaaataaacatcgtaacacaaagaaaaattgaagtttactactcggtttgtggattatgtaaacttggggaaaaattatatcctcgctcctcattcacccgtgaaaataagtttagatctggctaaactctttcacttgaaacctgttcggataaaattgctccaattaagccacttgataattgcgagatatcattattttacggaccctcaatgttgcgaacgtcttcagccttggcatacatttccaatatttttatcacaagaagttttcggttcatccgaagtcctcataaaatctatcagagcttcatcctattcgatgtttaactcagcataccaagtaaccccttgcggagtaatagattacggatatcttcctgttactttaatattaaccgaacgtttgtgcacactcatttttttacataacaacgatactagtctatcgtacttcattgtaagtggcaacttaatatgacactgtagataacaactatagcatactgagttattctctaccacaatctcaaccccccccccccccccaatataataaaagcctaatttttctcacttcggacattatgacaaatattttggaatacctgaaggatcctaaatgaatttttaccaaattctgaaactccttaaataagaaaaaataccagtccgggggtacaataattgaggtatagcgcatgtataataggcgctatatatgtagcgtgtatattgcatgcgctataccctcaattattagtgggtcaacacggttcagataaaatattggtggggcaggaaagttcaaatatagcgcggctattcaccgcgctataccttaatggacaaacgtgtcgttaaggtatagtgtggtgaatcaccgccctatatataccacgctatatataaaatggtagtcagttatttttttcacctattattgttgtttgagtccaaaaaggtattgttgtttgagtccaaaaaggccacaatttggttccagactctaatatttaaatcttttctaatagtacaagggtatatttgacatttctttccgatttaattaaattactcagctagccagtgtgtaagagaagtttatttaaactaattaatgcatgatggttatgtccatcaattgaaatcaacaatggaaaagattgtagaaaacatgtgattttactgatcgatgttaggaataaaaacttgtaaaaccaatgttgggagttgtgatgacccaagagatcatcacttgttttaaaatgaaatttctgtgttctgaggatttaaaaacctcttttagcatcacctcgatttgcatgcacagtccgggtgcgtagtcggaaagcttatatgtgaaaatctgtgaaaaatgataaattttgactataaatgaattattttgacttcggtcaacgttttgggtaaacgaacccggaccggtgatttgacggtcccggaggatccgtaggaaagtatgggacttgggcgtatgcccataatcgaattccgaggttccaagcccgagaattgaatttttgaagaaaattattttctgaaattttttaaaggatttggaaatgaattttgattagaacgtgttggtatcgggtccgtattttggttccggttcctggtaaaggtcttatacgttatttaagataattctgtgaagtttggtaagaaacggatgtcatttgacgtgatttggaccttaaatgcaaatttgattttttaagaagtattgaaatattttattgattttgaagtttaattcgatgttgatgatgttattttggcgatttgatcgcacggataagttcatatggtgttttggagttagtaagtatgtttggtttggagcccctagggctcgggtgagtttcggatgtgtttcagaaggttttaaactcttaaaaagtcgcaggttttcagttgctcgtattctggtattttcttctttgcgttcgcggaggactctcgcgaaggcgatgagttaattgtgctgaaggaaaattccttctatgtgaacgcgagaccgaggtcgcgaacgcaaagctttggggggtctacccttcgcgaatgcgggcctggtatcgcgaacgcgaaggcttgtggcttggttaggggaaagggaaaattatacctatgcgaacgcgactacttggacgcaaacgtgaaggctcaaggagttacttctccgcaaacacgagccatcttctgcgaacgtgaaggtctgtcatacctaaccatcgcgaacgcgatgaccaaatccgcccagttattttaaaagtccagaaatagaatgcattacaagatttaacccatttttcacaaacttcttcttctccacacctcttgggagatttttggaagaacttcttcaccataacctcatgggtaagtaatctttgacttgttttcttccatttttatcaacatctactagatttctaggcctaaagcatgagattaagggtagaaaattagggatttgggtagagttagggttttttgattatttgggaatttgacctcgttttggggtcggattaaaaaacaaattatatattcggtttcgtgggtgaatgggtgatcgagttttggtccgaacctcatattttgaccaagcaggcccggggtaaatttttgactttttgggaagaatgattagaaagccataattaagcattggaattggattgtttaggatttattgatgttattaagtcaattatgtctagatacaattgttttggagccgaattcaaaaggaaaagcggtgtttgaggcttgagttgacttttgaagtttgaggtaagtgttcagtctaaccttagcttgagggattaggagttgtgtcttatttgctatttgtttcttattgagtacgacgtataggcatggtgacgagtatctatatgttggtgtcaagcatgaccgtgggtcttatattgtgattttcatgacttcgttgtgttattcatgccttggtgaaggtttctattattgtgtaaagtttgtggaaagaattgtgacctatgaacattgagtagcgttgtctcaagttgtataacgaattgtgaaagtataagtgataattgaacctccagagcactgactcgagttgtgaagtgaattgtgaagtaaaagtgagaaagagaagagatcattatgttgcccccttgccgggctattgttgagttgtggtttccttgcattgtgttcttaattgacattacgaatgcttaggttgatgattctttgcgttgggtaaggattatggttattctcggggaacaagtttggttatagctgaggtagttagatgttgtaacaagtttggttatagctgaggtagttaaatgttgtaacaagtttgattatagctggggtagttagatgttgtaacgagtttggttatagttgtttctcccttgccgggacgtaattgcttatgctgtcggatcccttgccgggatagtgtagaccttgttgatcccttgtcggaactctcgttataattaaaatattttatgtggatcaggttgcacgccgcaacaatgataaatgatatggatcgggttgcatgccgcaacaaaattatatgtggatcgggttgcatgccgcaacaatgatatatgtgtatcgggttgcacgctgcaacaatgataaatgatatggatcgggttgcacgccgcaacaatattatatgtggatcgggttgcacgccacaacaataatatatgtggatcgagttgcacgccgcaacaatgataaatggtatggatcgggttgcacgccgcaacaaagatatatgtgtatcgggttgcacgccgcaacaatgataaatgatatggatcgggttgcatgccgcaacagtgttgttatatattgggatcgggttgcgcgctgcaataattattgatacaagtgtgtttagcgtggatattagtttcttttgttttgctgtgaattttaagctgcccttagactgttacttttgatttactgttaatactggtatacccccgtagcatgtatcccctcccatccttacttgtttatttctgttttattttccaatgtacattatataatacacaggtttatttggtagtctggtcctagcctcatcactacttcgccgaggttaggctaggcacttaccagcacatatggtcggttgtgctgatactacattctgcactcttttgtgcagaccccagtgttgtagacttcagaccgcggtggaattgctgattcttgttcatcaggcgacccaaggtagtcttataggcgtccgcaggccttggcgtctccttccatctactattcctgtttctttcatgcatttccagagacggtattgtatttatttctttcagacctttatttgtagtgttcttagaccgtctgtgaaactatgacacccgttctgggtagtcgagattcaaacagttgtattggattcatgttctgatagcttattgctttttcttccgcttatgttaaattccgctgtttaaatgttattacttcgaaattgttaatgaatataaaatgggtaaaaaggtaaattgtgcaaataattcgcttgcctagctcgtattagtaggcgccatcacgactcccgagggtgggaaatccggatcgtaacaggagttgacctcatgttctccctttcttaattctgagctacgattcattgatatcaactaacaacaaaagattctgaaaattaagttcacacttcaaattttgcggacatacgttatgaataaattaataaagtccacgttcagtgtaccctttttcgtcggagctaggttctattcctgaaatcaataagaaattgatgaaactcacatgcatgattttgccaatgtaatgactaaaacgaacttctgcatccactgtaggaactggatttccacgctctctctcttagatcaatgaaccggccaggcaagagtttcagatatcacatcagggcttcaactttggagttgacaagttgttatgagaaaaatttgcaaatgcattgtcggattctgtgctctctcttgcttctgggtcgcaattgttaaacgaggccacattatattggtccctttaaacacgcggtcattcaattcagacgaaccgaatctgaacaaagaaaaagtatattattactttaaatatatttgtttttattgttatttaaattattgtatcgtattgttaaatttgtcgttacgtaacaacgtaacgtacaattttatgtaacgaccgatttggtgtgacattgttaccttatttttttaatcatattgcccttccttattaatcatttatcatatctttttatatactaataatttattttctattaactttttctttgtaatattgcaagtttattctttatattattggtatatgacatcatgaaaacaacgacaaacgatacaatttatccaaacattgtatcatcaaaacaatatataaaacaatacaatataatacgatacatgcattatgaaacaatttgaacaaccatataatacgttacatgcacgaaataatttgtaacaaccatccaaactagctgtaagggaatggaatctgaaaaaccaaaggaggaagaaaaagaagaatagtagaaagtagaaacaatcacacctaccttcctttgctgcttacaaattgccatttagacaagctcaaacctttttaaatagtggtagattagattttagtatcttgtagttatttccatctaaattcacccaaagtccaagataaatttctttagtgtttttcagttttagaatttaacatataaaatatattttatacataaaatttattcgattcgattcgttatttttcagttttttacaaagctaaaaaaaactatcataattctccgtgaggatataaatttatactgaaaccttattttactttaaaaacctgataatcaactccgttaggttcagtttggtcaaatggtcggttttcaaagttgttttgacacgggtagttgcaattccagtggcctcactactgatgatctcaaatccctaatctcacaagtgagtattactgaattaattatgtaaggaataatttcaaagatgtttcttcgtgtttccctctatcacattatctccctcatggttcataatattatgtttaccttcattattttaattattttgtaataattttctacctatttttcattaatataatatagtttgagaaactctcctttttctaatattaaattttttcaattaattatttctatcaaaatgtcatattttaaaaattcttttaaaataaaatcagaaaacgttcaaaattacacttttactattattgcgatgagtttgcatgccacatggcatccacctcaacgatacgacatgccacgtgaggtaatggtgccatggtggagggtccgaacaccagagggctatatttgcaccaattctattacatcgggggctataatggatcaatagtataacgaagggtataaatgaacattttcaaatagtaaaaggataattttgaaccttttctgaaataaaattgtttaccctaaaaacggataacaattaaatttatatgtggttttaaggatatgcgaattaattcaatacaaatgataaattgcgttagattaaacagatagaaggacgtaataaattgtcaactcacttaagaggaatgattccgagttcggttacagccttaatggaatgcctgccttcgatcccggattcaaaataacgaagcactgatgagcaaaagtaagaactttgaataatggacaaaatgagagtatattgccttggtatgcgtgttacaatgtgtttttaatgaataatcagagcccctttatatagttggggagttttatcctaagcacaattccataaaaggtaaaaatcttccaattaactaatcaccggttctttgccgatacgtgccgagattcacgccgtgatatctagctggtcgtgaatattacgacattttgttgatcgtgttcggttacctggtaatgctctccgaggcctttggggttcgaaccggacatggggtcatggccccgatactcacgagggtaggtgttttacccgaaccccggatcgaacagctccttgcctcgattccagttccttgccttcatgtctctcactctgtttacttcatcggaaattgaggcgtcccgtggttcagtttcatccatacacagatagtccactcgtttctcggagggtaagtttacgaaaacgatgagaaacgacatgagctcttcgattcattctccaatacgtcgtgacagaaacgacaaagaatttgaaatgccccgtcagttgcgtcataatgacttcaaacgcgtgtctgccatcggcaggctatccctggacgcgaaacggcgcaaagcctctataaatactccctccttcgttcattttttacttttgaccaagcttctaccttccaatcttcaagatatcactggctttcttcatactccaacatttttaccttcatttttcaagatttctcggtaaattgaaaacttttatttatgttctgtccaaaccagcatacttgattccttcatctcccaatattccttctcactctcccaaacttttttccatataacaatggtgaagacttctaaaatggctccccaaaaagtcacttcttcttctcaaccgaccaccaaaattgatgaaaccactcctgatgtggtcgacctggagaggtacgctgctgatgtggttaccgatgaaccggctatcgaacctcccttaaaaatgttcattcccgagggttgtttggtcgccgacgactttaaggttgagaatccctcttcggtgtagggtcagcatgaggaggcatcgagatatatatgctcgatcaccgaagatgtcctccttgaagtccgaaatgactgcaactgggcagataaggacatagtggtccccgaccctgaggaggccattactacccatatcgagggatatctaagtatttacacttatcccttcacactaggcccggtggacccgaccattatagacttctgttagaggtacaaagtatgtctcagtcaaatccacccatcgctgaggaggattgcaatcttcattcgattcatcgtgaacaagatcgactcctatcagctcacggttgatcatctactccgcttgtacagttcccgaatcttctgagggggctaataaagctcgtgcaccgaactaacaaagcatcattctcaagcatcgatgaggactggtattgaggctggcatgggagctttgctgggtaaggacctcagacttgatccctaccaaatttaggccattccccgagaggtggaatgcatcacgtaagcacgactttcctttaaatgttgatttatgttcatctcttttttcctcattggtatttgtggtggtacaattgttgctcgagtccccaacactatccctcggctcaagaagtggattgaggatatcatctcacagatgccttactccgagcgctcgtggcgcaaactctcgaagggccgttggtaggctcgttcccatggtaagatttatttcccaaataagttacattaggcttctccttctagcatcacgttctcattttcttgattcctctactttagggcagctcggggctgcatcaggagagaagaagaagaagaagaaaagaaaggctttgggttccccgagctcagagaagaaaaaaccgaagagaagattggcctataagccaaaggatagctccagctctcgagcaccagactcagacttgctctactggctcagggaagagcatgaggaggatgatctttttacggcctacgaaccgacctcccccaaagagcgggcgatagccgaggaggagacaacaaaggcctgtctttctcaggttcgggagaccgatgtagaaacgagggctcagccttctcgagacgctggctctgctccacccagcatcaaagaaatttctgggtcaccttctttcaccgaatctatgttggacaaagctcgagcggagaaggagagatataacgaaggggcctatggtgtggacgacccccttcgttgcctttttgaaggtgtggactcaaccgccctaaaagacttctccggttgggttatttggagctgccgagactatctttggaggtcagcgggctgaactcgagcccaaaattaaacaatcgattccctgccccgagcatggatctcgacaaaaagcagtcaataatcatcactgtcctggtagatgccttggttcttttcgcccccgttggagtagctagataccttcggtgcctagtaaccaataaagagtaggaaaagtgaatgaggtggacacaccgtgcttgttcaacaaagcatagcaggcgctgaaccaggtaatgcatcattaccctctttcatcttcgtattttagtctttgatatctatgatgccttttttttatatttttgcaggctttggtacttcatcataaaaattttctctggtaccagcctgaggttaaccagctcgaggctgaggtcaaggagcttgctgagaagagggacacatataagtttctcagcgagaaacataaggaagcggtcaagagtctttgaacaaagtcggacgcgggtcagaaggagcatgctgacctccgagtcagatgaacgaggccaagtccatggctgaaaggtggaaagaaaaaatggatcgattggcttcggagaaagagactgcccgggagcaactgacatcggtgtaggtccaactccgagtggcaaaagagaaggaaaatgcatgtgctcgacaaatcgatgacctccatgctcaactaggctcagctgctgctaaacgggatacctttaggaaggagctcgaatcagtgaagtctgtgtcagaaataactaggggtgatgctgaagagatggtggcccagtacagggccgatgtcgaggtagcccaggacctccttaaagttactattgagtacgtaagtggttgtcctgaagggagactctcgaggaggtccatgtccagggtttctacctgttagccgagattgaagatgcaaaaaggctcgaggccgaggccaagaagctggctgaccccaaggatggggagggctatgagggctccggtgaccccgaggatggagaagaccctgacaaccctactaacgaggtgggttctggtgaagatcgggcttaggcgccttaaggatttttctttgtttttgtattttgtctattttgttgaggccattatcgtcggcctttgtaaagacttttattggaatgtatataaggcgtttttccctttggtgattttcgagttcgtttcttttggcttcctctttatgattgcaaagatttcaaatgccttagcacggaataaaatgtagtactaaggccttgttcggaggttcaaacaagaaaagacttgttctcaatgtaatttttgtttgaaactcgtgggggctcgatatgactggaagctttacccaaagtgcttatttagatgtttttaaattatagttttaccgagggtagcctttgaaacagtttggaatttttgaaggccttatgttttgattacgggttttggatgtctacgagccatttctagggtggctgtagccttttaagttcagattatgcctaataggatttgtactttcgggcttcgatacctgagccgtccgaacttgccttggacgacagtccccgagtgggtgtgatctctttgaactggatagaggcagcccttgtgctcggtatccttaaggaacaaaatgtaatagtctgaagggacaaaatatgtatctacaaggtggaaactttctttcattcttgtgcggaatatacaagattgtaagtgtgtacaagctttgtattagggcttaagtggtctatgcggacacggttcatttgaccatttggcccttacaataaatcttatcccacaagaccaaaatgttcaagcacatagtttccttccttgctaaaatcagtacccgagggtgatggcccccagtattctaggtcgatcgtcgagaggtcttggatattgttgatgtgaccctcgattctggttcataaccagtttcgattctaagttagcatgatccaatgttgcctcattaaaaacttgccgaaaaacccatttgggacaaaaccgattcaagggaaaaatagtgcaatgcgtgctttcaggcctaatagctgcatcattccttggatattgcctgcaagttttctaattcgtaatatacataaagagaagaatgaatggggtcataccttaacaatagtatcatttttagtgggttacattcaagttgtttggtagtcgctcaccattccctactttgggtttgtatgaacctttactggtaatctctacagttagatatggaccttcccaattcggtcctagattccctttgttcgggtttcggatgttcagtgtcacctttgtcaacaccaagttcccaatattaaaatgtcaaaggttggctatacgactgtaatacctttcgatccatcatttttgggcggccaaccggacaagggcggcctcgtgcctctcgtctaataattccaagttcatgctcatggactcaccatttgactcttcaatcgcatatcgaaactgaaaatagattctcctacctcgaccagtgttagcacttcaacacagtagaccaatgagaatagggtggccccggtactagattttgaggttgtatgatatgcccacagtacttcgggcaaaatttccttccattttccttaggcgtcggtcaatctcttcttaaggttttggagtatggtctttttagtagactctgccttccatttccactagggtgatagggtgttgataggatctttttgatcttatggtcctcaaagaaaattctcaccttactaccaatgaactgctcatcgttgtcgcatacgatcttggccggcactccgaaccggcaaattatgtggtcccaaatacaatcaataacttctttcttcatgactttctcaaatgtccgggcttcaacaaatttagaaaaatagtcagtcataaataatataaattgagtcttgtagggtgcctatggcaggggaccgacgatgtccattccccatttcatgaatggcgaaggtgacaaaactgaatacagcagcttcccaggctggtggatcattggtgcattcctttgacatccatcgtattttcatacgaactcctttgcatctttctccatgttgatccagtagtagccggctctgattatcttaagaacgagcgattcggcacccgaatggttcccgcaggtgccttcgtgaacttcctcaagacatatttggtatttcccggtcctagacatagggcgagtggtccaatgaacgttctccttaatagggtgttatcttcgaacatacaaaacctggccaccttcgtgtacataactcttgattctttagggtccgagggaaacttctcggtcttcaggtaatctatatacatgcttctccaatcccaagttaagcttgtcaagtttatctcgacgtggccctcttccactaccaatttcatgagttgtacaaccgttcccgagctgaattcatcgtcatcaaccaacgatccaaagttagctagagcatcggcctcgctattttgatcccggggtatatgttgtagggtccattccttgaattgatgcagtgttacctgtaatttatccaggtatctttgcattcgttcctctttcacttcgaatgtcctattgacctgattcactaccaggagggaatcacacttagcttcgatcacttcggcccccaagcttttatctagttcgagacctgcaatcattatcctcatactcagccttattattagtcaattttacagttctaatatattgcctaactacattaactattggtggctttgacatgatgccaagtctggacccttttgcgttcgaggaaccatccgtaaagagggtccatatccccgaggaagtccccgagttcaacaacaattcccttacaacctcaagtattaggataggcgtgaagtcggccacgaagtctaccaaaatttgggatttgatggcggtttggggtcgatattcaatatcgtacctgcagatttccatggcccatttggccaatcatcttgagagcttgggtttatgtattatgtttcttaacaggtaggtagttacgacacatatgggatggcattgaaaatacggctttaacttcttggaggcgcttagcaaggtgaacgccaatttttccaagtgaggatacctagtttctgtcacgacccaaaatccactaagggccgtgatggcgccggacaccattgtcaggcaagccaacactaaataactagtaatttctcgttttagatatttctgaattcagttcttttatacatttaaacaataaggaataaattcccgctgaataaataatgatatctttaacaatttcaaaatactgactacttccatagacatcctagaacctggtgtcacaagtgcatgagcatttactagagaatgaaataaaatatagaaactgtccgaaatacaagtagacagaaatgaaaatacagtacaatactctgaaggagactccgctggctacgctagtctcgataactgcaactcacataagtctccgtatcaaccatgccgctatgccactaagccactagccacacataaacatgtgcaacaaaaatgcacatcaagtgtagtatgagtacgaaaacaacgtgtacccaatgagtatcccgtctaatattgaagaagtagagacgagaggtcgacttcgacacttattagtggtccaatagtaatatattataaatgcaagtaatcatggagttattaagaccggtagtaatttcaaataagtcacgaacaggtaaaagttccttttatattaaaaatatccggattcataatctattaatttccaattatctcaagtcagggagagcaaatatcagtatcgataaatctcaaggcaagcaataaaagcatgcgcaaatcctgccgaggacgtatgacccgattcaacaatatttaaactatgcactgccagagcgtcgaatgatgcaaaccatagatgcatctatttaatcaccgaggcgttcgacccgttccgaaattaaacacatacagacagtcaatcaagaaatcaacaaggaacaattatccaaagaaaagcctttaacaattttataaaactgaagtttaatccttttagaaattcatttaccaattcaacaggatttaagcaattcagttgtcaataagattaaaaatattccaagtatagcatgctttttgggtcctagactacctagacttaaacataatagtagctacgcatggactatcatcacctcgtgcgtacatagcccccacaaataggagcacataaccaattatttcaactatggggacaattccctcttacaaggttagaaaggagactcacctcgctccaaagttccataatcggcattccacgcccttccgaagactcaattcgatgcaaaaatgctccacaactagccatttatcatctaagcccattaatatatgctcaagtactcattataatccaatttataacaatttctaaccccgatcgaaaagttgacaaaattgccctcaggcccacatgcccggattccgaaatttctcgaagataaattttacccatggactcacgaactcaaatatatgattttctcttaatttcatacgcaaaattgtggtcaaaatccaagaatattaattttctaggtttcccctaaatccccaagtttctaccaaattttcatgctcaaatccgcacataatcaatgtatttaactcaagatagatgtggttagcttaccttgtcattgatgatgaaaaaccccacttgaagctctccaaaagtgtccacaccatatgaaaatgggggaaaaaaagaccaacccccgattttaaaagaacttactgcctccagcacttctgcacctgcggtcacatgaccgtttctgcggttccacaggtgtggcccctttaccgctcctacggtttctctccaggctccctttttccgcttttgcgccttaacttcgcaggtgcggtcccgcttctgcgacgagatgactgcatctgcggtccttacacttccaacccaaaatcgcatctgcgactctcctgactgcttctgcggctccgcacctgcggccaaaaactcgcaggtgcggttacaccagatatcagctgcctcaatccatcctcaaattccaaaattgatctgttaaccatctggaatccactcgaggcccccgggacccaaaccaatcataccaaccagtcccaaaacacattacagacttgctcgaggcctcaaatcatatcaaacaatgcaaaaatcatgaatctatctccaatccaggcttaatgaactttagaatttcaaacttcaacattcgatgctgaaacctataaaatcacgtccgattgacctcaatctttttgcacacaacaaaaagtccactttcggtcaaacttttcaaaaaccttcaaatttctatctttagccaaatgactccaaaatgacctacggatctctaaattcacttctggtcacgcccccaataccagaatcaccatatagagttattcctggaatcggaatctcaaacgcacattgataaccctgaaatgcacttcaatccaaacttatgagattcttccaaaaatgctaacttccataataggcactaaaacgtacccagtccggacatacgcccaagtccgaaatcatcatacaaacttgctggaaccttcgaatcccgattctgaggttgtttactcaaaaatccaatcttagtccattatttcaccttaaagcttccgaattgagaatattctttccaaattaactctgaacttcccgaaattcaattccgaccatgcgtacaagtcataatacccgaagtgaactgctcatagcctcaaactactgaacgacacgctaaagctcaaaacaaccgatcgggtcgttacattctctcccacttaaacacacgttcgtccttgaacgtgctaagaactgcactgaagttgttctaaatcactgtctaacacctcgagcacctacccacgctaccacaactcagctgggcaccctagctcgatcaatctgaagataccctttttcacttaggcaattaagccttagagcccaattccaacattcgaaattctctgccaggcttgctccaacatatgctcacttaatcaataactacacgcagcaccaaaacatgactgcataccttagttgaattcacaccttgcaccactttactcacaggaccacaataacattctcttatcaatttaatcaaaattccatgactgtgatgctcccattgcacctcatgacatacataggtcttgccctaactcttacaatacccccacgacggaaaagagtgtagaaattcataactaactaccgaatcgacaattcattgggtctatattcctttcaggaaccatcaccctattctgaaccaaataatggtctttgctccttaatatacttcatataatcatattgcaatgatcctaaatccaatgatctcagctcaccccgtccgtactactcaggcaataagccatccaaaacatgatcaaaagtctcatatgctaccacaatgtaccaatatgctaccaattcgaacatgatacataaaggaaatgaactctaaaaaggaaatccaattaccccgcttgcgaatcataatgcgacgcggacacatagctaatacgagttttccttagaaactaggaaacaaaatacataaaaatagatataaggaactgtactcaacatcatactgttgcggcgcgcaacccaatccaaacaacatacccatggtggcgtgccacccgatccacacataaaattcacataagcagttacacattgagctagattgctcattacaacaaaatatcgaatatcggtcacaagcacgctaagtgcataataccatccctagggagatatatagcgctataagctacaaactcaagcacaactggggtgcgatatacgatctgaatctcaagagccattctgctcatataacatcatctctacgcggaacctcaacacataagaaattcactaagccatctcataactcacacagcgcaatatatcattacatgaaatagctgatgacgaggtaataccccgactactctcccataaggagcgcattgctgaaatgaacacatctggcctgatatagagcccatattcacatttaaatccatccacagacctcaagctgattctgatcgcacttaactaggctaataacctttcaaagatccataatcaccccccttttctcataacacacaagaacaaccatcataatcggagtagtcctccacaatccacaacccaataatcgagtgccctctagtcatcaattctcaatttaacgacatcactacaatcttcatacttggtttaactcttcaatcagtcaagtggttgcatgccacatgttacaacccatattcacgtatgttagctcatggcataaggtattcgacgtaaatccataaagagattatctttaagatgataagaagttaatcttattggtcttaaatgatacaagcgtgtataaggggggttaacaagtattataagttaaacgaatcaaggatattgttagccgtatttttgggtaaacctagaggttcttaatacactcaagaggtagtgttttaaggtgtttgaatcatataatatccgtatcataagtcttgaagtgaaacaagttatgaaacaaaagtcgacaaaagttgccgcaacttaggttcatagttttacttaaacattaggtcaaatgttactaagattttctcccaatttacttagaattatgggatgatatacccaccaaatttaagatctatgagtctagtttccaacgcattaaaccgtttgtcgatacaatctcgaagtacagagatatttgtatttttgtgagactgcgccaaacacctctctatagggcccacttaggcagtttaagacatttggatatatatatatatatatatataatgatgccaacccatttaagttaattttttcactatattcagaccttagaaccctagaacatcatatcaaggttctctcaagattcaagacccaaataaaggcaaacaacacaaatcaagtgtcgggaatcctgtggcgctagtaagtttcttgttcttcttgttgttgctcatttttgtgttgttccagctcgtgagggaggttgttttaaggggtttatgttctgtaaatggtgttaaccctctagcctgatttataactaaattgttgcagtgtatcgataatggtggcacagttcttagtgtttgctgtagcaaataggcttagatcatcagcaacgaataggtgggaaatattggagcctgtgtggttgatcttaatggggaactagctaccattctgcgcttgagcctcaatgctcctagataggcttttcatacacatgatgaagatgtaggaagacatagggtccccttgtcccatgcccctgctaggatgaaagaaataagtcatacccacattcactaagatatagataaagctagtagatatacatgagaggatcaacttagtcatattattagggaaatcaaaggacaccagggtatctcttataaaagaccattctaatctatcaaaagccttttctagatcaattttaaggatcatgttagcatttttccctttcattttattgaaatggctaatatattttctgcataatgatggaattgtcactagccctcccattggacaggaagttatcttgactagggccaatgttagaggggaggacaagtttgattctactaacaattattttagtgatcaacgtgtacattgtattgcagagtctaattggtctgaaattcttaagaattgtggcattgtcacacttatggataaagcataagtaggttgtgttcacaacatgcttcatttcaaggctgtggaaaacctacttacaaaaattggttactttatctttggtagaagagtgggtgaaggccatcaggcctatggtacttggttagtatgaaagagaacatagcagccttgatctcactgatccttaagggggcattcatattagtcttattacaccccatgttttcgtacatgaaattacgtcgtaagtcagttgatgtatgctcggaaattaggtcatcattaaaagtatataaagcaagttaatcatattactttggaggttaaaaatatttaagatcaataactacaagtaccaataggattagaaggtttagaagctaaacaaatcgaagaaaataagtttcgtcgaaatagcaagtcgggaatattataacccgtactttttgggtcatattagggttattaatatgataaggaggtgatattatgaggtgttttggtcatattatagtcgtgtgttatgttttgaaatcaaacgaattaagaaaaaaggtcgacaaaagttgtcacaagttacgttcataatttacgtaaaatttaggtctaatgttactgatcttttctctcaatgttattggatttatggggttattcatccaaaaaattgaatataaatgaatttattttccaattcattaaaccgttcatcaatacgatatcgaagtggagagatattttgcgagactacgtaagcagctccctttgggacccacaaggtcagttgaggattatcttgatatataaagttatagccttcatctctaaggctcatttcgacccatataagacctaaaaagtatctctatatatcttaaatacatccttagggttttggagcaattccataatccgcaactcaaaatcaagatgcgaacacatcaatgcgattctcacgacatatgtaagactttgccatccccttactccttataactcatgttttggaaagagcttcgtggctaaggaagattttctcctctatattttagttatacaagcataattaagggtatggatcaaagggaacaagttttggaagtgagaatacaagaggtatatagggttttcgtttcatttttgacatgatttgatttaactatgttctagacttttctcttaatcttttaagggttgttcaaggaaaattttagcatatatggtatccttgtataattcaattccatatgtgaattatggaagaaactagtttaggttgaaacttcaaagtacaataaaaacagaaagagtgaattgcccatttgacgtatgtcatccggacatatgtttattccgttcctttgatgtttttacgtatacctaacacccatataatcataatagcttcagttaagtatatataagcttaattattaggtgttgatgcatagattaatcctaaatcatatttatactttcatgtcacaagttagccactatgagtcgacattacgtcacagttctgttcatgttacgtcacaagttagccactatgagtcgacattacgtcagagttggacaaatatttagtttaaagggcatcccgttcctcaagttcttaatattaaccctaggtgatttcaaaccttctaaagtgattctagtgccggaaaatactaatagattgctagtttcacttccttgttgttgtgacagcattatagggatatttcatggacaattaaggtcaaattggagttgttctttctggctaaaggtaaggaacctcttactctacatgtatttaagattatccaagttgcggctaagtcattgaagctagaacttgtgaaatatatatcaaaaggcttggtagtaatgttatcggttggtggactattttgggaggttcaatatgattaacattgatgttgttttggctatttggttattttttcacttgtaggaagtcatataaataggggaggtgctgttcgcttcctcgtaaaataggttgtgttcgatacatagtagttacgacgcctaaatgataacgatagtgtcatttcttattgtaggctaaggagccgtgaaattgcatatcttgaggttgggaagaatatacaaggtatgtgaggctatccctttccttcttttgcacgaccccgattgtacataatgtaatgaacaagattctaaagatactctactcttagaagctagcagtacttacattgtttccctttttatggagcgattgatgttgatgttgcatctcttattcttatgttatcaatgttgttggtatttccttattcttataagattaatgataaagcgttagtcctaataagtgtacagaggataccgaccttaatcactccggaaggttcaaaatattattccaatgagtccagcatgcattgtatatatgtatctattttactctaccgagccgcgctatagacggccgggtacaacacctattgtgcaaccactaatcaattgggttttaccaaactacatgtggtcgggtacgattctaccaagccttatgatggccaggtacgattttaccgagtcttttttgaggtcgggtatgatatgatgatgatgcccacagaggcgtgtgttttaaaagtttatgtatatatatttttgtatcatgcatttcatgtcagtagcctacagaggtacccagatattacaggttgtatattctctatccttattcacattactatatatacttatgtttttcttccttgcatactcagtactttattcgtactgacgtcttttttatttgtggacgctgcatcttgtgctgcaggtcctgatagacgggtagatgcagctcccccaccatagtaggctgcctagttcagcggttattgacgagatcccttctccggacttgtcgtggtcttggtatgcatttttgttatagacattatgggtatgtcagggccctgttccggctatgtttcaacacttatgttcctttagaggcttatagataggtgttggctcatgtatagtttggtatgccttgtcggctgaatttttgttgtatagcctttcatggtagcgtggtagctcgtaccttatatataatttcttgattatctggtcatcccatgttatgtatgttcatgccatcatattttattgttggttgtccatgatccatgtctaccatttatattgatctcgtcatccctaaaagataataaagaaggttagataaaatgtacgttggtgcttggcaagtatggctgggtgctagtcatggcactccagtttgggtcatgacaaacttggtatcagagcaagtgtgtcctaagggttgtctatgagacgtgtctagtagagtcttgattatggatgtgtagcgcgccacatttataatcaggagggtacatgacatctagggttgttaccttcttcctgaatctagatcgtgcgtagagttgagtcctaagtgttcgtctctaatattcaccttattctctttcagtaatgcctttgactaggaagcaaatgattagtagacggcttgatatagaagcgagagagggtaccagtcaggtgccccaagctagatcaggacaaggtgaggctcagagtgagatgccctctcatacctcatctactctatctcctccagaggatattaggaggcaccgagcacctccagttcctccttctggaactacagaccaagatatgtggagtgctttgcagttgttgactagcttggtagctgctcaggcttagacacagaatacaggtgatgttgataaactagttagtacgagagttcgtgattttattaatttagaccctccagtgtttaccggatcagaccccaaggaggacccgtagacttttattaactaggttcatcgtacactgtggggttatgcatgctagtgatatagaggtagtagagttggcttattatcggttacgggatttaacggttttctggtatgatagttgggagagatccaggggtccgaacgctccttcggctgtgtggaaggaattttttgaggcctttcttcgtcactacttgatagttgagatacgatgagctagagctgataagttcttgaaccttaggcaaggtaatatgagtgtgcgatagtacagtatgcagtttaattctttatcaaagaatactccccatatggtggccaagatgagtgatcgggtgcatatgtttgtgaacgggttgggaccatatctgataaatgagtgcacaacagcctccttggtggagggcatggatatttcccatattcaggcttatgcccagaccctagaggatcgtaagcgccaacaaaaggtagatagggagaaggataggggccaacataagagggcgagatttgtagggtattctgatgacttcggaggcagtgtcagatcccaatcttcgaggagttcggtgccatctgtagctagtgctcctctacagtttcagaggcctcgatatgatcgatttacctattcaggtccaggtcaaagttcgcgggcattaggctcgcaatataacagagatactagtcagacgagacccccaacatcacgttgtgatcagtgtggtaaggcccactttggactgtgccatcgaggttctgatgcgtgctattcttgcagacagcctagccatataatgcgggattgtcctaatataggaggtggtggtatggctcagccgactagatctgtgtctggttcttcgtcatcaatttgatctccagcatgaggttttcagcagtcgacaggtcgtggtagaggtagaggtgcagtgccgcattcgagtagtgctcaaaatcaaacctatgctctagtaggtcgacaggatctcgagtcgtctctagatgttgttacaggtatattgtctgtattttcttatgatgtatatgcgctgattgatctgggatccacattatcatttgttacaccctttgtggctaataagtttggcattaaacctgaattgataagtaaaccacttgcggtatctactccgataggagattctgtgatcactaggagggtatataaaggttgcacagtgatgatttgtagtcgtcaaacctcagcaaatttatttgagttagaaatggttgatttcgatgtgataatggggatggactgtttggcctcatgctatgcaaatattgactgtcgtacgaagatggttagttttcaatttcctggtgaacccgtcattgaatggaaggggaacattgctacaccgaaaggtaggtttatttcctatcttaaggcaaggaaaatgatctcaaaaggttacatttatcatatcgtttgcgttagggatgcggaggcgaagccgcctactctacaatcaatccccgtggtcaatgaatttccaaatgttttcccagatgaactcccaggccgtcctcttgaaagggagattgagtttagcattgatgtgttgcctgacactcaaccgatctatatcctccatatagaatggcctcggtagagttgcaagagttgaaggcgcagttgaaggacttgctagataagggcttcattaggcctaacacttcaccttggggtgcgccagttttgtttgtgcggaagaaagatgagtcgttaaggatgtgtatcgattatcgacagttgaataagtttactataaagaacaagtatccacttccaaggattgacgacctttttgaccaactccagggtgccaagtatttctccaagattgacttacgttcagggtatcatcaggtgaggattaaggagaaggatgttccaaagacggccttccggacaagatattggcactttgagttcttggtgatgtcgttcgggctaacaaataccccagctgcttttatggatctcatgaatactgtattcaggccctatcttgatgtgtttttgattgtagtcatttatgacattctagtgtattctcgttcggaggcggaacatgcgggccacttgcggatagtattacagacacttcaagattgtaagttatatgctaagctctccaaatgtgaattctggctgaactcagaagcattacttggccgtatgatatctgacgagggtattagtgtcgacactcagaagatcgatgcagtaaagaattggccgagaccgacaacaccatcaaaagtccgcagcttcctggggctagcaggatattataggcggtttgtagaagggtttttctttatatcagcaccattgactaagttaacacagaaaactaccaagttccagtggtctgacacttatgaacgtagttttcaggagctaaagaatcgattaacatccacaccagtgctcactctccctgaaggaacagaaggttatgtggtatattgtgatacctcaggtataggtgtggggtgtgtattgatgcagcgtgggaaggtgattgcttatgcatcaagacaattgaagaagcaagaaaagaattatccaacccatgatttggaattggttgcagtaatatatgatttgaagatatggcggcactacttatacgtcgtccatgttgacatctacacagatcacaagagtttacaatacatcttcaagcagaaagagttgaatttgaggcagcgtaggtggcttgaattactgaaagactacgacgtcgagatattgtatcatcctggtaaagccaatgttatggcagacgctcttagctgtaagctaatgggaagcttagtacacattgaggcaggtagatgggggttgactaaagagcttcatcagctagccaatatgagaatcagattgttagactctgatgatggaggtgttactgtacataatacatcagaatcatctttgttagccgaggtaaaagtacgacaatatgaagatcctatcttagtacgattgaaagagagcattcagtagtgtaaaattacggcttttgagatcggaggagatggggcactaagataccagggccgattatgtgtgcctaatgtggcagggttgtgagataagtttatgaatgagattcatcaatcccgatattccatccatcctggctcgacaaaaatgtatcatgatgtcaaggagcagtattggtgggataacatgaagaagtctattgcagaatttgtagcccagtgtccataattgtcaacaagtaaagatcgaacatcagaaacccggtggattccttcagaatatagagattccgacctggaaatgggaggtgattaatatggactttattattggattaccttgctcttatcataagtttgactccattagggtgatagttgatcgacttacaaaatgtgcccattttttgccagttaagacaacttacttggctgaagattatacgaagttgtatatcaaggagattgttaggcttcatggtgtgccggtatctattatattaaaccgaggagctcaatttatggctaacttttggaggtctttttagaagggtttaggcacacaagtaaatctcagcactgcatttcatccacagactgacggacaggctgaacgtattattcatacacttgaaaatatgctacgagcatgtgttctagatttcaaggggaatcaggatgaccatcttccactcatagaattcgcctacaataatagctaccattccaatattaaaatggccccatacgaggcactatacgggaggagatgtagatcaccagttggatggctcgaagtcggtgaaacagaattatatgggccaaatttgattcaccaaggcattgagaaggtgaaagtgatacaggagcgattgaggacggcataaagcaggcaaaagtcttattccaatgactgacgtcgtgatctggagtttgagtttagtgattgggttttcctgagtatctcaccgatgaagggtgttatgtgtttcgggaagaaaggtaagctgattctgcggtatatcgggatgtataaaattcttcaacaaattggacaggttgcttatgagttagaattgccatccgaattggaatttgtccacccggtattccatgtatctatgtttaggaaatgtattggagacccttctcgagtcatcccaatcaaagatgtacaagttatagaggatctatcatatgaagaagtgccagtggcaatattagatcgacaagtccgcaagctgagaacaaaatatgtagcatctgtcaaagtattatggaggaacaagaatatggaagaaatgacatgggaagcagaagagaagatgaagtctaaatactcttacctattccacaatgaagataacaaggatgttggtggaacgcaggatacattggaaggtgaaactgctctatgaggtaagcaataacttgagaatactcttccttaatacaaaatggtgatatgtagataatgtaaatatccataatgctttgtgtagccttgtgaggacatatgttgggcttaactgcttgcaagttttgctagtgaccattttataagggaaaattgaccggaaatttccattggaatccacgatgatttggactccccataaacctttacattcgaggacgaatgtccctaaggggggagggtgttacaatctatattcacgtatgttagctcattccataatggactcgacgtaaatccatgaagagattatctttaagatgataagaagttaatcctattggtcttaaatgatacaaagatgtataagggtggttaacaaatactagaagttaaatgaatcaaggatgttgtcagccgtatttttgggtaaacctagaggtgattaataaacttaagaggtagtgttttaaggtatttgaatcatataatatccgtatcataagtcttgaagtgaaacgagttatgaaacaaaagtcgacaaacgttgtcgcaacttaggttcataggtttacttaaacattaggtcaaatgttactaagcttgtctcccaatttacttagaattatggggtgatatacccaccaaattgaatatctatgagtctagtttccaactcattaaaccgttcattaatacaatctcggagtagagagatatttgctttttcgcgagactgcgccaaatacctctctatggggctcacttaggcggtttaagacatttggatatatatatatatatatatatgatacctccaaccctttttaagtcaatttttttcactatattcagaccttataaccctagaaacaccatatcaaggttctctcaagattgaatacccaaacaaagggcaaacaacacaaatcaagtgtcgggaatcccgtgtcgctagtaagtttcttgttcttcttattgttgctcatttttgtgttgttctagatcatgtgggaggtttatttaaggggtttatgttttttaaatacttactcaagttcttaatattaaccctaggtgatttcaagccttctaaagtgactctagtgtcgaaaaacactaattgattcctagtttcgcttctttgttattgtggcagtattggagggatattaaggtcaaattggagtttttctttctgtataaaggtaaagaacctcttactctgcatgtatttaagattatccaagtttcggctaagtcattgaagctagaacttgtgaaatatatatcgaaaagattggtagtaatgttatcggttggtggactattttgggaggttcaatataattaacattgatgttttttgtctgtttggtgattgttttcacttgtgggaagtcatataaatagggtaggtgttgttcgtttcctcataaaataggttgtgttcgatacatagtagttacgatgcctaaacgataacgatagtgtcatttctcttattgtagactaagaagccgtaaaattgcatagcttgaggttgggaagaatatacaaggtatgcgaggctatccctttccttcttttgcacgaccccgattgtacataatgtaatgaatgagcttccaaagatactctactcttagaagctagcagtacttacattgtttcccttcttatggagcgattgatgttgatgttgtttctcttattcttatgttatcaatgttgttggtatttcctaattcttataagattcatgataaagagttagtcctaataagtatacagaggatatcgaccttaatcactttggaaggttcaaaatattattccaatgagtccagcatgcattgtatatatctatctattttactctaccgagcctcactatagatgtccaggtacgacacctattgcgtaaccaatgatcagttggggtttcccgagctccacgtggtcgggtacgattctaccgagccttatgatggtcgggtacgattttaccgagtcctttctgaggccgggtatgatatgatgatgatgtccacagaggcgtgtattttaaaagtttatgcatatatatgtttgtatcatgcattttatgtcagtagcccacagaggtacccagatgttacatgttgtatattctctatccttattcacattactattcatagttacgcttttctgccttgcatactcagtactttattcgtactgacgtcctttttatttgcggacactgcatatcgtgctgtaagttctgatagatgggtagacgcagctcccccaccacagtaggctgcccagttcagcggttattggtgatatcccttctccggacttgctgtggtcttggtatgcatttttgttatacacattatgggtatgtcggggccattttctggctatgttgcaacacttatgttcttttagaggctcataaacaggtgtggactcatgtatagtttggtatgccttgtcggctgaacttttgttgtatagtctttcatggtagagcagtagctcgtaccttatatatagtttctttattttctggtcatcccatgttatgtatgtccatgtcatcctattttattgttggttgtccatgatccatgtctaccatttatattgattgcgccagccctaaaaaataataaagaaggttagataaaatgtacgttgttgctcggcaagtatggtcgggtgctagtcatggccctccagtttgggtcatgacaccacacttatacaactttcccgtggggcacactcctacgacctttcgtttcagataacaggtctgtacatccaaaccaccagccgcactaacgctgaaaagcgatcaagaaccctcaaccaggatgcaaagcctttttcacaaaataccgacctcaagtgacactgaggacaataccaacttatttttaaacatccgaactcctttcctgctcatccgagctcgtgacatctttgtcaacaccgaatcgcaaccttgatcctcacttctaattccataccacttagtgcacccaacatgcccatatacgatagaacatgatttccatcataaccccggaaccactaatagatcaaaacttcatcatataaaaacttttcacttaactcacttcaggaggaccatatcaacacacaagtaaattctcataaccgtagaatatgcaattctctaagtagtagcctaagccaccatatccctttcgggatccgcctacacatacaggccataacaatagaatacttctgaataatatcaattacggcggccgacaagctcaccacgtaccgctaaaatccacttgcataacttgatcacgctaaaagaactgatcactaccaccaatctgccaattcaactatggctaaccaatctatcttcttccaatttatccttgattgccttagaaataataataaccccatctaacacataacacgctccattcgcactcatcccgagtgaccttgaatcacgagaccatgttgtctcaaatcccacaaactgtttcatacctcccaaatgctacactgcaagtcaaaacatcctagaagattctaggactcttcttataagctgctacaaagcttgatttttaaccgtacctataggctcgaaatcattacgcaccacactttacccctttgaatccactagtaccgttgttgagagccacccgctctgacttggccctgaatgttatcaattccatgaatcttctagtatatgaataccttctcgacgaagcacccggcaaaatcacttcccttggaacccgtatctatacaaggcgtaaatcctgaatcctctcatagaatcatcatccacagtcgcacgaccgatctctttgttgtataacccatagaattctttgcagaagcttcgccaaccatgtaaccgctggtctgctcactggagataacccacctgggaaatttacgtgccaacatattccaacgctgctgcacggggtacaatcattatgacatcaataactcatcctgagtccgaactcactctctagctgcacaggtccattcacccctcgtggaaatcaattaaaggtgtggcaacatccttccaatccaaagttatgttgtatccttcttcatttcaagcagctcctttccattgtacgaaatcttctaccgcataatagctcatacttcagcttaaatccatagaccccaatcacccatcactaaaattcccaaatcattccaaactttccttaaggtgcgtagtcatcctaccacaaaacccacatgcaactccgccactcttccgctttggcggaactcactcctttaatcaactacttgaccttcacttcttatacctggccttctagaaattttaaccaccacctgacactccccatatgtctttcctcatcctttgctgcttagttgttgccttaactaaaatccatctttgtagcacttgaacccacaaatcgctactaactttaaacctttccgaagatcatctttctcgagccgtcaacatttgaaacaccgattcaatcctgaaccaccacaccccgcgatctttgacagccgattttccagtacttttgtataataacatgccccaaaggtgaatcgtagaagatcataacaccgatgaacttaacacatccaatcgaggacgacaacactacatcgtagatgaaaattccaccacgctcgaaaataccatgtctcattgctccatcaccccaaatccggacattcataggccaattgcttttcctccaccagaaatgaaatatcagatctctgaattatgcactgagtggacttcctttcaaatcattcaccgccccaacacataggcaagtatcctatcatcaagtcaatactgtgtgataactaatcgtgagcatcatagcaacttgtgcatagcctccaagctcttagaggcacaactactgatccaaaacgatagaaaaaaaaatccttccacaaggcgatgacaatagcccaaccaactacacagggagaacatcccgcaccatatctgtagtaccattacaatccttcaattctcgatttataacaagtggttcgcgtcgtgtaagattgaataggaaggaaataaaagcataagtctcaaggaattaaaccacacaatgaggaatcaagaagggaagtgctcctaacagccctgcagcctctcgaagataagtacagacgtcttcgtaccgatccgtaaaactctactagactcgctcatgactcatgacacctaaggaaacctagtgctctgataccatgttgtcacgatccaaaatccactaagggtcgtgatggcaccggacaccattgttaggaaagccaacactaaataactagtactatcttgttttagatatttctaaattcacttattttatacatttaaacaataagaaataaattcccactgaataaataatgatatctttaaaaatttcaaaatactgactacttccatagacatcccaaaacccggtatcacaagtacatgagtatttactagggaatgaaataaaatacaaaaactattcgaaatacaagtggacagaaatgaaaatacagtacaatactctgaagaaaactctgctggctacggtcatctcgataactgtaactcacctaagtctctgtatcaaccatgccgctatgccactaagccactagccacacataaacctatgtaacaaaaatgcacatataagtacgaaaataatgtgtacccaatgagtattccgtctaatctcaaagaagtagagacgagaggtcgactttgacacttactagtggtccaatagtaatatattataaatgcgagtaatcaagaagttattaagtgtgatgacccaagaggtcatcacttgtttttaaaatgaattctgcattctgaggctttaaaaacctcttttagcatcacctcgatttgtgtgcacaatccgggcgcgtagccggaaagcctatatgtgaaaatctgtgaaaaaatgataaattttgactataaaatgaattaatttgacttcggtcaatactttgggtaaacggacccggacccatgatttggcggtcccggtgggtccataggaaaatataggacttgggcgtatgcccggaatcgaattctgaggtcccaaacccgagaaatgaatttatgaaagaaattgttttcttaaaaatataaaggtttttgaaagtgaaatgttatgtgaaacctgtggtattgggcccataatatggttcttccggagtccagtataggttcaatctgatttatatgtgttttcggtaaagtttggtaagaaacggaatccatttgacgtgattcggaccttaaatgcaaaatttgatgtttaaagaagttttgagaaatttcattgatcttgaggtttaattcgatgttcatgatgttattttggtgatttaattacacaaataagtctgtaggatgttttttaggttgggtgtatatttggtttgaagccccgagggctcgggtgagctttggataggccacggggtgcattttgaacttagaaaattgcaggattttgttggtatgatcaggcctgcaggcttcgcatttaacaagtccaagcctgcccttcctcgcaaatgtgagatgttcctcgcaatgccgaccttgaaaatgcgagggtgccttcgcaaatgcgatgtatgccggaaatgcttgaagtcgcaaatgcgacatttctgatcgcaaatgcgaaaagcccaaatttcctgaagggttcacaaatgcgagccttgtttcgcaattcccaagccagcagaggtcggggttcgtaattgcgaacccctgttcgcaattcccacatctgagacctgcaacttttatacttagacgaattttaacccatttttcatatcctctcaaaacataaacacactagggcgatttttcaaaggcttcttcttctccaaatcaattgtaagtcgtttttaactagtttccttcaattattaacatcttttaacatgatttcaacttaaaattaataattttcatggggaaaattgggtgttttgggtagaacctaggtttttcaaaaattggggatttggacctcgatttgaggtccaatttcaaaacaaattatatatttgggttcatgggggaatgaataattgggttttggtttgaacctcggattttgaccatgtgggcccggggctatttttgactttttgtgtaaaactttggaaaacacattttcatgcattggggttgattcatttagagtttattgatgcaattaagtaacttgtggctagattcgagcggattgatggtggaatcaaggggtaaagctataattgaaacgtgaattgtgttcgtggcatcgaggtaagtgtttggtctaaccttagcttgtggtattaggagttgtgtcttatttgctgcgagttaattgtggagtatgacgtatatgtgtggtgacgagtatctatacgtcggtgtcaagcatgcccgtgagtcttgtattgtaattgttatgactccgttgggaattatttcacttcacatgttattgaaatattattgtccccttgccgggatgttgttatattgccctggttcccttgccgggatgtcgttatattgctcttgttcccttgtcgggacgttgttatattgcccttgttcccttgtcgggatgttgttatattgctcttgtttccttgccgggattctttatgattgctattgatttgtaatttggagcgggtggtactcctgtcacgagataaataaaatgggagcgggtggcatgcctaccacaaggtaaatgaaatgtgagcgggtggcacgccttccacgagatacatgaaatgggagcgggtgtcgtgcctaccacgagatacatgaaatgggagctggtggcgtgcctgccacgagatacatgaaatgggagctggtggcgtgcctgccacgagatacatgaaatgggagcgggtggcatgcctgccacgagatacatgaaatgggagcgggttgcacgccagcaacgagatacgtgaaatgggtgtgggttgcacgcctgcaacaagatgtgaaatgaaagtgaattctgcctttgtttcccttatccttgttagtagttggattttggttcctttataattctcttgatattctgtttttacctgttattccccgaagcatgctttccccctaccatctttacttgcttatttctgttttactttccgttgtatattttataattgcacaggtttaattggtagtccggtcctagcctcatcactactttgccgaggttaggctgggcacttaccagcacatggggtcggttgtgctgatactacactttgcactatgtgcagatcccggagcagctcttggactgtagtttggaggctaccttcagtccacgcaaagatccaaggtagacttgcaggcgttcgcaggcactagcgtctcctctatcttttatttcctgtttcatctttctgcttcagaaacagtgtgtcttttatttttagaacttgtatttagcagtcttagaccgtctgtggtactgtgacaccaggttttgggtgattaaggcttgagcagttgtaatagatacaaatttcagatattttatcattttcttccgcttaaatttaaattttcgctgtttatacattatcgcttcatgtttgttaaaaagaaataaatggataatgaagtaattaatttaaaggattggctttcctagcttacattagtaggctccatcacgactcccgagggtggaaaattcgggttgtaacattaagaccagccgtaatttctaataagtcacaaacaggtaaaagttccttttatattaaaaatcttcggattcataatctattaatttccaattatctcaagctagggagagaaaatatcaatatcgataaatctcaaggcaagcaatacaagcatgtgcaaatcctgccgaggacgtacgacccgatctaacaatatttaaactgtgcactgctagagggtcgaatggcgtgaaccatagatgcatctatttaatctaccaaggagttcggcccgttccgaaattaaacacatacagacagtcaatcaagaagtcaacagggaacaattatccaaagaaaaatcaattctcttttaacaattctataaaaatgaagtttaatccttttagaaattcatttaccaattcaataggatttaagcaattcagctgtcaataagattacaaatattccaagtagagcatgctttttgggtcctagactacccggacttaaacataatagtagctacgcacggactctcgtcacctcgtgcatacatagaccccacaaataggagcacataaccaattattttacctatagggacaattccctcttacaaggttagaaaggagacttaccttgctccgaagttccataaccggcgttccacgcccttccgaagactcaattcgatgcaaaaattctccaaaactagccattaatcatgtaaacccattaatatatgttcaagtactcattataatccaatttataacaattcctaaccccgatcgaaaagttgacaaaattgtcctcgagcccacgtgcccggattccgaaatttctcgaaaataaagtttactcatgaactcacgaactcaaatatatgattttctcttaatttcatacgcaaaatcgtggtcaaaatccaagaatattaattttctaggtttcccctaaatccccaagtttctaccaaattttcatgctcaaatccgcacataatcaatgtatttaactcaagataggtggggttagcttaccttgtcgttgatgatgaaaaaccccacttgaagctctccaaaagcgtccacgccatatgaaaatggagggaaaatgaccaatccccgattttaaaagaacttactgcctccagcacttccgcacctgcggtcacatgaccgcttcagcggttccgcaggtgcggcccctttaccgctcctacggtttctctccaggctcccctttccacttatgcgcctcaactctcgcaggtgcggtcccacttttgcggcaagatgactgcatatgtggtccttacacttccagcccaaaatcgcatatacggctctcctggccgcttctgcggctccgcacctatggccaaaacctcgcaggtgcggttacaccagatatcagctgcctcaatccttcctcaaattccaaaatttatttgttaacaatccgaaatccacctgaggcccctgggacctaaaccaatcataccaaccagtcccaaaacacattacaaatttgctcgaggcctcaaatcgtatcaaacaacgctaaaatcatgaatcaatctccaatccaagcttaatgaactttagaatttcaaacttcaacattcgatgccgaaacctatcaaatcacatctgattgacctcaaattttgcacacaagtcatatttgacattatggacctactccaacttttggaattggattccgaccccgatatcaaaaagtccacttccagtcaaacttctcaaaaaccttcaaatttctatttttagccaaatgactccaaaatgacctacggacctccgaattcacttccgatcgcgctcccaataccagaatcaccattcggagctattcccagactcggaatctcaaacggacattgataaccctaaaatgcacttcaatccaaacttatgagattcttccaaaaatgctaacttccacaataggtgctgaaacgttcctgggtcttccaaaacccagtctggacatatgcccaagtacgaaatcatcatatgaacctgctggaaccttcgaatcccgtttacgaggtcgtttacttaaaaatccaatcttagtccattctttcaccttaaagctttcgaattgagaatttttattcaaattaactccgaacttcctgaaattcaattccgaccatgcgtacaagtcataatacctaaagtgaagctggtcatgccctcaaactactgaacaatgcactagagctcaaaacgaccggtcaggtcgttacactttcggcctcgcctagagtcctcctaacatagtagataggaaattgtgtaccttcctattcccgggccgggactccacttacctctatctcggatactgctaagtataggtacaactgcttgtctgacttgggagtatgaagcaaaggcaggctcgaaaggtaccgcttgagttattccaaggcttgttggcactccggggtccatgaaaagttcttcttcttcttcaataacaaaaagaaccgatggctcttgtcggaggaccttgaaatgaatcgacccaagggggctatgttctcggttagcctttgaacgaatttgacattgtccaccatggtgatgtcctctatggctttgatcttttcgggattgatctcgattcaccagttggataccatgaatctgagaaacttcccggacccgactccaaatgcgcatttctccaagttcagattcatattgtatctcttcaatatactaaaggtttcctgcaaatattttaaatggtcctctgcttgcagggacttaactaacatgtcgtcaatgtaaacctccattgattttcctatttactcttcgaacatccgatttaccaagcgttggtaagtttcttggtcatacagtctaccatatttaattatacacggagtaggcatcgagaaagctgagtatctcatggtcgtccattgcatagatcatgcaatcgatgttaggcaaagggaaaaagtctttggggcatgccttgtttaagtctttatagtctacatacattctcaatttatttccctttttaggcactaccgctacatttgctaaacaatccgagtacttaacttcccgaatggagcatattttaagaagtttggatacttcgtctttgataaacgcatgcttgacttcagaccgaggcctcttcttctgtttaaccgggtgaaacttcgaatccaagctcagcttctgagtagttattttcggtgggatccatgtcatgtcaagatgggaccaagagaagcaatctatgttagctataagtaattcaatgagttttttcctaagcccgggagttagtcccgtgcccaggtatacctttcgatcgggcaggtgctcgatcaacttgacttgctccagctcctacaatgtttacttggtggcatcagaatagtcaggggctattgaagtcctagggactctgtagtcatcatccttgcatgtcacctgcttttatggttcggttggggctggcgtcagtgattgatatttggtttctcccttggtgactgaactcgagctcttcgatgtcgaaagtgtggatatcgggaccacctcatcgaccacgaacatttcttttgcagtcgattgttctccgtaaactattttgatccctcccagtgtaggaaatatcaatgcctaatgtagcattgagggtatctccctcatgttatgaatccatggcctcctgaataaagcattgtacctcatatctccttcgatcacgtagaactttgtttcttaaatggtcctggcggtgtttaccggtagggttatctcccctttagtggtctcgcatgcaatgttgaatccctttaagactcagactgcaggcactatttggttttgcatacctagttgttccacgatccttgatcttatgatattggccgagctacctgaatcaattaacacacgcttaactagagatttattttttagtacagatattaccagtgcatcattgtggggttgcatgatgcctttaacgtcctcgttgttgaaagatacggttccctctggtacatagtctcgagcccgtttttcccttgcaatggatactttagtgcattttaacatcgacccttggggatgtcaacttcaccaatgatcatgttaatgatgtgttgaggttcctcttctcaatctatttgttggtgtccctattcctgaagtgatttttggctcgatcacttagaaattctcggaggtgcctgttgttgaataaccgggctacttcttccctcagttgtcggcagtctttggttctgtagccgtgggtgccatgatatttacacattagattggggtccctttgggcaggatcagactgcaatggccgaggccactagtatctttaatacgtctgatggctgatacgataccgacaacatcgacgttaaagttgtattccgataaccttggtgcttctttggacccgataggtctgtcaaaaccgttctttctcatgagtccccaattattatgacctcgataactccttctttactccttgcaggggtgcgtccagacccactgctccttcaatctccactctacgattgatactaatctctgttcgatcttggctcatgatcgacgtctcttttggatctgtcactggtcctaacggggtaaatggacccagaaagggtctcgagctaatcatctttgaccctgatttttgtttggtgtctgttatggacgtcgacccaagttacagccgggtattctttcaaaatttgcttcaactgttgtgaagccaacgagctttggggattgagtccttgggtgaatacctgaacggctcaatcgtctacgactggaggcagatccttccgttccatttgaaaccttgacatgaactccctgagtatctcgttacatctttgctttaccttgaaaaggtctgacttcctggtctcgaccttgatggctccggcgtgcacttttacaaaggcatctgcaagcatagtaaacgagtcaatagaattaggggggtaagttggaataccatatcatagctccttttggcaaggtctctccaaccattttcagtagaacagattcgatttcatcatcctccaagtcgttccctttgatggcgcatatgtacgaggttacatgttcatttggatcagtcgttccattatacttcgggatttcgggcttatgaaacttttttgggatcgacttcagatatgcgctcgaggggaaagccttttggacaaacttcttggaatccaggcctttcagtatcggtggtgctcctggattttggtcgaccctggagttataggtctccacctttttgtcgttagcttcgattttcttttctcctatttctacccgttccgtcaattcctcgagcatatttattatctcggggttggccccggattcatcttcactcgcctttttgtggctggttaatttctgcgagtgtttttccggaattgttcgggctcaactctactgggagcaaggctttggttctgcaactgggctatcgctgcttgttaagcctgtagcatttcgaagatcacccgctagttgatctcatcgcctttatcgttgtgcgtatccctggctatcgacctggctcccacgcgaacactattttacggatcggtgggaaagttagcatcaatggccacatgggagttggcatcgattggacctgcgaccggcaccccgtaggggtcagcatggtgaacctcgttgctgggcactatattgttgttctcgccgtggtggccagattcagcatcaacgtttaggtgagcaaattgagagtttgacatctttaagatttcgtaaaattaagatctcaaagaacaagagaaaagtagagtgtgttatggaaatttgtatcaaatagccactattatccttagccccatggtgagcgccaaactgtttaccctaaagaacggataacaattaaatttatatgtgattttaaggatatgcggattaattctatacaaatgataaatagcgttagattaaatagataaaggccgtaataaattatcataccacttaagaggaatgactccgggatcggttatagccttaatggagtgcctgtcttcgatcccagattttcaaaaacgaagcactgatgaacaaaagtaagagctttgaataatagagaaaatgagagtatattgccttggtgtgcgtgttaaaatgtgtttaatgaataatcagacccccccccccttttatatagtcggggagttttagcctaagtacaattgcataaaagataaaaatcttccgtttaaataatcaccggttctctttcgatacgtgctgagattcacgtcgtgatatccggctggtcgcggatattaaagtcttttgttgatcgtgttcggttacctggtaatgctctccgaggcctttggggttcgaaccggacatggggccatgaccccgatactctcgagggcaagtgttttacccggacgctggatcgaggagctccttgcctcgattccggttccttgccttcacgtctctcgctccgtttgtttcatcgaaaatcgaagcgtctcgtgggatcggtttcactcgtatacaaaaataaaaagatacaatcttcctcgtgaattcagttgatgactagccttccgttttttctttccagcttttggaatgagtattggatatacgatttccacattattattgtttctcttcattgaaatctccactgccatgaaaaccgagatcgaaattttaatttggatagtgttttttggttatttagtttggttttagaatgagaaattaaaatttttaatttttttggttttgtttgggatttaagaaaataaaaaacgaaaacccaaattttttttatatatattatacagaaaagggctatatatgtccctctactatcgaatattagttatttatatcctctgttatactatttgacgtttcttacccttgtcgttagcctttttaacaaatctgcccctcccattgacggccccagtctgtgcggacacgtggcacatttttagaacccaaaccctttttctttccccacccaagatccatgcccgaaatctatactaaacccatatcaataataagaagcaagcttagtttattaagtgccttaatgcattgtctttcatcattgcaagaaaccatcaaatcaaaaccccgaaagtgaaaaataaaaccctgctactacctaattgattgattaaaaacaaaaactcgtgaaggggcgaaatatatcacgattaaaaagaaataaaaggtttacatcttcttcgttctatgctccttccttaagcaaaatgagggcttcagattcagtaggtagagctgggattggtcatttcttggttgttgtgatggctctacatgcacaggcaaaccttagtacttccttcaaccttgcttcatcttgcatttttagttttccacaaattaatttacccccgttatgatgatgtccatctcattgaagaagtattaggcatgtgcctaataagagttttctttggtttggtagccaaccttgttgacttggtttggttggtagccaaccttgttgaattagtttggtttggtagccaatcttgttgaatttctttggtttggtagccaactttgttgaattgtgaaaagtgtgtgtaaattgtcaaatattgtaggctttagagggtgaagctttggctataaaaggagagcttcaactctcatttctacacaccaacaaagagagaaagaaagagtgaggtttcacagacaaggtataagaaaatagtctgtgaggaaaatagagagtgggcgatatcgtagtgaggtgggaatatcaaaagagggttatttcttttgagtgttgtagtggtctttggagtatttatctccgacctacaaagtgtaaaattccttactatagtgatatcagttgctcctctcggggtcgtggttttttcccttattcagaagggttttccacgtaaaaatcttggtgtcattgttactcttttattcttgttaattaccgtatctcggtgctacattattattccgctttattaccgtgaatattattttgttaaggggtttattcccaacaactggtatcagagcacaggttctgctcgttcactgaaatactattcactgtcggtagtactatacttggtggaaaataaaaatgtccggagtaaagtacgaggtagcaaaattcaacggagataacggtttctcaacatggcaaagaaggatgagagatctgctcatccaacaaggattacacaaggttctagatgttgattccaaaaagcctgataccatgaaagttgaggattgggctgacttagatgaaagagctgctagtgcaattaggttgcacttatcagatgatgtggtaaataacatcattgatgaagacactgcacgtggaatttggacaaggttggaaagcctatacatgtccaaaacgctgacaaataaattgtacctgaagaagcagttatacgccctacaaatgagtgaaggtacaaattttttgtcacatttaaatgtgtttaacgaactaatcacacagcttgccaacctcggagtgaaaatcgaggaagaagataaagccatcttgctattgaactcgttgccatcttcgtacgataatttggcaacaaccatcctgcacggtaagactactattgagttgaaagatgtcacatcggctcttctactcaatgagaagatgagaaagaagcctgaaaatcaaggacaggctctcatcacagaaggtagaggcaggagttatcaaaggagttcgaacaactatggtagatccggagctcgtgggaagtcaaagaaccgatccaaatcaatagtcagaaattgctacaactgtaatcaaccaggtcacttcaaaagagattgcccaaatccaaggaagggcaaaggtgaaaccagtggccagaagaatgacgacaacacagccgccatggtgcaaaataatgataatgttgtcctctttataaatgaggaagaggaatgtatgcacctgtcaggtccagagtcggaatgggtggttgacacagcggcatctcaccatgccacaccggtaagagatcttttttgcagatatgtagcaggtgatttcggcacagtgaaaatgggtaacacaagttactcaaagattgcggggattggtgacatttgtatcaagacaaatgtcggatgcacattggttctaaaggatgtgcggcatgtacctgatttgcggatgaacttgatctcgagaattgctttagaccgagatggatacgagagttattttgaaaatcaaaagtggagactcactaaggtatcattggtgattgcaaagggagttgctcgtggcacgttgtacaggacaaatgcagaaatatgccaaggtgaattgaacgcggcacaagatgagatttctgtagatttatggcacaaaagaatgggtcatatgagcgagaagggattgcagattcttgccaagaaatcactcatttcttattccaaaggtacaactgtaaaaccttgtgactactgtttagttggtaagcagcatagagtctcatttcagacatcgtctgaaagaaaattgaatatacttgatttagtatattctgatatttgcggcccaatggaaattgaatcaatgggcggtaacaaatattttgttacttttattgatgatgcttcacgaaaattatgggtttatattttgaaaaccaaagatcaggtgtttcaagttttccagaaatttcatgctctagtagaaagggagacgggtcgaaagctaaagcgccttcgaagtgacaatagaggtgagtacacttcaagggaattcgaagagtattgttcaagtcatgggatcagacatgaaaagacagttcctggaaccccacagcacaatggcgtagccgagaagatgaaccgcaccattgtggagaagatgagaagcatgctcagaatggctaaactgcctaagtcattctggggtgaagcagttcagacagcctgttacctgatcaataggagtccatcagttccgttggtgtttgaaatcccagagagagtttggaccaacaaggaggtgtcctactcgcatctgaatgtgttcggttgcagagcttttgcacatgtaccaaaagagcagagaacaaagctggatgataaatttgttccctgcatatttatcggatatggagatgaagagttcgggtacagactgtgggatcctgtaaagaagaaggtcatcagaagcagagatgtagtcttccgagaaagtgaagttggaactgctgctgatatgttagaaaaggcgaagaatggtataattcctaactttgttactattccttctacttctaacaatcccacaagtgcagaaagtacaaccgacgaggttgccgagcaggtggatcaacctggtgaggttattgagcagggggagcaacttgatgaaggtgtcgaggaagtggagcaccccattcagggagaagaacaacctcaacctctgaggagatcagagaggccaagggtagagtcatgcaggtacccttccacagagtatgtcctcatcagtgatgagggggagccagaaagtcttaaggaggtgttgtcccatccagaaaagaaccagtggatgaaagctatgcaagaagagatggaatctctacagaaaaatggcacatacaagctggttgaacttccaaagggtaaaagaccactcaaatgcaaatgggtctttaaactcaagaaagatggaaatggcaagctggtcagatacaaagctcgattggtggttaaaggcttcgaacaaaagaaaggtattgattttgacgaaattttctcacatgttgtcaaaatgacttctattcgaacaattttgagcttagcagctagcctagatcttgaagtggagtagttggatgtgaaaactgcatttcttcatggagatttggaagaggagatttatatggagcagccagaaggatttgaagtagctggaaagaaacacatggtgtgcaaattgaataagagtctttatggattgaagcaggcaccaaggcagtggtacatgaagtttgactcattcatgaaaagtcaaacatacctaaagacctattctgatccatgtgtatacttcaaaagattttctgagaataactttattatattgttgttgtatgtggatgacatgttaattgtaggaaaagacaaggggttgatagaaaagttgaaaggagatctgtccaagtcatttgatatgaaggacttgggcccagcacaacaaattctagggatgaagatagttcgagagagaacaagtagaaagttgtggctatctcaggagaagtacattgaacgtgtactagaacgcttcaacatgaagaatgctaagccagtcagcacgcctcttgctggtcatctaatgttgagtaagaagatgtgtcctacaacagtggaggagaaagggaacatggctaaagttccttattcttcagcagtcggaagcttgatgtatgcaatggtatgtactagacctgatattgctcacgcagttggtgttgtcagcaggtttcttaaaaatcctggaaaggaacattgggaagcagtcaagtggatactcaggtacctcagaggtaccacgggagattgtttgtgctttggatgatctgatccaatcttgaagggctatacaaatgttgatatggcgggtgacattgacaacagaaaatccactactggatatttgtttacattttcagggggagctatatcatggcagtctaagttgcagaagtgcgttgcactttcaacaactgaagcagagtacattgccgctacagaaactggcaaggagatgatatggctcaagcgattccttcaagagcttggattgcatcagaaagagtatgtcgtctattgtgacagtcaaagtgcaatagaccttagcaagaactctatgtaccatgcaaggaccaaacacattgatgtgaaatatcattggattcgagaaatggtagatgatgaatctctaaaagtcttgaagatttctacaaatgagaatcccgcagatatgctgaccaaggtggtaccaaggaacaagttcaagctatgcaaagaacttgtcggcatgcactcaaactagaagacagtgctacctcctctgaatgaatgagactggagggggagattgatgatgtccatctcattgaagaagtattaggcatgtgcctaataagagttttctttggtttggtagtcaaccttgttgacttggtttggttggtagccaaccttgttgaatttctttggtttggtagccaactttgttgaattgtgaaaagcgtgtgtaaattgtcaaatattgtaggctttagagggtgaagctttggctataaaaggagagcttcaactctcatttctacacaccaacaaagagagaaagaaagagtgaggtttcacagataaggtataagaaaatagtctgtgaggaaaatagagagtgagcgatattgtagtgaggtgggaatatcaaaagagggttatttcttttgagtgttgtagtggtctttggagtatttatctccgacctacaaagtgtaaaattccttaatatagtgatatcagttgctcctctcggggtcgtggttttttcccttattcagaagggttttccacgtaaaaatcttggtgtcattgttactcttttattcttgttaattaccgtatctcggtgctacattattattccgctttattaccgtgaatattattttggtaagggatttattcccaacacattatttatttataaacaagcttaatttgggataagaaattataaaggtattaccgttaatgggaggggcatatttgttaaaaaggctaacgacaaaggtaagaaatataacggagtttataaataattaatatccgatagtactagatatataaggtctcattattcatctttaaatacaaccccttattctcgttactaagtagtattttgattgggaaactttcatcgagcttctttaacttttaatatttacgagcaaaaatcagtctcatttgcacttgaattataatttattgtatttttatacctggacatgttactattaatattgtcttttaaaagttttaaccgtgactaatattaacaactctattttaagagatataatatgattacttctcattctctatgatattttttgccatagaatataaatatttaattatgttttttttttaatttttattcttctattatgcccaaagatctatttcttttcgattatgttaattatcttatactagtattagtacccgtgcgatgcgtggacaaatcatatcaaattgtgatgtagattgtttgaatcatgtgcaattaacctcaaaatataaacctctcagataaaaattatataatcattagatattaattaagaagcaggatatgaaattattgtttaaatctcgtaatggacaacctatttttgtctatattagtagtcaaactagtactagtatcatcagacactagttgtatgaggcattttttttatctcacatttttgtggactcatgtttttatggatccagaagtataagattagggtccacgagataaaaaaaagtcttatacaattcatgtaagttgtgtgagacacataataaaacttaataaaactttacttgctggatctgtacgtttgctattatccatgttttgaatatgaaacttgagcatccagcgaagagttgattttgtgctatctttcttacgtgttgacttgtcattcattgagttggcttttcatttaccttaaagacagacgtactatattattaatcaaaactagtagtcgtacccgtgcgatatgcggtaaatattaaaaaaatattaattaaattaaattatgatcgggtttgtttgatcctattagatcttattgctttattaaatttaaattgtcatcttattgtctatacgatatacccaataataaaatctctattaacttaaagatacttatatagtcagtgtaacttttttgttctatatttttctttattacgttatccattgtttagtattattacattgtcaatagaaatttttattagtatattactttgtttactccaaaccctacaatgtgagatattactgggtacgttgttattgtatattactttgtttactatttttgtctgctcactttctttttctaatataagagaagatatataattaattgttgttgaaatatttttttattttgaattttattctgttattcttaataatattatctaaattttaatgaataaaatctctattaaactaaagggacttatacaggcaacaaataactttttaatttttctttattttatcatccaatatttagtattattacattgttaataaaaaaatttattatcatattatttatttaatatttttctctgctactttatttttgtaatataatagaagatatatattttattaatcttgcaataattttattttaaattgttaaaaaaattttattatcatattatttatttaatatttttctctgctactttatttttgtaatataatagaagatatatattttattaatcttgcaataattttattttaaattttattctattgtgctcaataatattgtctggactttaatgaacaaattttcgattaaattaaagggacttatgtagtcatcgaataacttttttttatgtatttatctttattatatcactcatgtttgagtagttaatattattctaattattttattttaaaataattttaaaactccaacttaaaactactctcgccaatttgaacgggtagttatttttattatatatttatatttttcgttttttattataactaattataagatctatatttattaattcaaataaagtatatatatatatattgtagttttttttattttttattattttcgttttttataaatatttaaattcaaaaataataactaaataattaattaaatatttaaattttattatattttctcaataatatttaattttagtgaataattacactttttattttgaaaaagaaaaacgaaaatgatttaacaaaatcaaataaagaaattaactaacccaaaccaaccatcacccatgtttgagtagttaattcaggtaattaatttctttgttaatttttaataaataattgttattaactaattgtgccatatgttttttattgctttattttaattttttaatttaaaataaacttaaaattccaacttgaaactactcctcaatttgaatgggtaaattttttttttacttttattttatttaaaaatattttaaaactccaacttgaaactactctccgatttgaatgggtagtttttctttttcttttttcatttaattattaaagcaaattattttattttaaaataattttaaaactacaacataaaactactcccgccaatttgaacgtgtagttatttttattatatatttatatttttcgttttttattataacaaattataagatctttttttttaattcaaataaagtaaccaatatatatatatatatatatatatatatatatatattgaagttttttcattttttattattttagttttttataaatatttaaattcaaaaataataagtaataattaactaaataactaattaataactaattatatcatgtggcttttttttaggctgccacttggcttaaggagagggctttatcctctccttttaataatatatagatattttattttaaaataatttaaacactccaacttaaaactactcccgccaatttgaacgggtagttatttttattatatatttatatttttcgttttttattataactaattataagatctttttttttattcaaataaagtaaccaatatatatatatatatatatatatatatatatatatatatatatatatatatatatatatatatatatatatatatatatatatatatatatatatatattgaagttttttcattttttattattttagttttttataaatatttaaattcaaaaataataagtaataatttactaaataactaattagtaactaattatatcatgtggctttttttaggctgccacttggcttaaggagagggctttatcctctccttttaataatatataaatattttattttaaaataatttaaaaactccaacttaaaactactcccgccaatttgaacgggtagttatttttattatatatttatatttttcgttttttattataactaattataagatctttttttttaattcaaataaagtaaccaatatatatatatattgtagttttttcattttttattattttcgttttttataaatattttaattcaaaaataataactaataattaattaaataactaattatatcatgtggttttttttaggctgccacttggcttaaggagatggctttatcctctccttttaataatatatagatagatattttattttaaaataattttaaaactccaacttaaaactactcccgccaatttgaacgggtagttatttttattatatatttatatttttcgttttttattataactaattataagatcttttttttaattcaaataaagtaaccaatatatatattgtagttttttcattttttaatattttcgttttttataaatatttaaattcaaaaataataactaataattaactaaataactaattagtaactaattatatcacgtggcttttttttaggctgccacttggcttaaggagagggctttatcctctccttttaataatatatagatttttattttaaaattaatttaaaactccaacttaaaacttctcccgtcaatttgaacgggtagttatttttattatatatttatatttttcattttttattataactaattataagatcttttttttaattcaaataaagtaaccaatatatatatatatatatatatatatatatataatatatatatatataatatatatatatatatatatatatatatatatatatatatattgtagtttttttattttttaattattttcgttttttataaatatttaaattcaaaaataatagctaataattaactaaataactaattagtaactaattatatcatgtggcttttttttaggctgccacttggcttaaggagagggctttatcctctccttttaataatatatagattaaaaataaacttaaaattccaacttaaaactactccccaatttgaattggtaatttttttttacttttattttttgttttaaaattattttaaaactccaacttgaaactactcttcgatttgaaagggtagtttttcttcttttgtttccatttaattattaaagctaattattttattttaaaataatttaaaactccaacttaaaactacttccgccaatttgaacgggtagttatttttattatatatttatatttttcgttttttattataactaattataagatctttttttttaattcaaataaagtaaccaatatatatatatatatatatatatatatatatatatatatatatatatatatatataatgtagtttttttattttttattattttcgttttttataaatatttaaattcaaaaataataactaataattaactaaataactacttagtaactaattatatcatgtggcttttttttaggctgccacttggcttaaggagagggctttatcctctccttttaataatatatagatagatattttattttaaaataattttaaaactccaacttaaaactactcccgctaatttgaacgggtagttatttttattatatatttatatttttcgttttttattataactaattataagatcttttttttaattcaaataaagtaaccaatatatatatattgtagttttttcattttttattattttcgttttttataaatatttaaattcaaaaataataactaataattaactgaataactaattagtaactaattatatcatgtggcttttttttaggctgccacttggcttaaggagagggctttatcctctccttttaataatatatagataaccattacgcttccggtattggggatgatatcctttcttttggggtaccattaattcattaatttgtacaaagtgatagagcttgacgtttactcatatgcccctttcttatgtggtatgcatatagatgctgaaattttaacagatcaagataaatcctaaatttatgattattcttaaaataataggagtctatcaggattacttggtggctactccactgtcacgacccggactttctaccctcgggaatcatgatggcgcctactaatgtgagctaggcaagccaatccttaacaacttacttcattaacaaatcacttattttaacgattatcagtgatagcatgaaaacatcagaatttagtaaatgtacggaagacttaaattaaagaaactgaacaataatacggaaatcaacatatgcctctacccaagaactggtgtcacattactcaccaacttctaagagtactaaatacaaccgtttgaaagaaaaatataaactgtttgtctcgaatacatgagataacagactgaaataaagagagaggagacgccgggcctgcggacgcttgcaaggctaccttggtgtctcactggactgaaagcaggctcccgcgttactgctgctgtccaagacctggatctgtgcaaaagagcacagagtgtagtatcagcacaaccgaccccatgtgctggtaagtgtctggcctaaccccggcgaggtagtgacgaggttaggaccagactccagataaacctgtgcagttatatactatatgacggaaaagtaaacaggtaataagcaatcaaagctggaaaaaggggaaacatgctccgggggtagcagataaaacagaataccaaagaatagtaaggaaactacaatttaacttctaacacggataaagagaaataaggaaactttcactttcagtttcatcttgttgcaggcgtgcaacccgatcccatttctcatatcttgtggtaggcgtatcacccgctccgattttattatatctcatggtaggcgtaccacccactcccatttcattatatcttatggtaggcgtaccacccgctcccatttcattatatctcgtagtaggtgtaccacccgctcccatttcattatatcttgtggtaggcgtaccacccgctcccatttcattatatctcgtggtaggcgtaccacccactcccattccattatatctcgtggtaggcgtaccacccgctcccatttcattatatcttgtagtaggcgtaccgcccgctcccttttacatttcatcacacaatcacaagaaatcccgacaaggaaacataaataatataataacttcccatcaagggaacacaacaatgttataattttcccggcaagggaacaacaatattgaattagtcatcccggcaagggagaatcagctataccaacctcaactcaacttgtactcagttcaattattgaaaatgctcaatcatagaagatcattaagtaaagcacccaagtgtcatttaagaacacaacaactttcaatttaagactcacggtcatgcttgacaccaacttatagatactcgtcaccatgcctatacgttgtactcaacaagaagcaagtagcaagtatgactcaactcctaatccctcaagctagggttagaccaaacacttacctcgatgccttgatcaccactcaagtctcaactatagctttaccccttgattctaccaccaatccactcgaatctagtcacaagttacttaattacatcaataagtgctaaatgaatcaaccccaatgcatgaaaatgagttttctaaaattttacacaaaagtcagaaatcacccccgggccgacgtggtcgaaacttgaggttcggagcaaaacccgattacccattctctcacgaatccaaatatataatttgttttgaaatcggacctcaaattgaggtctaaatcaacaattttagaaaacctaggttctacccaaaacacccaatttcctccatgaaaatctttgatttgaagttgaaatcatgttaaaagatgttaaggagtgaacaaaatgagttagaaatcacttatcaacgttttggagaagaaaggttatttgaaaaatcgccttttatgttttggggttttgaaaaagtgaaaaaatagctcgtttatttatacccctctcagacccacagtgtggaccgcatcaaatggaccgcggtcgcacagcctctaccgcggaccacacaaaggcgactgcggccgcgctggcccctccctgaagacctgcagttcaacaccctgggcggaccgcacaaaggcgatcacggccgtgctggcccctccgctgtcgcacacaatttctcgcggaccgcactagagggttcagagaatgcaacatttgactttctaagcctaaggcatttcggagcccattcgaaactcacccgagccctcgaaactccaacccaagtatacacacaacctcaaaaatatcctacggatatattcgtgtactcaaatgaccaaaataacatcacaagcattgaattaaacctcgagatcaataaaatttctcaaaactcttttaaacataaaatttctcaattaaggtccggatcacatcaaacgacgtccgttttaaccaaatttcacaagaatgactcaagtcatatataagacctgtaccaagtaccagaaccaaaatacgagcccgataccattgctttctaatcagtttctcacttcaaatttccttaaacaatttctaaaaataatttcacttaaaaattcatttctcgagtaagggaactcggataccgattccgggcatatgtctaagtcccatattttcctacggaccctccgggaccgtcaaatcatgggtccgggtctatttacccaaaatgttgaccgaagtcaaatttattcattttaaagtcaagacttaacatttttcacagaatttaatatttaagctttccggctatgtggctggaatgcacatgcaaatcgaagcaacttcaaatgaggttttcaaggcctcggaagtacataatgggtaagaaaacaggtgatgaccctttgggtcgtcacattctccacctctaaaacaaccgttcgtcctcgaacggacagaagaaggaagtaactgagtcagggaataaatgaggataatggctccacatatcgaactcggactcccaggtcgatgccgtaggaggctgacctctgcactgaacacgaaccgaaggaaaactctacgacctcaactgacggacctgccggtctagaatagccaccggctcctcctcataagacaagtccttgtccaactagacagtactgaaatctaacacgtgggatggatcgctgtgatacttccgaagcatggacacatgaaatactggatgcacggctgatcagttaggcggcaatgcaagtctacaagacacctctcccactcgatcaataatctcaaatggaccaatgaacctagggctaagcttgcctttcttcccgaatctcatcacgcccttcatagacgacactcggagcaatacccgctcaccaaccataaaagtcacatctcgaactttgcggtctgcataactcttttgcctggactgagtcgtacgaagcctctcctgaatgatcatgaccttgtccatggcctcctgaaccagatccgtacctaacaaccgagcctcccctggctcaaaccatccaacaggagatcgacatcgcctaccatacaaagcatcataaggagccatttggatactcgactggtagctgttgttgtaggcaaactctgctaaaggaaaaaactgatcccacgaacctccaaaatcaatgacacaagctcggagcatatcctctagaatctgaatagtccgctcggactggccgtctatctggggatgaaagcctgtactcaactccacctaagttcccaactctcgctgaactgctctccagaaatgcgaggtaaactgcgtacctcggtccgaaatgatagatacaagcacaccatgaaggcgaacaatctcccgaatatagatctcagctaacctcttggatgaataggagaccaccacatgaatgaaatgcgctgacttggtcagcctatcaacaatgacccaaactgcgtcgaacttcttccgagtcagcgaaagtctagtaacgaagtccatagtgatccgctcccacttccactcgggaagctcaatcctctgaaacaatccaccaggtctcttatgctcatacttaacctgcttaaaattcaaacattgagccacatatgcaacaatatccttcttcattctacgccaccaataatgtcgccgcaaatcctgatatatcttcgcggcgcctggatgaatagagtactaggaactataggcctcctttaaaatcaactctcgaagcccatccacattaggcacacaaactcgcccctgcaatctcaaaacttcatcatcacctaaagtaacctgcttggaacctccatgctgcaccgtgtctctaaggacacacaaatggggatcatcaaactgtcgatcacggatacgctccaataatgaagatcgagtgaccgtgcaagctaatattcggctaggctcaaagatatccaatctcacaaatcgattggccaaagcctgaacatccaacgcaagcggcctctcaccgaccgaaatataggcaagactgcccatgctggctgactttctactcagagcatcggccaccacgttggcctttcccaggtgatataagatagtgatatcataatccttcaacaactccaatcatctcctctgcctcaaattcaactccttttgcttgaacaaatactgaaaactcttgtgatcagtgaacacctcacatgtcacgccatacagataatgcctccaaatcttcaatgcgtgaataatggctgccaactctaaatcatggaccagatatttcttctcatgaatctttaactgccttgaatcataggcaatgaccttgccatcctgtatcaacactgcaccaagcccaatacgggaagcatcgcaataaactatgtaaggccctgaacttgtgggcaaaaccaacactggtgcggtagtcagagttgtcttgagcttctgaaagctcgcctcacactcgtccgaccatctgaatttggcacccttctggttcaacctgatcatcggggctgcaatagatgagaacccctccacaaaccgatgatagtagcctgccaatcccaagaaactctgaatctctatagctgatgttagtctaggatagttcttgactgcctcaatctttttcggatcaacctgaataccctctgattatacaacatgacctagaaatgcaactgaactcagccagaactcacacttcaagaacttagcatataactgactatccttcagagtctgaagaaccactctgagatgctgctcgtgctcctcctggctgcgggaatatatcaaaatatcatcaatgaagactatcacgaacgagtccaaataaggcctgaacactcggttcatcaaatccacaaaagtcgctggggaatttgtcaacccaaatgacatgaccaagaactcataatgcctgtaccgagtgcggaaagctatcttaaggacattggatgccctaatcctcaactgatggtatccagatctcaagtcgatctttgaaaataccttggcaccctgaagctgatcgaacaaatcatcgatcctcggcagtggatacttattcttgatggtgaccttgttcaactgccgataatcaatgcacattctcatcgaaccatccttttcttaacaaacaacaccggcgcaccccaaggcgaaacactgggtctaatgaaacccttctcaagcgagtcctgcaactactccttcaactctttcaactcaggcaggtccatgcgatacgacagaatagaaatgagctgagtgcccgaagccaaatcaatgcaaaagtcaatatccttgtcgggcggcatacccggcaggtctgaagggaaaacctcaggaaactcacgaaccacgggacaaaatcaatagaggaaacctccgcactataatcttgaacataagctaaataggccaagcaccccttctcgaccatatgccgagccttcacataagaaatgacgctacatgtagaatgactaggagtccctcttcactctaaacgaggcatacccggtaaagctaaggtcacaatcttggtgtcacagtccaagatagtgtagtaaggtgatagccagtccatccctaatatgacatcgaaatcgaccatgtctagaagcaataaatccacgtgagtcttaagacccctaatctcaactcacaagagcgatagactcgatctaccacaatagaatcacccactggcatagacacataaataggaatactcaacgaatcactaggcatgactagatacggtgcaaaataagatgacacatacgagtatgtagaccctgtatcaaataacactgaagcatctctatcacaaaccagaaccgtacctgtaataactgcatctgaagcctcagcctcgggcttggctgggagagcataacatcggggctgggccccccaccttgaactacctctctaggatggcctgctactggctggcctctacctctggcggccagagctccacttctaggacctctaactccacctctaacacctctacccccacctctagctatctgggcgggctgtggaacatctagtgcctaaaccatagcacgagaaccctgatgcggagaactgctcgaagcccaagggaaataccttacaatgtgcctcgtgtcgccacaagtaaaataagccctcggctgctggggctgacgaccctaagaactctgaagcggtggtgcactgataggtgctggtggtgcactgaaggactactgatcagaatactgaatcggaggaccacgaccacctgaagcaccgtgaaaagcctgaagagccaactagaagggactaggaggatggcctctaccatatgaatccctaccaccagacgaggtaccactgaatctgcctgaatgatggggcctcttatctgacccctgaccaccttctgcgacagaaccatctcagctctgcgggccacattggccacctcctgaaaagtgatctcactcccggcctccttggccatctgaagatgaatcggctgaataagaccgtcgataaacctcctcaccctctctctctcggtaggaagtatgataagagcatggcgagctaagttgatgaacctggtcttatactgggtgaccgtcatggaactcgaactgcctccgataggcctctctctgagtaacggggagaaaattctccagaaacaatactgtaaactgctcctaagtcaaagatggcgacccagctggcctagctaagcaataatccctccaccaagtcttggcggatccagacaagcagaatgtagcaaaatcgacctcaacaatacccatgttcctaagaacctcgtgacagctatatagaaaatcctggggatcctcagaagaagcaccactgaaagtagtagtgaagagcttggtgaacctatccagcctccacaaagcatctacatacatagccgctccatcaccggtctgagatactacacccggttggactactccaactggccgaaccgctggagtctgaatctgaggagctacctgctctggagtgcgtatagtaggtgtctgagcccctcctccagcctgagaagtggctggggctacaggaagcaaacttgctcgggtgacactctccgttaggcccaccaatcggaccagagcatcctgaagaactagggtagcaataaacccctctgggacctgagctgggcccaccggaactgctggggccagaacctcattctcaaaattctcgggactaaactctgcccctacctcggcctctagcatggcctcggcctctagcacggcctcggcctctgcccctagtgcgagcttctgctgggggctcgggttgctgagcggtagataaggaagcgcgtgttcttgccatctgcgagagaacagagtagaaatccaattagcatttgaggaacaaatccgcacgacaagaaagaacaaatttgagattttcctaactctgtagcctctgggggataaatacaaacgtctccgtaccgatccctcagactctactgagcttgtctgtgagttgtgagacctatgtaacctagagctctgctaccaatttgtcacgacccggacttcccacccccgggagtcgtgatggcgcctactaatgctagctaggtaagccaatccttaacaacttacttcattaacaaatcacttcttttaacgacaatcagtgatagcatgaaaacaccagaatttagtaaatgtacggaagacttaaattaaagaaactgaacaataatacggaaatcaacatatgcctctacccaagaactggtgtcacattactccgaacttctaagagtactaaatacaaccgtttgaaagaaaaatataaattgtttgtctcgaatacatgtgataacagactgaaataaaaagagaggcgatgttgggcctgcgaacgcgtgcaagactacctcggtgtctcactggactgaatgctggctcccgtactactgcttctgtccaagacctggatctgtgcaaaagagcacaaagtgtagtatcagcaaaaccgaccccatgtgctggtaagtgtctagcctaaccccggtgaggtagtgacgaggctaggaccagactacaaataaacctatgtagttatatactatatggcagaaaagtaaacatgtaataagcaatcgaagctaggaaaggggaaacatgctccgggggtagcaaataaaacagaataccaaagaatagtaaggaaactacaatttaaacttctaacacggataaagagaaataaagcaactttcactttcagtttcatcttgttgcaggcgtgcaacccgatcccatttctcatatcttgtggtaggcgtaccacccgctcccatttcagtatatctcgtggttggcgtaccacccgctccaatttgattatatctcgtggcaggcgtaccacccgctcccatttcattatatctcgtggtaggcgtagcacccgctcccattttattatatctcgtggtaggcgtaccacccgctcccatttcattatatctcgtggtaggtgtaccacccgctcccgtttatatttaatcacacaatcacaagaaatcccggcaagggaacataaataatataataacttcccggcaagggatcacaacgatgttataattttctcggcaagggaacaacaatattgaattagtcatcgaggcaagggagaatcagctataaccaacctcaactcaacttgtactcagttcaattattgaaaatgctcaatcatagaagatcattaagtaaagcacccaagtgtcatttaagaacacaacaacttttaatttaagactcacggtcatgcttgacaccaacgtatagatactcgtcaccatgcctatacgtcgtactcaacaagaagcaagtagcaagtatgactcaactcctaatccctcaagctagggttagaccaaacacttacctcgatgccttgatcaccactcaagtctcaactatagctttaccctttgattccaccactaatccgctcgaatctagtcacaagttacttaattacattaataagtactaaatgaatcaaccccaatgcatgaaaatgagttctctaaagttttacccaaaagccagaaatcacccccggggctcacgtggtcgaaactcgagtttcagaccaaaacccgattacccattcccctacgaatccaaatatataatttgttttaaaatcggacctcaaattgaggtccaaatccccaattttagaaaacctaggttctacccaaaacacccaatttcacccatgaaaatctttgatttgaagttgaaatcatgttaaaagatgttaatgagtgaagaatataagttagaaatcacttaccaatgttttggataagaaaggttgtttgaaaactcgcctcttatgttttggggttttgaagaagtgaaaaaataactgaaattctcgttatttatacccctctcataccccagtgaggaccacaacaaatggaccgcggccgcatagcctccaccgcggaacgcacaaaggcaaccgcggccgcgctggcccctccgcggtcgtacgcgatttcttgcggaccgcactagagggttcagagactgcaacttcctgaacctgcaacatctgactttctaagcctaaggcatttcgaagctcgctcgaaactcacccgagccctcgaaactccaacccaagtatatacacagtctcaaaaatatcctacagacatattcgtgtactcaaatggccaaaataacatcacaagcatcgaattaaacctcgagatcaaaaaaaattctcaaaactcttttaaacgtcaaatttctcaattaaggttcggatcatatcaaacgacgttcgtttttaaccaaatttcacaggaatgactcaagtcatatataagacttgtaccgggcgccggaaccaaaataagggcccgatactattgctttctaatcagtttctcactttaaatttccttaaacaatttcacttagaaattcatttctcgggctaaggacctcaaattctgatttcgggcatacgcccaagttccatattttcctacggactctccgggaccgtcaaatcacgggtttgggttcgtttaccctaaatgttaaccgaaatcaaatttattcattttaaagtcaaaacttaatatttttcatagaatttcatatttaagatttccagctacgtgcccggactatgcacacaaatcgaagcaactctaaatgtggttttcaaggcctcagaagcacataatgggtaagaaaacaggtgatgaccatttgggtcgtcacatccacccaaaccctaattcatgcctataaataaggctacatatgttcttcaaagatagtccaacagttccataaactctcaaaatatgcataaagagatcaaatatacgatctccaaaatccccaaaaattcttggaatattcaataagagatcaaagacatgccaaatatgtcttgctcaaatttctatcaacattcaagatccaaacagattgctgctacatgcttcttgatcatcaaatacatcaaggagatgcataccattacgttcgagaaatacacttctaaggccctagaatcacgtagaataaatcggaggaaagaatcaagggataaacagagttgtaacctaaaatgtttatcaataaaatccttttttctttatagttgtttgtgattgcagttttatttttctctgcataaatttgttgcaaacaaattggcacgcatagtgggaccagctctgtcctccatctcttccttctgcaaatcgaatgtcgcgccccctttttccccttcatgggaaaaatccgggttctaacgttcatgggggtaataacttatttccttttgggaatttgggtattaaagagtcgccacctaacggattatagtgcgttagggcacctagagcgattaactcttggattggtttgcattactagagatttagggtaagggctcgagataacctagaagagaaggtgttaggcacccctcttagtccacaacggtgggtcccgcccgaacatatatttacgaacaagtccattaacagataaatagttttaaacacataattacaaataagagcaggttttagacattacatgactcaaataatgacacaaaggaaaggcttaaacaaattgtatacatatggaaagtaaaggtaatttgggaaggaggggtcctagtttggttagactacaggatcaccccatgtaatgtctggtaaacactcctcaatgaggggctacatatgacattagcgcgtagtcatcatatccctttctacccaagtccctccccttggtcatagcctaaacctctctagcaactttgacaatatcctatgcgtgcactacccgttccttcttcgtggccctggaggtattttaggacctctattctttagacagttctcgacttttctaagtttttaaaggataaaaatctaggcgtcaattaagaatagtttggactgcatttaaagaaataagttataggctcatagttacctcctcaaacataacaagtaagtgcacgtcttcaaagaacattcaaatacttaagagaaaaccctagcacatgatatctaggtgagcaggggttatatagcgttgaattaggacaatatgtgaaagatcctatttatcttgcctattgatttgaacttgttaaatttgaacagctttaagtagcaaaaaaatagttccagagttgcagaatttaaaacgccctataggcttgcctaaatgtagaatagtgatgtcttaagagcaagataactacgttgatgtagtaaatcagtgaacagttttaaacggacacttgagatcctataggcatgctttctagcagtagtgagttaaggcagtgttttaaaaactcaattaaagaagtggatagttgattaagccaatttcaaagtgaactaacatgaattagactgacttgtgtaactaaattgattttaattctataggcagaatttctgattttaattcatataggcatgttatctaattgttaagagctgatgttggaacttataggtatgattttagtgagacaaatgtaaacacatgtagtagaaggaattgaactcaatcactttacactctataagcatggtatctaattatgaagttgattttaaacctatagatatggtttctattattgaatccatttaaaccctatagacatgagttctaatatgggaaccttttaaaccatataggcatggtttctagtgtggtaaagcaaatatagcaagtctattaatataatcctataaatatggtatctacccgaattacccctgaaatatgtaactacccacgccttttcactaatcaccccaatgttatttgcaaataattattacagaccagctgaacaaataacataaacaaataaagaaggaaaagaagaagttaactatagggagcctgaagtaggcccaaatgacttcccaagcctccaatagcctcaagtgccaaagtaacatatacaatatcatatctaggtgtgtcaaagttccctaaggaactcaaggatcctgagcagtgctcacacctagacctttctcaacaataactgatttaagtgcagtgtggaaaggccagctctaacatgcaagagttcagagaaatctcatggatctcaaggcagtacacatgccagaggggcaggacctaaatattctagtagtggagagtgcttgacatagaaagagtttggaagatagagaaagaaggtcttaatagcagaaagaacttttatgaaagtcagaacaaagttttaagagtaggaatagtttaagaagacatttaaaataataagaaatcaggttaaagaatatacagcttcagaataaatctcacacaagggatagaggtatgggaacacctagcatacaccttagtggtgtcaatcaagtacagatatggtagttacaaagttaagttgggaacacataggtttaagacacaagcagaattacattagaacaaactgtaccggacaaacatttcatgaaaaacattcaatgtattagaacaagcagggtttggtcatgctaaacagtataaaatcataagcttgaaacatgctttgtaatatagtattctaggcatactgattgcatctaagtagaatagctcataaaactgaaaatcaagattgataaactatagtaacaaagtaaacacatagcttggaatgtgaatttaatcagaacataccagtttaggagagtatgcagaatacagagtaaagataatgccagtagtcagccttagtgtacaaccgactgaactagtaggaattgtaaggaacagaagagagtagatgctttttgagagtataatagtgtagacaaactagagtgccttgttatcgttgttataaactttaaagaagagaaggtttatataggagtcgaaaacttaacaaaatgagataagagattaattgagtagtaaatcagggaagttacccataaatcagcaagatcttcccttaatcaagggactattcaatcaacggtaaacatgccaggtatttaaggacaagaataaagtaaagtcttaggtataaaataggtaattaagggctaggtacataaagttctaattagggaaataattagtaagaatcaagtaataatgcagacaaggtaaggaaaaattaattaaggcaagcaaattaatcaaattgagtaaagaagcaagaatcaaacgtttaaagcaaagtagtcaaataaaactagaaactaagggatttagagtaattaacggttcagaaaatcgtgaaagaagcagcatgcttagcatataaaatgaggtaaggcatgaacagtcaggatttcacacagccttgacaaaacacatggttaaacgacactgattcaaagggaagcatacaaattttgcatgaatggctagtacacacacaagttcataatattagtgaaagtttgaacaatgaagattcaataaaagcatactaggacaagtaaatcatgagaagtcacaagaaactaaggcaagaacacactcagaagtacccatatcagaaacaaaatgaaaaccccaacattagggttttcagtataaacgggctagggttgcagcaattttataaaattagtcaaaaatgtgtgagaatcagaagtttaaacacaaagaatcatcaaacaaagttttaaaagaaatttcaaaaaccctaattttagaaaaggtgaagaaatcacttgaaatcaaacgattttggtagagaatctcaaagatattgtaagacacacaagaaatagactcaaatcgtcctagatctgtacagatctaggagatttagagaggaagttagggtttcgcagaaaaccatatagaggtgaagaaacatactgaaaaaaccatagatcgtggctaacatagaaagatttcactcgaaatcacaccggaatggccaagaacaggcaagagatgaacccaggatgcaagtcggcatggccctggtcccttgagggccttagggattgaaagaatgacatgagagaagccattagaggcctgagagatgatgagaggtcgccagagatagccatagataaggggtcggcgtttggagattagggtttaggttgagagtgttttgagagcaaagaggattttagggcggcggggtgggttgtaaaatgaattaggttggggagggaggggtattggtcggtttaattaggaaagggagaatctgggccgttgatcctttgggccattgatcaaaacaatcaatggccaggatttggccggtattgggtcgggtattttaatcaaaagttgggctaggtaatttagtgtccgatttgggatgaatagggattggggaggggttggaattgggctaaaattgaaatgcaatttggctagattttaaataaaattttaacactatatactttataataaataataaatgatttctgaaaaaaataatttcatgtattaaaatgattaaatagttgtttaatattttaaaaatataaaataccattttatgtattaaaaacgtagttatgctttaatagggctagtattgcaaatatatgcaaattgactttaaaaatgcaaatgcaattataaaaatgtactaaaaatattttaacaatattttggcataaatatagaatttagatggctaaatcaccacaaaaataatttgaaggatgattattggagatttttgactttgtttttatggtatttatgttatgttatggatttaatggtattttatgttgttttattatgagtctattgatagtactaatatagtgtctcttgttgcctctttgagccgagggtctcctggaaacagcctctctgccctcgggtagaggtaaggtctgtgtacatattaccctccccagaccccacttgtgggattacaccgggttgttgttgttgttgttgttgattattggagattttatcagtaaaaaggaaggaaataaatcaatttgaagattttaaaaattatagaaaaattataaaaatgcttatgcatgcttatatatgcatatatactattttgaaagtatatttatgtattaaaaaaatatatagggaaaaattcggtatcaacagctgcccctctttaccgaaaaggatgaaagagctttcgggtaaagaaataatagccaattttgaccggacgggatgttttgaaaaacagaggccggactccggtctttgatttgcctacatatccctaattttcaggaatcaggccatgtgtagttctagattcatcggcggaatatgccgatgaaattattgcaagaacggacacgagatgtggaagcagctatggtgagtggttagggttcgggacaattgaaggaactggagcgagatcgctcctactaggatagttgtttcttgctggttacctgcagataaaaatactacaaacctatatttgtgaaaatttaaacatgatgaagatttccttttagaccatgaaggttgtctttggacggttaaagatgatgtccttggaccatgatgtcctgggccatgaattgtttagcgagggattcacagtccatgaaatgatgttctcgggccatggcaatggtgcctccgaaccatgacgcctttgaataatgatatgcaaatttgagggatacttaggccatggcatgaggatgatgccttttagactatgacgcctttggatagattgacgatatttagcccatgatatgcaatagtcatgatgttaacaagacaaggcttagtcttgggaaatggagggcagagcttagcccgattgaaaagcaaataaatagtactagaaatagagcaatattcgtgcaaagagggacaatgcttagtcccatacagatggggaagcaaggattagcctcatgcagatggaggcagggaatatcctcatgtagagagggaggcaaggattagcctcatgcaaatatggaggcaaggattagccccatgcaggtgtggaggcagggattagcctcatgcagatatgaaggcagggattagcctcatgcaaatagggaggaaaggattagcctcatgaaaatatggaggtagggatcagcctcatgcaaatatggagtcaaggattagcctcatgcagatatggaggtagagattagcctcatgcagatatggaggtagggatttgactcatgcaaatgtggaggcaaggattagcctcatgcaaatagggaagcaaggattagcctcatgcaagtggggagacaaagattagcctcatgcaagatagggaggcagggattagcctcatacacgtatggaggcaaggattagcctcatgcagatatggaggcaggaattagcctcatgcaaatatggaggcaaagattatcctcatgcaagtgtggaggaaaggattagcctcatactaatagggaggcagggattagcctcatgcaagtatggaggcaaggattagcctcatgtagagagcaagtagcaaataagagtagtgtatgtcttagctggagatacattcggtgtctgatgtcttgattgataatgaatttgttacgtgtatgtatttgaggatgttattgccatgctagatatgcctgcattcaaagaaaaattgtaagttttgtgggggaaggttggtttgtgcttctgtcggctggctttgctttgctctatcctgaaagccctttctgagttcccctaggtaacacctgactgttatggaaatagagtttttcgaaaaatattcaatcgttcataaaaatagagttatttcagaaatatattgatatatttagatgaactagtgactgtaacacatctcaaatgcattacaactctcttctattggaattttgagggtccttctcaaaattctgccccagtttagtagatgatccttcggctgtttgcggacaataggccttgctgaaccttcttcggaattttgagaatccttctcaaaaattttgccccagtttcttaactaattattgaccgtctgacacatgtttgcattggctggacttgctccggaattttgaggaccctcttcaaaattctaccacagtttctgatcttggggggaaatgaaaattttattatgatatgatcgaacccataaggctgcctacgtatcccctcttaaatggaaatcaggtcaaacgtagttcaattacattagatgagaaaaatgtaaataatccaagcatcgtatctcttgattgcgtctgaattaattggttttggccaaattgctccatcaatttttgcaagtatgggtgctcctcctgtcagcaccctgtgaaccatatacgaaccttgccagttgagggagaatttcccttttgattcatcttaatgtgggaagatcttctgcagcaccaactgacctggtgtaaattgccttagtttgaccctttagttgaaagctctggacattatgttctgataaatttggccttggcacactgcattcatcctctttccatcgatgaaggccaattgttcatagcgacttcttatctattctgcatcgctgagttcagcttcctatatgactctcaaagaagcaatctctacttcggctgggatgacaacttcggtaccgtaaactagcatgtaggaagttgccctggttaatgtgcgaaccatagtgcgatatcccaataaagcaaatggtagcttttcgtgccactatttgtgattctctaccatcttccttagtatcttcttgatgtttttgttggccgcttctacggctctattcatctgaggtttgtaggttgtggaattcttgtgcttgattttgaaagtttcacccatggcttttatcagatcactattgaggttggcggcattattagtaagaatggactcgggaactcctaatcgacaaacaattcgatccttgacaaaatctacgatgactcttttggttacagctttgtaagatgcaacctctacccattttgtgaagtaatcaatggctactagaataaacctgtgttcgtgtgaagcagtgggctaaatcggaccaataacatccattccccaagcggcgaatggctaatgagagcttgttacattgagctcgtttggcggcacttttatcatatcggcatgcacctggtattgaaagcatttgcggacatactggatgcaatccgtttccatggtcatccaaaagtaaccgaccctaagtatcttcttagccaagacgaaaccattcatgtgcaggccacaagtcccggcatgtacatcctcaagtagcttagaagcttcctttgcatcgacacatcttaggaaacccaaatcaggagttctcctgtacaaatttcctccgccgtggaagaagtgattgtaaaatctctggagtgtgcatttctgagtgtggtttgcgtgctcaagatattctccctttgacaaatacttcttgatgtcatggaaccaaggctttccatctatttcttcttcaacatgagcgcaatatgccgactgattatggatcttcactgggatgggatcaatataatttttatatggatgttgtatcatagatgacaaggtggctactgcatcgacaaactcattctgaattctgggcacatgtcgaaattctatcttcatgaacctctttcttaattcctgcacatggtgcagatatggcaatatcttggaattcttggtggcccactctccttgtacctggtgcataagcaaatctgaatcatcgatcactagcaactcttgaatgttcaagtcgatttccatgtttagccctagtatgcaagtttcatactctgccatgttgttcgtgcagggaaatttgagtttagcagatactggataatgttcacccatttctgataccaaaactgctccaatgcttactcctctaaaatttgcatctccatcaaagaacatcctccaaccgtcgtatgcttcagtaatgtcttctcccacaaatgatacttcttcatcaggaaaatacatcttcaaaggttcgtatgctcctcccaccggatttttagcaaggtgatctgccaatgcttgccctttgaccgccttttgagttacgtagacgatatcgaactcacttaacagtatctgtcatttggccaactttccaatcggcatgggtttctagaatatgtacttcagagggtctatcttagatatgaggtatgtagtgtaggcacagaagtaatgcctcaatttctgagctgtccaggtcaaagcacagaaagtgctttcaagtaaagagtaccgtgcttcataaggtgtgaacttcttactcaggtaatatatggcttgctcctttcttattgtctcgtcatgttgtcctagaacacatccgaaggctccatccaatacagatagatagagtagcaaaggtcgtcctggttctggcgggaccataattggtggtgtggacaggtactccttaatcttgtcaaatgctttctcacaatcctttgtctagcttgtttcggcatcttttctcagcatcttaaagatgggttcacatatgattgtggattgtgatatgaatcgattgatgtagttgagacgtcctacgaagctcattacgtcctttttgctcttaggcggtggtaactcctgaatagccttgaccttagatggatccagctcgatccctcgaggactaacgatgaatcccaataattttcctacgagaaccccgaatgcacactttgcgggattcagtttcaaattgtacctctttagactgccaaagaactttctcaggtccgctatgtgatctgcgaccctatcggatttgataatgacatcatccacatacacctctatttccttgtgtattatatcatggaagatggttgtcatggctctcatgtaagtagccccaacatttttcagaccgaatggcatcatcttgtaacagtatacacccaaaggcataataaaagttgtcttctctgcatcttctttgtgcatccagatctggtgatagcccgcgaaacaatatacaaaggattggagttcatgcttggcacaattatcgatcaggatgtgtatgtttggtagtgggaagtcatccttgagacttgctctgtttaaatcccgatagtcaacacatactctgaccttcccatccttcttcggaataggcacaatgttagctaaccaagttgggtacttaaccaccctgagaactttggctttgatatacttggtaacttccttattgattttcaggctcgtgtctagtttgaactttctgagtttctgctttactggcggacatatgagattagtaggcatcccgtgagtcactatggacgtgctcaaaccagtcatgtcatcatatgaccatgcaaaaatatcctcatactcttttaggaagcaagtgtactcttccttctctgttgttgacagtgaatgctgatgcgagtctccttgacggtcttggcgtctcccaaatttactgctttggtttcatccagattggacttaggcttattctcaaaattttcaacctccctgataatttcctcgggtatctcatcctcttcgtctgaatcactatcctcatgttgcatttcctcattacatgtcacagtcacgggttcatcagaaaaagtaataataatgctgtagaaatgaaagtataaaatagtaatgaataataaagagcaaaagagtttgattaaaactgataaatcatcttgacaagtacggctcgatgaatcaggcatttatttcgaaacaagtaaatcttaaaacaaaattacaggaaatcttagatgcctagaatggctatagaagtaaaaatttgccaagctacccagggactcagcgggctcgagatggtgtggcagtccagttcctgagagcggctcccttctttacagtttgaatggtgaggccttcttcctcctcctcctcctcaattatgcactgcagtctatgtcctcatcctccaagaacaaattcttcaacccagcgagcgcttcctcttctgtagtcccccatatcgtattagcttgatgaaaagcttgttccaaatgtgacactagttgctcgagagggtagtacggtccatgccattaaggcgaccaatttctatgctcctgccatgtgtactagtatccaagcccaaaggtggtaccatgatttttcagctatattggtttggtgataccttagaggttctttcccaatcctttgccgggttcatatccagactaggccaatatgctttctattttactgctccaccatttatccttgtcgatggcattgacccgttcaatgtgatgatatgtttccccttctagccttcttttatgtccaatagccgggatggtttgactagtgtaaatgggctactcccgtcgccgtgaatgatcacctcctgacgattccattttaatttcatagcttgatgcagttaggaaggcacggcatcagaggcatggatccatggtcggcccgacagaagattatatgaggctggtatgtcaagcacctgaaactcgacgtcgaaccgagttggccccatctgcaagcaaagtttgatttccccgatcgtggccctttggaacccatcgaaagctttcacgttcatgcttcctacccgtatttcatggaaacctttgtccaaccttttcagagtgtccaatggacaaatatttagtcttgaacctccgtcaaccaagaccctgtcaatgaatttgtcttcaattacactgtaatgtgcaatgccgattgtgatttagcccctcaggtggtagctcatcttcgtggaagataatcttataactttccaatacttgccccaccatgttggccatttctccgccagtgatgttattgggtacataagcctcactcagcactttcattaaagtgttcttacgtgcctctgaattttatgatagtgacaggatagatatctgagctggggttttgttcagatggtcgacgatggaatacttctttgcttgtactttcctccacaggtcattcggcccgatctcaatgataggctacctagtattggtatccttacttgaacctcccaaatgttcaggcatatagccccttccagtcctagtcttcccttgtgcatcatcagattcttctacgttggcgttccctttttgctgagcctcgacaacataatcccagggtattgcttttgattttaatggaggtgtggttgatactgtcatagtaaaaggtgggaccacttctacctcaaagggagcaggggtggccacatgtaaagccacctctacctcaaatggaactgatgcatttatctcaaccttgattggtgactgagtctgtaccacaataggagtaagtgtgactgcaactttaaagtcatagccttctcgaataaacccaatcgatccctcagggtcccattcttcattcgtctttatcacatgtacttcaccgcatctatgatcagggagggggttgtcgcggacattaggtgtgtcttcctttgcgtgtatgaccttgttgccaatcagtgtctggatcttatccttcaatgttcggcacccagcagtggtgtgtcccttcataccagaatggtacgaacaagttttgttcagattgacccattgggatgggttttctaatgccacagtgggaacagaagtggcataacccacagcttgcaacctttcatacaacaggtcgataggctcaacaatggcggtgtaatgtatgggtggcttgcgatcgaaattaggtcttggtctcgaaaagttttggcgagttggaggtgattataaatgggatggttgggagttataagtatggtggaaagtggccgattaggaatatttgggagataagggttgacatgtgggtggcggtgcttggtacgtgggtagaggtgtttaatatgtaagtggagatttcgggccttgggccaccattactgccccaacatttctcttctttgatatgctgcctgattgtaatgccttctttgagggcctgtagcacctcaaaattcattaccatcccactcttgattccttcttcgattctttctccgagtttgatgatatcagagaatttatgatttttgataaccatcaatctttcataatattgcggatcctatgctctaatgaagaatttgttcatctgttcctcgtccaaagctggaactctaacgagtagcatactcacggaaagtctcagtaggtttcttcttaagattctggatgtagaaaacatctggtgcattatctgtattgaacctaaaccgatccatgaaatctgacgccatacttacccaactggatcatttcttgggatcttggctaatgtaccaggacaaacaatccccagtaagactcctcataaagagattcattcggatctttttgtctttccccaccccgacaagtttgtcgcaataagtcctcagatgaactatgggatcacctgtatcgtcaaacatctcaaacttgggaggtttgtatccctctggcagttctacattcggttgtatgcataggtcttcataattcaaaccttctattcctttgccgccttcgacaccttgaactcagcttgtcaacttcttgagttcttcagccatgtttttaatgagcaggtccttttcggaggattctggtgtataagacatgggttggatggagtgaggtacaatttctacgtatatagggttgctttgatgggtgccaggaacttaggcgtagtgatggtcgttggtggagttttggggatggggaatgggttgtggtgtgttttggggagtgtggtaagtggtggttggtgggtactgagttggctgatggtgatgttgtggcggagtcaatattggcaatggattgagattttggggtggagttgcatattgatttggtgcgggaggattttgtggatgttggttttgtgtgttttggggaggtattgggttctttgtgttctgttggttgatgtcggggacattcaaggtgagtgacaagtttgccaagttgtgaacctactcaagttctccttgcaattccaatatcttttattccaatctcaggactagataatttggggctggagtactacggccatctgaggtttctgcgttctcaacattctcctttcggataccacttaagtcgtccatttttgctttccctctaccctttgtattgcttggaggaggaggaggtggagggcctctagatctagtatgatatgctgatgaggccagtatgagtgaaccaacctaaggagatgggaataattaaaaaaaatatgcaaaaacaaaaaggtaacaagttagtgaggattctgaaatgtttgtagtatttaaacacatattgtggaaatgtaaattcgtgtcctactttggaaacctcattgtgcccgaggtaggcctagtgataaataaatttggagaactttaaatgccaataaatgcttcatttaataatataataatagatgaatcccaaatcgacactaagataataaaaaataagtcactattggcacttggccttattacattttaggaaaatagataaatctagcctatttggtcatagaaggaccttccccagattcaatcttcctgactccatcatatatatcccccagctcgcgcagacccagcagcaagtaggctctgtccagatgttctccttcagcgttctgacaatcctcgattctctttatcactttgcctttcagctctactattcctcgctccacatccagtttcctgttggaagtggctgccatctctttccattcttcaatcatcgtacatttctctcatgtatttcccagtgctcattctcagagtcgtggaccctcttgcgcagcctgttgtatttgacttgagcctcagcttcttcgtttatgatcctattccctcgaccagttcctagcatcaccatccccttcagattgtcctccaaccatgtcgggtagagaggctcacaccccacatgatacctgtctggctcaatgtgttcttttccacaatgattttacaatgccacacgtgctgagcttggcacttataagggacatcgttgttttgaaagtctgccctgaaatgactcatattggcaacccttggtacaacctgtttcctgcctgcttgtcttatacctcggatagggatataagggtatatccctctcaacccgatcagcaccaagtgtggagcgtttctggatctgatgatgaattcgtctgttgggaactattctaacatccattgcacatattcatcagtcagattgtcgaagaactctacccattatttggcactttttggctgagcaaatctgtctggaatgtaagtcatccgcttggggtgatgaaaggcaatatggtcgttccaagcccttcgcgaaaattcttggcagtagtgacccttttgaaaatgttctaacaaccacaattgcagcaacaagttaaaaccctcgaaatgtttggccccttttggcagcactccagagccctgtagatgtcagctatgatcatggggactttagtgtatgtctatctattgatcccttccctcaaaatcttggcaaccatggccaacctagtgtggattctttcccttttcattgggaacactatcaggcccaagaagcatacgatgaacacgaacactctgcggtggatgtggcccagataagtgagagagaactcatcatggtaggtacggtaggacttgctatggccatacctctcatacaaagggtatgtaatattctttcaggcataccaggttagcattattctttaaccccatcatttttaagaaccttttaccggtatggttctccggtaccaataacccgggactatcccaagtcaacccgcaagccctccaatttcttctagaagtggtatcatttctacgttgcgaaaactgaacacagacctctcactgtcccagagcaaagtagtagcctcgatcaacttgttgtttggctcaatgtctagcagggaaggcaagttacccaggtacttccttacatgtttcttgtcacttgaggaaaggtcctctaccaatctagcagcaatggtggaatgttgctaaccatacccaatctggggaccccgtacctcattttctgcaaaacaaaagggttaggcctttatcccccaccagactcgactatttatacattcatgattagcatattggtatttagtttgccaaattaatgcacagatcgtggttgtgtccgttgggattatggaacctccggtggactttggataagtctcttcttaaaggatcattatgtggataacataattgctccgacttggtttgaccataatgcatgcacaattttgatcagagtaaggtaactatggggttttatacttgtaccctcaaacggacaacttgagggggaaacacgcgaaaccgtcgactgcaccgctgatcgattggttttatcacaaataagcctttccgtattcaagggtaataaataggaagagcgcaaccactcattaagcgtcactataggatttgatacgtacgagtggaatatgatgtggagcataatttattcaccaattaatagcataaagtcatgtatttgaacgtaggaaaaataaatacaatatttaaataattgaaaagacagttacagaaaaaagaaaacaaaaagacaagtcagttttaggaataaagaaacataaatgcttaaaataggcaattaaatttaaataaggggaaaaggcttaggatagagcatgcttggactaattcataaaaataggttcgttatggtaagagtctaagatattcccagcagagtcgccatgctgtcgcgctcctttttttcccttcgctggaaaagtccaggttccgacgttcatgaaggtaatgacttatttccttttgggaatttgggtactgaagagtcgccacctaaaggattacggtgcgttaagtcacccagagtgattaactcttggattggtttgcattaccagagatttagggtaagggcttgagataacctagaggggaaggtgttagacacccctcttggtccacaacgatgggtcccagccgaacttatatttacgaactagtccattaacaaataaatagttttaaacacataattacaaataagagcatgtttttggacattacatgactcaaataatgaaacaaaggaaaggcttaaacaaattgtatacatatggaaagtaaagggaatttgggaaggaggggtcctaggttggttagcctacaagatcaacccacacaatgtccgataaatactcctcaatgaggagctacacgtgacattagcgtgtagtcatcatatccctttctacccaagtccctccccttggtcatagcctaaagcgttctagcaactttgacaatgtcctatccgtgcactacccattccttcttcgtagccctggaggtattttaggacctctattctttggacaattctagactttcctaaggttttaaaggataaataagtgcacgtcttcaaacaacattcaaatacataagagaaaaccctagaacatgatatctaggtaagcaggggttatatagcgttgaattaggacaatatgtgaaagaccctatttaacttgcctactgatttgaacctgttaaatctgaatagctttaagtagcaaaaaaatagttttagagttgcagaatttaaaacgccctataggcttgcctaaacgcagaacagtgatgtcctaagagcatgataactacgttgatgtagtaaatcagtgaacagttttaaaaggacacttgatatcctataggcatgctttctagcagtagtgagtgaaggaagtgttttaaaaactcaattaaagaagtggatagttgattaaaacaattttaaagtgaactaacatgaattagactgacttgtgtaactaaattgattttaattctataggcagaatttctgatttatttccaataggcatcgtatctaattgttaagagctgatgttggaacttataggcatgattttagtgagacaaatataagcacatgcagtaccaggaattgaactcaatcactttacactatataggcatggtatctgattatgaagttgattttaaacctatagacatggattctattattgaatccatttaaaccctatagacatgagttctaatatgggaaccttttcaaccctataggcatggtttctagtgtggtaaagcaaacatagcaagtatattaatataatcctataaatatggtatctacacgaatcaccccataaatatgtaactacccaccccttttcagtaatcaccccaatgttgtttacaaataattattacagacaagctgaacaaattacataaaagaactagagttccttgttatcgttgttataatagtgtaatagtgtagatgaactagagtgccttgttatcattgttatgaacttaaaagaagagaaggtttatataggagtcgaaaacttaacaaaatgaggcaagagatcaattgagtagaaaatcagggaagttacccataaatcagcaagatcttcccttaatcgagggacagttcaatcaacggtaaacatgccaggtatttaagaaaaagaataaagtaaagccttaggtatagaataggtaattaacggctaggtacataaagttctaattagggaaataatcagtaagaatcaagtaataatgcagacaaggtaagggaaaattaattaaggcaagcaaatcaatcaaattgagtaaataagcaagaatcacacgtttgaaggaaagtaatcaaattaaaccagaaaataagggattcagagtaatcaaaggttcagaaaatcgtgaaagaagcagtatgcttagcatataaaatgaggtaaggcatgaacagtcaggatttcacacagcctcgacaaaacccatggttaaacgacactgattcaaagagaagcatacaaattttgcatgaatggctagtacacacacaagttcataatatcagtgaaagtttgaacaaagaagattcaatagaatcatactaggacaagcaaatcatgaaaagtcacaagaaactaaggcaagaacatagtcagaagtacccatatcagaaacaaaatgaaaaaccaccaacattagggtttttagtacaaacgggatagggttacaacaagtttataaaattagtcaaaaatgtgtgagaatcagaagtttaaacacaaagaatcatcaaacaaagttttaaaagaagtttcgaaaaccctaattttagaaaaggtgaagaaatcacttgaagtcaaatgattctggtagataatctcaaggatattgtaaaacacacaagaaacagactcaaatcgtcctagatctgcagatctaggaggtttagagacaaagttagggttttgtagaaaaccatacagaggtgaagaaacatactgaaaacccttagatcgtggctaacatagaacgatttcactcgaaatcacatcggaatggccaagatcaggcaagagatgaaccctagatgcaagtcgacatggctctggtcccttgagggccttagggatggcaagaatgacatgagagaagatgagaggttgccggagatggccatagatggagggtcggcatttggagattagggtttaggttgagagtgttttgagagcatagaggattttagtgcggcggggtgggttgtaaaatgaattaggtttgggggggggggggtattgatcgattttattaggaaagggaaaatctggaccgttgatcaaaacgatcaatgaccaggatttggccggtattgggtcgggtattttaatcaaaaattgggctgggtaatttggggtccggtttgggctgaattgggattagggaggggttggaatttggctaaaattgaaatgcaattaggctagattttaaatagccattttaacactacataatttataataaataataaatgatttctaaaaaaataatttcgtgtattaaaatgatttaaaatataaaagaccattttatgtattaaaaacataattatgctttaataaggctaaaaatattctaataatattttggcataaatatagaatttagatggctaaatcaccataaaaataatttgaaggatgattattggagattttatgagtagaaagggaggaaataaatcaatttgaagcctttaaaaattatagaaaaattataaaaatgcttatgcatgctgatcgtggcctactccgcactactaattatttagcgagagagggtcaagatcgatatccacagagagctagaattggaattgagtgtctatttagcctatgattgcttagcgttccaaattgcacttctcataatttttagggttttcttttataattctacttttaacaaactacaaattgtaacttaagctaagagttaaatgctatgggttgttcaaatattctaaaagctttagggtagtggcatccacctaggtggtcaattgacgggtacttgaaactaaggctctattgacattattggggagtatgatataagagttgcactgctttacccactctacacctctcggtggctcaagtgattttgcccaattggctttctcaataccaatgggtatgcaaatttgctcaagcaacttagggttcaagtcgggtattactctctcgaagtttaaccctttaattgggactatcaattctcttgagtccatcccaattccttgttggatcaatttcggagacttaggcactctttttcaagaagagcccaagtcaaattagcacaaactagtgtttgcaaccactaattcagtaattaaaccatgaaattgatccaaataacaaacatccatactcaatatagccgtaaattgcaacactcatcaattgcccacactagggttgagccacaaccctagctaatgggtctagccactcatacttgaagagaaaaacagagaaatagatgaagatgagcacatattaattaattgctaagctaaataaaaagattcaatgataaaaagtaagtaaaaatgcccaaaatggctacaagatacgttcccatgagcgcaacaactattctaaaatgcatgatcccctataaatggaaaaaggatctatttatactaagctaaaaaatttggacaaaaatgccctgcggggttagtgcggaccgcacaaaatggtgtgcagcctcattaagctcttgaacttgaaaacttgactctctgaactcaggctctgcggatcgcacaaaatggacatcggccgcggaggcttctagtgcgttccacacaaattggactgcaaaccgcacaggtttgaaagctgcaactttaccctctctgaatcttggctctacggaccgcacagaatggtagtgcggactgcacaaaaccttctgcggccgcactgccttaatgcctgaaataccagctctctgaatctccctagtgcagaccgcacaaagtgtagtgcggccacactaggcctgtttttcctgagtttgtcttgtctttggtacttgtgcaagtttcactcctttcgagccgatatttgacatcttgtcactttgttgatcaaacctgcaatcaagcacaacttatgagcctttttggactattttgtgtgaatttataatcaaagcgtaagcaagaaggagtataaaatgcgtcaaaatccctagttatcaactcccccaaacttaagcttttgcttatcctcaagcaaataacataagacccaccccttaagggaaaattcaagaaattttcagctgtcctaaagcaacctcaattaacatcaattgggactaacaattgtcttcaacacacataagtcataaacaactttaacctttgaaaaaccatggatcaagtgtgacacaagagcatcaagagttgactcaacacatcaaagaacacttttcacttaccttggtcattgtggaacccaaactcacacatcctcaactctccctaagccaaacttacctttagaatagtggcatgcaaaacgaggttaatggaaattcaatcttctctctcaagaaaaagtcacaagttcggctctaaataccatatgctttccccttatgtgagtatccactaatgtaagctttattcaactcaacatcatataaggcttttttggagacattatgaaggcttttggttcagggtaggacatgttttggtcgaagtaggttccatcttcccttaagcacttcttttgattcatttggcgtaatttacttgactctttgagtcatttcacttctttctaaggggttagagagacacactgtcactctttcttatgtctttcagaccttttctccttttttagctttccacacctttcattctttgcttttcttgaatccctttttattctttttcagattgaacattctttttgtctttttgcttttctttatttttcattgcctttccttttcttcattttctttgtgactttttaccactttgttgccatccttgtctctccccccaaatttatactttttccatgtgctaaaggaaaggttgggtgccaagagagggtatctttttagaacgggtataggcttgtatcatggttcttgaaagaaaaaagtctaagactcaaaagggttgactagggatcttatcattggtaggctatggaattgttcgagatatcatttggatcaaggagagtctataatcatgtctcaagtcaaaatgcacttaggattttgcctcaaaaacatttagggaaagttctagaccaatggctcggtacttggatatgcaattcatttactcaccacacaagctaagggaacattaaagacatagagttaggggcctacaatgaccttagatacgatttgagcaaacaatgatcccgaaaaccacttgataattatcggtcaacgcaagagtctcaaggtcacacctttcaccatcctaaacacaacaatttgtttttgaccataagatcaagggaaaatgtgctaggcccaagtgaagctttgcttgaggcacccttaactactcactactaaaaccagaaagaaaaacagactcaaacccttaagaaggttgtcatgccatccatcactgggaagtgccacccggttcatacaacactccacctttggaaagaaccgtggtattaagaaaaccaaaggcttattggaaatgtccaaaacaaaacaaaaagctacgaacataaataagaagctaagaatgaaaaatttgcggaaaatagaatgaatatatacaagaggggatttaaatatacattagatgggatgaatatgtacaatgaaacgtaactttatatacagaactaaagtaaaataaaagtgtgataaatgtaacgaaatatcagaattatatacagaccaaagatgaaaaatcaagaaagcataaaaatgtatcaaatatatatgtacaatcatccaaaatgtaaaatgtagggcctaagccctcaaatgaaagctggcattgtccccaatgccaactagtctaaataaaacatcaaaaagataagaggaaaaaaggaaaaaggatgtagaagcctccctaagccctgcttgtctgcataggattatgagtggtccctggttcctctgtgtgctcgggaccctcagactggttcccagtggcttgctgctctactactgggacctagacaggctctggacctagtacatcctgtggctgattggaagaggtctcctgtgggtctgccaactggatgactgcatcgagcaataagtccaaaggcagctgatcttccttcaatcggtcaacatcaaccctcaatgctttcacggactccttggaagctcgtgtcttccgcagcttctttgctcccaagcaagctccttgagagccttgctatgtgaatcatatacctttgagagcacaacctgagtgtcaaggatcttcttctgattgtctaaaatctctttcaaagcatcctctatcaactaggaaacctgtagggctggaggtgccgactgagcctctaccgtggtagtctagatggacaacttagatgaggcagtcttcatccagttgttgaaatttagaagtgcctggcttagacggtgggtagtaatatgatgggcccagtaagatgggatctccgggcccgctgatgtggatagaccagcaggaatagctgtggatgtggaaggtccgggagagatgtcagcaggagtagaggtaggctcagcagggacctctaccataactggatctttagactggacaattggggcagaagcatgagctttgtagttcttgctcttggggttgttatcccccttcatgctataccaggaaaatggggctatctccttgaccttgatgtcatagggcctctcatccactttcaggtcccggaagtactcagtcaggaagctggggaatggattgtttctatcatgctcggcacccacaatagtaataatcctcgacatcacattccccatattgatggggtaccccaccataatagaagtgaccaatacagcccgatggagaggaaaggcgttgtcatgagtggtagggtccaaccggctgcaaacaaaagtctctcatcccctcgcttcaaagttcaggctctttctcaatattttgattccagcagccaaccagtcagggacggtacgtgggattgccaagtactgtgctagccatggacaaacctcctctcccatttccaaatttgccatgtataaggtctcgtcctctcattgaagctcaggtattcatttatatacttcccatcaaacaacaccttccaattttgaaccttggtcactttggagccctttttgatgtgggctacattgctgtaaaattctttgaccaagtgttcgttggaatcctcacacttatcaaggaaatggtcccagccaactctcatcctaaactgtctcctcatgttggggttgtgaggtagcaagtcactatcaatgaaactccgctccgggatcaactttctcaccggccaccactcctagaatttatggtatgccacttcactaacaaacctatcttgccaaacctcggctttctagttctcacaatccccccccccccacacttgtggttcacctccttcttctacttcatcgtcaccacctacttcttcctcatctcctacaacaccctcttcagataatgaagctgtgggagtggtagagtattcatccctactacccgctggtgagccctcagacgacctagaagaaatgttcactgatgcttgggctgcggggaaaggggaagagtgtctctatgtctggccctctacggatacgagatgtattctgggattgagtccaaagagatatcccgagatggctcgtactcactccccgaaatgtcaatgtctttgtcagccacttttatggccttccttatgttcttgatgttttgcctagcttggggagtgagtttgaccattttctgtttccctcccagggaggattctcctcggcctggttgtttagagcctttcccttgttgtttcaccattgtctgcatacacaattcagttgaacttgttagaatcaatttcattagttgaaagcagtgtttcaacaagaaagcagaaagttgtagaaaatacctagtgcggaccgcacaaaatggagtgctgccgcacaagggccagtgtggaccgcacaaaatggccatgcgatccgcacatgggtggggttcagaatacccaccctctgtatcttgacagtacagactacacaaaatgtagtgtggccacacaggggctagtgcggaccgcacaaaatgtagtgcggccgcactgcccaatgttcagcttcccagaagttctttagtgtggtccgcacaaaatggtaccgcggaacgcactagggaatcgcagaccgcacaaaacgaccacggtccgcactgagtgcccaggtttggcattgagttagggttcgttggatttttgcttttaagtccaaattttcacctaatgagtgcccccaagtcatttcccagtccattaaactaacaaagtcctcatgaattcaaaatttaactactctagtctaggcaattgaaataaatacgggagggagaagaacagaagctaagaaaaataaaaattaaatgaaattgcaaaattaaacaaggaaagggaagattttgttaccagattatgagatgaagtgaaacgaatcaatgccaagcaagtaattacgatcaaatgcaagggatgaacaatattagtatgctttgagagttaaaattttgaaaagggtaacaagagaccctcaaggtctatttatagagaagccactggggcccagtctcacctactagtgtagactgcacaaaatggaccgcagtccgtactgaactgttttgttcaagtttgataaggcaacactctgcggtccgcacaaaatggactgcggctgcagaggtccaccgcagaccgcacaaaatgtagtgcggccgcggtggcaaactttatagaggcttcattttacccacaccagtgcggtccgcacaaaatgtactgcggccgcactggaaacttcagagacctgtgcatttttttcactatgtcttgcactgcattaacacaaccctgtaacatctcataaccagttagcccaaaaatcaatcctatacttcaaagaaaatcaaagaaagcaagaagaaaagcacttgggttgcctcctaagaagcgcctgatttaacgtcgcggcacgacgcaggttaccatcacatcatttgaaatgaagaagtgccaccacgtggctgtcatcaattttcccaatataatgctttacccgatgcccgttaactctgaaaacttcactatttttatttttcaaatcaagagcaccaaaagaggtcacaaacacaacttcaaacggcccaccccattttgatttaagttttcccgaaaacagacgtaaccgagagttgaacaagagaaccaaattatctactttgaactcctttccacaagcatatttatcatgaaggtacttcatcttgtccttatacaaggatgaaatggagtaggcatggaatctaaattcatcaagttcattgagctgctctacaggaagattggctgcaatatcccattcaagattcaacttcctcaaagcccatatggtcttgtgctctaactcaatcggaagatggcaactttcccaaacaccaaccgatacggagatgtaccaatcagagtcttgaaagctgtcatataagcccatagagcgtcatccaacttcttcgaccaatcggtcctattagcattgaccatctttgacaatatacttttgatttccctgttggagacttccacttgaccacttgcttgaggatgatagcggtaaaaactttatgattgacaccgtacttagaaagcaacgtgttgaaagctctattgcaaaaatgagacccccatcacttatgattgcacgaggagtaccaaacctcgtaaaaatgcttttcttgagaaatgaaacaacactctgggcctcattgttgggtaaagccacgactttaacccactttgaaacatagtccaccaccacaagaatgtaagtgttcccacaagagctaacaaatgggcccatgaaatcaatgccccatacataaaaaatatcaacctctaggatggtattgagagtcatctcatctttcttcgaaattccagccgctctttggcactcgtcgcatcttttcacaaaatcacctgcatctttgaataaggttggccaatagaatcctcaactaagaactttagaggcggtcctcaccccaccatgatggccaccatagggtgaagaatgacaagcctccaagttactcaattgctcttcctccgggacacacctttggatcacaccatccgtgcaaatcttgaaaaagtatggctcatcccaataaaaatccaaactatccctattgagcttcttcctttggttagaagagagctcacacagaattattccggtcacaaggtaattagcaatatcggcaaaccatgacatatcattcattgacatcgcaaggagttgttcgttgggaaatgaatgattgatctcaaggccatcacaaggcctcacctcctcctccaaatgggacaagtggtctgccacttggttctcactacctttccgatccacaatttctagatcaaactctgtaagtagtagcacccgtcgcattaatcttgacttggagtctttcttcgtcgtcaagtacctaagagcgtcatgatcggtgtgcactatgactttggcacccataagatacggccgaaacttttccattgcaaacactatagccaacaactcttcttgataactgtgtagttcttttgagcctcattcatggtcttgcttgcgtagaacaccagatgaaatattttattaaccttttgacccaaaacagccccaactacaatgtcgattgtgtcacacatgagctcgaaaggcaagctccaatttggtgcggtaatgataggagtagtggtcaacataagcttgagaagctcgaatgcttgcatacatccctcattgaacacaaacttagcatccttttctagtagcttgcacaaggggtttaccacattcgaaaaatcttttataaacctccgataaaaccccgcgtgcccaaataaactcctcacccctttgacagaagtggggggaggaagccttgaaataacctctatcttggctttgttaacttcaatcccacgctttgaaattttatggcccagcactatgccctcctctaccatgaagtggcatttttcccaatcaagcacgagattggtgtcttcacatcgggttaatactctatctaattttttcaaatactattcaaagaaattaccaaccacactgaaatcatccatgaagacctccaagatatcttccaccatgtcagtgaaaatagccatcatgcatcgttggaaggtcatcagagcattacacaacccgaacgacatccgagagaaagcgaaggttccatacggataggtaaaaatggtcttctcctagtcctccggggcaattaaaatttgattataccccgagtatccatccaaaaggtaataaaagctctccccgcaagacgatcaaacatttggtcaaggaatggcaataggaaatgatacttttgggtcaccttgtttagcttctggtactccatacataccctccatccggtaactgtccgagtgggaataagttcattgttgtcatttgttaccacagtcataccaccctttttcggtatacattgcaccggagaagtccatgagctatcggaaatggggtacacaacaccagtatctaaccacttgatcacttctttcttcaccacttattgcatttccccattcaatcttttttgatgctccaaggaacgctttgcatcatcctccaagataattttgtgcatacataatgcggggcttattccccgaatgtcagccaaagtccatccaattgcccttttttgcctttgaagcaccgccaaagtggcctcaacctgcatgttagttagacaagaagaaagaataactggtaaagtagaatttgagcccaaaaactcatacctgagatgtggaggtagtggtttcaactccaacaccggtgactcctcaattgatggttttgttggtggagtttttcggttttcaagatccaaagataatttcctaggctcataagaataagagcctatcccatgtaaggcattcacgcactccactctgcttgcattatcattgacatcaagatttaatagcatggcctcaaggggatcctccacgttgatcatagcactggtgtcatccacaatcacagctgtgacaaggtctacaaatgagcacacctcggtgctattgggtttcttcattgatttccaaacatgaaagacgactttttcatctcccacttagaaagtgagctcacccacttcaacatcaaccaatgccttccccgttgtaagaaaggccttcccaagataataggaacctcatagtccaccttacaatccaaaatcacaaagtcggacggcaatatgaatttgtccacccggacaagcacgtcattaataatgcccaaaggtcgcttcatcgatcgaaccgccatttgaagtctcattgaggttggcctagcttgcccgatacccaaagttttgaaaaccgagtagggcatcaaattgatactagctcccaaatcatatagagccttggcaaagtccgcactcccaatggtgcaaggaatggtgaaagcaccgagatcttcaagtttcgaggccattgaatgcactatagcactaacttggtgagtcatctttatagtttcacaatccatagaacgcttctttgtgaccaagtctttcacgaattttgcatagcccgggatttgttcaagagcctccaccaaaggcgcattaatggacaggatcttcatcatgtcaatgaactttttaaactgattatcatttttctgcttcgcaagcctttgaggataaggtggaggtggcctaggcaaaggaaccttggcttttggcacaactaactccggcatgtcaattatgtgtttcctagacgggttcacatcattttgagtttccacctcgacatcgttaacatcaatcctcacttcattgttcacatttttatcaaccacatcttcaactaccaaagggatttcctcttcgtgcaactcaacatcatcatccaaaacttgcttttgcttagaggcattcacatcaccacctctcccacttcttgttgtaaccgccatcacatgattgtttccactcttcgggtttactaccgtatcacttggtagagcacccttcaggcgggtattcaaagactgagagatttgtcccaattgcacctccaagtttcggatagaggtattgtgggatgccaattgtgcatcagaatccacattcttcttcatcatttgttcgaacatcatttcaattctacctaaatcattgctagaagaactaggaccttgagagaggaaagggggtggattgtttggttgttcgtacattgggggcctttgaaatccttgcccccggtttccttggttcccattattccatctaccttgattgttattattgcccccattgttattattaccattccaattcccttggttgccttgattgttgttctgattcccccaattgtcgttttgattattgttcccccaattaccactattttactgttgattgccccaatttccttgaggtatccattgttgttagtttgaagagttgcctcgttgaccttgatagttgtttacatattgaacctcttcactttggtcatcataaccataattttgacacccattatagtcatcaacaaattgctcagaattcccttgattttattgccttttttgtcttctcttggtaacaagcatattgacaccctccatggcattcacctggcaaggattctggacttgttgcaactgatccttagccaattggttcatggtagtcgtcaactccgctatagcttgtccatggtcatgtaatttcttatgcaaatgaataaccgtggggtcaccttgaggcacattggctctactttgccatgcagaagaagtgtcagccatctcatcaagtacatcacatgcctcatcatatgatagcttcacaaagttgcccccgaaaagttggttcactatgcattgatttgttgtattgatgccctagtagaaggtttgttggatcatagcttcggtcatatcactccttcaccatcgttctacaccgctcccaaatctcatgcaaaggttccgtggtctcttgcttgaaagccaatatctcatctcgaagtgccgccatatgcctgggtgaaaagaatttagaaatgaatttatctgccaactcatcccaagttgtgatggaatggttggggagtctctcgagccaatctaatgccttcccccaaagtgaaaatgggaaaagtctcaatctaagcacatcttcggacacattcgtttgcttgctcccccagcatgtatccacgaaccccttgagatgtttgtagtcattttgatccgcagcgcccgtgaagtatccacgctgctcaagtaaggtcaacatcatattggttatctgaaaattgccctcacagattcggggtgggacaatagcacttgcatagccttggttcggtaatactctgggagccactcttggaggtggagaaggagggtctggaatattgccatttggattagcattggcatttcggcctctacattgtccttgaggtacaagaggcacctcatcttgttcaacatcatctacctcctcccccgcaatcacgtttccaagagggtcattagtgttgttcaatgccatattggtacctgagtcgcaacacaaacaagtaagtaacaaagaaggaaagaagaacaatacacaacactaactgaatagatagccaaaaccgttagctccctggcaacggcgccaaaaagtgatcgcgacctactccgcactactaattatgtagcgagagagggtcagagcagcttttacccaattttgggtcgggatcgatatccacagagagctagaattggaattgagtatctatttagcctaggattgcgtagcgttccaaattgcacttctcataatttttacggttttcttttataattctacttttaacaaactacaaactgcaaattaagctaagagttaaatgctatgggttgttcaaatattctaaaagctctagggtagtggcatccacctaagtggtcaattgacgggtacttgaaactaaggctctattgatattattggggagtatgatataaccgttgcactactttacccactatacacctctcgatggttcaagtgattttgcctaattgactttctcaagaccaataggtatgcaaatttgctcaagcaacttagggttcaagtcaggtattactctctcgaggtttaaccctttaattgagactatcaattctcttgagtccatcccaattccttgttggatcaatttcggagacttaggccctctttctaaagaagagcctaagtcaacttagcacaaactagtgtttgcaaccactaattcagtaaataaaccatgaaattgacccaaataacaaacacctatagtcaatctagccctaaagtgaaacacccatcaatttcccacactagggttgagccacaaacctagctaatgggtctagctactcatacttgaagagaaaaatagagaaatagatgaagataaacacatattaattaattgctaagctaaatacaaagattcaatgataaaaagtaagtataaatgcccaaaatggctacaagatttgttcccacgagtgcaataactattctaaaatgtctgatcccctaaaaatggaaaaaggatctatttatattaaactgaaaaatttggacaaaaatgcccctgtggggttagtgcggaccgcacaaaatggtgtgcggctgcactaggctcttgaacttgaaaacttgactctctgaactcaagctctgctgaccgcacagaatggactgcggccccagaggcttctagtgcggtccgcacaaactggaccgcggaccgcccaggcttgaaagctccaacttcaccctctctgaaccttagctctgtagaccacacagaatggtagtgcggccgcattgcctttagtgcggacctcacaaaaccttctacgaccgcactgccttaatgcctgaaataccagctctctgaatttccctagtggggaccgcccaaagtgtagtgtggctgtactaggcctatttttcctgagtttgtcttgtctttggtacttgtgcaagtttcactcctttcgagttgatctttaacatcttgtcactttgttgatcaaaccttcaatcatgcacaacttatgagcctttttggactattttgtgtgaatttataatcaaagcataagcaagaaggagtataaaatgcgtcaaaatccctagttatcacatgcttatatatgcatatatgttattttgaaactatatttatgtattaaaaaaatatatataggaaaaaattgggtatcaacatcgaaaattacaagtttcaagattatctgttgtgatggtcggtacttcaaatcttgtcttcaagtttcagcaagcctacacctcgacaaaccttgaagtagggggcagttgtagacactaaaattttaacagattaagataaatcctaaattcaagacgattcttgaattattaggagtctattagggtacttggtggctactccatccaaaccctaattcatgcctacaaataaggctacatatgttcttcaaagacggtctcaacagttccataaactctcaaaacatgcacgagatcaaatatacgatctctaaaattccataaaattcttggaatattcattaatagatcaaagacatgccaaatatgtcttgctgaaatttctagcaacagtcaagatccaaacggagtgctgctatattcttcttgatcatcaaatacatcaaggagatgcatatcattctactttcgagaaatatgctgctaagaccctcgaatcacatagaataaatcggagggaagaatcaagggataaacagagttgtaacctataatgtttataaataaaattctttttttctttatagttgtttgtgattgcaattttgtttttctctgcataaatttgttgcaaacaacatgtattattttcaatcaagaacaaaaaatataaaaatagtgcaccacctgtagtatatttgcacatcctgttgttacagttgatttccatgttttaatttctttcttccgacgtacgtaccaatattcattaagctagatttaaatttacattaaagaacaaccacaaagattaattaatgaaatttacatgtacggttccaatttattccgatgttaattgtatgggccaaaaattatcttagctgtatttgtcgcgcctcctttttccctcttcgcatcggaaatcggggttatgacatttttgaggtaggacaactcattccttttgggaactggatttgcatttgaagagtcgccacctaatgatttaaggtgcattaggacacctatagggttcattttgaagtttgtttgatgaccagagataggtaatggcttgaaattatcctaaggtgaaggtgttaggcacctctcaggatccactagtgtggttcccggccagacagttttgtgaattttgtacaattagcaaacagacaaatataggctcaaatagtaggggatttaagtttaaacacataagagtttgaaaaacaactgtaacaaggcaaattttgaaaaggagttacattttacaaatacttgagaatgtaaaaagaggggggtgggggatcctaggtttatttataatatggatcacatcaatgcgatacccggtatgacactcatcgaaagagggaatacacgtggtattagtgcaccggtcatcatattcatatctatccttcccacctcgttaaggtatcaaagtgcagattggtctcgacctctattgtatgttattacccgtcccattcctatcagtcccggaggaatttaggactactattcctataagagggaggattttaggctgactcttgagttttaaaggtaaaaagtctaaggcgacatacaaaacacgtagaactgcatattagggaaaacatataaataaataagaggctcatatatacctccgcagacaatgcacataaatagcatgacttaaaaacagttagggtctaaatttaaagtactaagacagggtgtttttgttgaagcagacaaatttattacataactcagataagaagccccaatcatgcctgcctgctagttgtagcagttgttaattaaacaaaggcggattcagtttaatcatcaatacctgaggcttgcctaagtgtgtattggtgatttcctataagcatgatatatattactgattaagaaggcagcagagcagtggttaatttttaaacagacgatttggaccctataggcatcctttctaaaccgcattaatgaaaggaataggttgttcaaactgattctgaacagtacaagtcaaactgattttttactaaactggtctcagatcctatagacatgatctcgattatcgctgattttaattcctaccagcatggtatctaaatattaaatgctgatttgggtcctataggcatgatatctagttgaacgtgaagtgaaacaagcaggatttgatcacagcgaaattcctataggcatgacttttataaaaatattgattttaatcttataggcaatacatctaatttcaaagctgattttaaccttatatgcatgatgtctaagtgtggaagtaaaacatgcagaatttattaaacagatcctataggcatgtcatctatccttctaatagctaaaacatgtataatcaccccatcccttttcactagccagcccctcaatatttgttacaaattattacagaccaaaaatgaatgagttacatcagaaaagtgcgaaaacaaggagttacaaccataggaagcctgattcttgacttcctctctgagttatggaataaactacctcaaaaaccaatgttctcaaagcctttcttagatctggttgtgtcaaagttccctaagggtctcaagggaccccgggtagtgcttacacccaagttgcataaccagacaaagatgagtgcagtgtggaagggccagggcatgcccacaaactagccagagaacacaaacacatagaggggatatgggggtttgggattcctaagtcagcaaatcacataacaagtgactgacagagtacatatataagggaaacattaatttaaaaggggatggagcatattacaacatgctagtaatgtaacttgattgcataaacataagcagaagtaggcaagagtgaaaggaactgagatagctaaagaaacatgttgttgttgatgcttcaaaattagcatggacataccagtagagaaacagagtgcagaaagaaagaaataagcaagattccacagtctagccttgggctttcagctggctaaacaaagcagtagcataagcagcagtaaagaaaagagagaaagttttgagtgtaagtgtgtgttcttgaactcaattgttcgtgtctttgaaagaagagagggtgcagggtatttataatttttgaaaacgagtgaaaagtaaggtaagaagtaaagtcttaacagaaatatggaagcaatcccaatcagaatcaattaacataagtggttccctttaattaagaaatcagttttgggaaaagattgattattgccatataagggagtagtaaaattatgaagtaaataatcaagtctaagtataaaataggcttattttgggaaaggattcagcaaggtaaaacatcacagtaaagggaaaggaatcaattaattttaaacaggtgagtgaaattagggttcataaaagaaaagcctttgcaatcagtcacaagatcaagatcaatcaaaggagaaacatggttctgcatttcagtacataaatagagtgaacagaagcatcagacatgcgaggccaaaaacattggcaaaagagataatacaaacatacagtagtggcaaaaataagctaggattcagtagtaagaaaaagtattcaaagcacagtagtcaagtaggtcaagtagtcacatagaatcaacagtgaagaagaacatagtatcaggtaagagaaatcggaaataagtaagtgagcaaaaacttctaagaaatttagggcttcaacagtagtcgagtttaatagatgaaaagaactcaaatcaaacaagtcgaacaaggaaaagagagtcataaacgaagaacttaagataagcacacatttaagcaaataatttcagaactcggataagactaaaaagaactagggttttaaacatgctgactcaagtagaaggaaagcataaacaggtaacatagcaaaatcatgaaacaacaccaaaatcagagaagagatctttaaaagagaggttaagagaaaccctaatcggaaaaaatgaagagtcattttgaaagaaaagttgaagaaccttcgagaaaacacttaagaaatacatagtaagcacagatctaaaatagatctgaagaaaaatgaaagatcttatagattaaggttttggaaaacgcagaaaaggagagaaagaccttgaaagttaccgatctaaaagtcaaggatctgccttgaaaggccatgaatggccggagaaaggtcatggatggccagagaaaggccatggacagaaatagagcaaggaatggaccagattccctcgaggtctggccatgaaaccatataaacaaacacgcaggagccgcagaaggctaatacacatctcaaatgtccatgagaggccatggattaggcaggggttgaggtggattcgggtgggattagatggcgacggctagggttcatgagggattgtagagagagttgagagaagagggattcaaggacggagtttggtgaagaatgaggtagggtaaggggctttttgggtttaattatggaagggtgaatggtggccgttgatttgagtgatcaacagcctggattcaaaagggtaggtgaggaatccgggttgggttgtttaattaggttagggatcgggttttaatgggaattgggccgaggaaattgggtttaatttggggtcatatttaggctaaaattgaaatgtaactgggctattatttaaatagacaatttttcccttttaaaattataaaaaatagtaaattaattcctgaaaataaattgagagtactaaaatgatttgtaacatataattaacaatttaaaaatacaggcttaattttatgaatataaaacataattgaatcttaaaagggccaatattgcaattatatgcaatttagcttaaaaatagtaaataattttataaaaaatatgcaaaaattaccttagctatatcgtagtataaatataaaagtccaacaaatgaattacaaaaataataattttggtcacaattattggttttttatggataaaagagggaaataaattgatttaaaaacctttaaaaattatgaaaaaataataaaacacttggatatgcttaaatatgcatatatattaaatttgaagttattttgcatattgaaaatatatagggaaaaattggatatcaacagttgccctctttacccgggaaggatgaaagagttgtcgggtaaagatatgatggccaattttgaccaagcgaaacagtttgaagagatttaggacgcaccatggattttgatctacctacatacccctggttttacaagaatcaggtcatatgtagttcaggatccgtcggtggagtatgccgatggagacttttcaagaacggacgcaatatccaggatggggtgagtggacggcttgtgggaatggttaaggttttatatggctgcgggaactggagtgggaccgcttctgccgggatgtccgttgctcgccggtttacctgcaattagaaacaatacaagcgtatatcgcgcataaatttaaacatgatgcaaattcacgtcggaccatgaatgttgtcttcggacgatgaggatgatgtccttagaccatgattccctgggccatgaagcgtacaataaaggactcgccggccatgaaatgatgctctcgggctatgaggatggtgcctccgaaccatggtgcctttgaataatgatatgcaacagattaaaaggggtcctcaggccatgacatggtgttcttaggctatgaagatgatgcctctgaacgattacgcctttggataatttggcgatcttttagcccatgagatgcagtatgaggcaatctttcagcccatgagatgcagtagcatgatgcggacaagacagagcttagtcttgcgaattgaaggacaaagcttagcccgtaagagaaatgaaatagacgatgcttgagatagtgcttagtttcgaagaaaattggaggcagagcttagcctcagaaggtataatgatagccttatgcaaagatgaagaatgcggagagaggtagagcttaacctcggaagacagaatgttaaccttatgtaagaatgcagatggagacatcgtttagtcttggaaggcaggacggtagccttatgcaaaaatgcaaatacagaaagaggtagaacctagctttggaaggcagaatggtagccttatgcaaaaatgcaaatccagagagaggtagagcttaacctcgaaaggcagaatggtagccttatgcaatgcaaatgtagatggagacagcgtttagtctcagaaggcagaatgatagccttatgcaaattggaaggtagaatagtagccttatgcaatgcaaatgcagatggagacaacgcttagtattggaagacaaaaaggtagccttatgcaagaatgtagatggagacaacgtttagtcacagaaggtagaatgatagctttatgcaagaaataataaaataacgaatgacaatagagttttcttagctgatagcagattgtggcattatgattattgggagcattgtgactacggagaattacttgtgtactgatagcaaatgttggcaagtgcaatggttcggagagtcgtactcataggcatatagtatgtttaatgattttgcgattctagtacctgcatccaaagaaaaatcgtgagtttagatgaaccgacgactgctaaacaaaacaatttcaataataaacatgcatgcttttgtaaaaatatgacataagtgtataaatataattttttagatgaaccgatgactgcgacgtagcttgggacattgtaacctctccagctatggaattttgagggtccttctcaaaattctaccttagtttaacaggtttatgtttctgactgttgctcatgtggtgatcggctgaaattacttcagaattttgagggtcctccttaaaattctgccccaacttctaattgtggtgggaaatgaaaattttattgaattgtgaccgaacccatagggttgcctatgtatcccctcttaaacaggaaacaggtcaggtgtagttcaatttacatcatataaggaagcataatgattacacacagtaatgcttgactgcatctgaattgatcgactttggccaaacttcttctccgtccatttctacaacatccatctagatctgatgataaccagcgaagtaatccacaaatgactgtaactcatgcttggtgcaattgtcaatcaggatgtgtatatttggcaaagggaagtcgtcttttggactcgcccagttgagatcccggtagtcgacacaaactctgaccttcccatccttctttggcactggtactatattggctaaccatgtcgggtactctactaccctgagaaccttagctttgacctgcttggtgacttctttcttgattttcggactcgtatcaggtatgaactttttgagcttttgctttaccggtggacacgttggatcggttggaagtttgtgagacataatagacgtactcagaacagtcatgtcatcatacgacctgacgaatatgtccttgtattcctttagaaattctgtgtattcttccttttctaatggcgataggtgaacgttgattcgtgtttccttgacattttctacatctcccaagttaacaatttcggtctcatccaggttggacttaggtctattcttaaagttctcaatttctttgacaatctcatctggtatgtcatcttcctctgaatcattgtccatttgttgcgttgtctcattacatgtcacagttattggttcatcaagataagtaatagtaatgttgtataagtaaagtaatgggagaaaatgataatgagtgttgatttatgagaaaaaatcaaaatgctttgataaattgcataattgttttgaacattgaaggttttattgcgggaattgaaaaatgcgaaaagaaaatcatttaataaataaaacagagaatgatgcttgttttagccttgccaccccgaggctcgttaggttctggttgtcctaatggtccaattattgaggcgtgcctctctgctcatagcttgtatggaagggccttcctccccctcctccttgagaacaacacaatagtccatgtcattgtcttctaggaataagctcttcaccgctgaaagtgcttcttattcgtctgacccataaacaatgtcagcctgttggaaaatcttctctagatccagtattggctgctctagtggatagtaaggactgcgccatggtggcgaccagttgttgaattcttcccaagtgtagtcatatcccaaaccgaaggtagtgccatgcttcttgagttgtatgggcttggtgatttcttggaggttcttgccgagacccttgccaggttcgtacccactccaattcagtatactctcgattttgttatcccaccatttatctttgtcaacaacattttcccgttcaatgtggtggtaagtctctccacttagctttcttcttccttcgattgccggaatggtctggagactgtatatagggttgctactgtcgccgtgaatgatcacctcctagtgtttccattcgaattttactgcctgatgcaatgctgacgctacggccccagcaacatcaatccatggccgccccaatagcagattgtaagatgctggcacgtctatcacctggaaattaacatcgaaccatgttggtcccatttgcaagcataggacaatctcacaaatggtggatctctaggaaccatcgaaggctttcacattgatagctccatcttatatctcgtgtagtcccttacccaacttcttgagtattaccagtggacaaatgttgagactagaacctccatcgatcaggattctggtgataaaatagtctttgcattgcacagtgatgtgcaacgccttgttgttccccaacccttcaggtggcagctcgtcctcatgaaaggtgatcttatggctctccaacacttgtcctaccatgttagccatttccccaccagtgatgttgcttggtacatatgcttcactcagcacctttagcagagcattcttgtgtgcctcagaattttgtagcaaagcaagaatggatatttgcgctggtgttttgttcaactggtcaatggccgagtattctttggcctgtattttcctccaaagatcgtctggacccatctcaattgggcggcctattagaggcctgctttcttaactcagctagatgttcaggggtatagactctaccagttcttgtcataccctgtgctgcaacggtctcttcgaacctgaccttgcctttcctcctcgcctcggctgtataatcccaagatacaacctttgtatggaatggtgtcatggttggcattgctactgggattggcacggctaacctcactccgaatggagcatatgcctcgggtagtaaaactgtaacctcaaatattgtgggtgcattttacggagacacgaattcaacctcaattagtgttggtgtctttgcggatgaagttaattcaaattcaagtggtacagacaagtctacctcagcatcctcagacggttgtatctagactatgattggattgagagtgactgttagcttctttgggtcatcacattctatgatcaacccgatagatccatcgagatcctaatcatcctctatttcaatcatgtggatacctctacccttatggtctggcatagggttgttgtggacatttggagcaggttcctttgccataataatcttgttatcaattaaagactggatcttgtctttcagggaacgacattcatcgatggtgtgccatttcatgccggagtggtatgcacaggatttgtttgggtaacccactcagaagggttctcaggggttgcagcagagatggaggtgacataactagcagctttgaatctctcgtacaattggtcaatgggtttggcaatggctgtatattgttttggaggactgcgatcaaaattaggtcgaggtctagggaagttttggcgtgtaggaggtgattgatagtgggatggtggagcattgtaggtttggtagacatgagcgggttcgaagtatctggttgaagtaggttgatatgtgagaggtagaggtgattgataagttggtggtgagggtgcttggtagtttggagttggctgatatatgagtggaggtgttgggtaagtttgttatttgaggggagattttttcctttgtgcaaccatcacggaccctacgtcccttttcttggatgcaccaccagactgcaaggccttatttgaagtttgcaaggccttgaagtttgtaaccatttcgtttttgataccctcttcaattctttcacccagtttgataatgtcggagaatttgtgactctcgatcatcatcaatcattcataatactgcgggtcttgagtccggacaaagaatttgttcatatgttcctcttctaaggcaggtttgaccttagcagcttcagacctccagcgagtagcatacccgcgaaatgtttctgtaggcttcttctttagattctgaatatagaacacatccgcacattttttgtgttaaacctaaacctgtacataaaatcgaatgtcatgcctacccagattgaccacttctttggatcttggctgatgtaccaggacaacacatctcctttcaaacttctcatgaacaacttcatgcggattctcttgtctttccctactctaaccatcttgtcacagtatgttctcaaatggatccttatatccactgtatcatcaaacattttgaattttggatgtttgtaccccttgggtagttcgacatcgggctatatgcaaagatcttcatagtttagcccctcaattcctttacttcctttaatgccctgaatccggctagtcaatttcttaagttcctcagctaggtttctgatgagcatgtctttttcatcagactcgggtgtgcttgagataggttgggtggagtgcggcatggtctacacgtagataggggtgtgaaaatggtcatttgtggagttttggggttctgggatgagtactggagtattgtttggtgtatggtaggtgttgcattgggtctttggtggaatagtgtgatggtgaggagcgggatgattctgtttctttgggatgttttgaggaggtgtagggttttgagtattgggaaagttgatatttggggtgctgagggaaaatgagaggcttgccagattccgaacctgatctagctcttcttggaatttcaacaacttttgttcaagctgggatacattctccagataaacctaagtaccatggccattagtggcctctacccgttcagttggattctcctttctgacgttgttcaaatcttccatcttgcctttattcttgtttttgacagaactaagaggaggagtgggtggagggcccctggatctcgtggaataggatgatgtttccagagtgcatgaactaacctttggggaggggaataataaaaacaaaaaataaaaacaaaaggtaatcaaattattgaagaatataggaagtattgcaatatttaaacacatagtgcgggaatgtaaagcgcgtcctaatttggggacctctttgtgcccgaggtaggcctagcgacaaatttatttggagaacttaggatgctaaatgcctcattttattgataaaaagtagacgaatcccaaattgataaataaacaggaaataaaagtcactaatggccatgggccttattacatttataaagcaaaaagataaactcctatctacttggtcccagaaagaccttccccagattcagcatccttggctccgtctaacagcttccccaactcgcgaagtcccagcaacaggtatactctggttaggtgtccgccttcggtccctttcgcattttgacaatcttcgtcccttttgagaaactttctctcaactccactatacctcgctccaagtatcctagtcgcttgttggcactgacagccatgtccttccattcctcaatcagcttctggttggactcttgtatctcgcggtgttcgctttcgtactcccggatccttttgcttagttggttgtatttgacctatgcctcagcactttcatctataatcctgtgaccttgagcaaaccctagctggcccagaccatcatgattgtcttccaaccaaccagagtagaaaggagcgcaactagcatgatacctgtctggctcgatggtatctctccccattatgatcttgtagtgccacatatactgatcttggcacttgtaaggactatcatcattcttgaagtcatcccgaaaatgactcatcttgtcgacccttggtataacctgcttcctaccagcttgcctcataactcggagagggacgtaagggtatgttccgctcagactgatcagtatcaggaaaggtgcatctctagatcgagcgatcaactcctcggttgaaaactactcgaacaaccattggacccattcctcagtcagaatatcaaatagctcaacccatcctttggcatcctccgactgagcaaacatattggggatgtaattcattcgctttggatgatggaaagcgatgtgatcatcccagtccctttgctgaatcacttgttggtattctcccctttggagatgttccatgagccatagttgaagtaataaatttctggcttcaaagtgttttgctcctcgttgatagttgtccaaggctcgatatatgtcttcaatgatcatgggcacgatgttgaatggctgcccaccaattccttccattagggtcttagttaccatagccaacctagtatggattcttgctttcttcatcggaaacatgatcagacccaggaaacaaaacatgaagacgaaaaccctacgatgaatgtgccccaaggatgtgatggcgaactcgtcaaggtaggtatggtaggatttgctgtgaccgtacctttctaacaaataatcacaagggatgtagaattccttcagacatgtcaattctagattcttcttcaaacctatcatttttaggaaacccctgcctttacggttctcaagcatcagtagacccggagtttcccatactagaccggccaatcctcctatatcctctagcaagggtgtcatttcaatgtccccaaagtggaatacagcccttgataatcccaaaacagtgtggcagcttctatgatcttgttgttaggttggatctccaaaaggggtggtagatttcctagatattttcggacgagagtttgatcactagagtgatgatctttccaccagattagcagtcttatgtggatgatggtgaccatgctaaatctagggacttcatgcctcatatttctgcaagacagaaaaggttaggcccttacccccaccagacttgactatttaataccaacaattagcatgcatcatttagttctccaaataaatgcacagaacgtgacgatgtccgtttaggcttagggaaacccagtggactttggtcaaggccatcttaaaggatcattatatggataacatagctggcctgactaggtttgaccatgatgcatgcacaatttgaatagagtaatggtttctatggggttttagactagtacccttgagcggacaactcaagggggaaggcacggaaccgtcgactacaccgctaatcgaatggttttatcgcaaatacgcctttacgaatttagggggtaatgatataggaagagcgcaaccactcattataagcgttgctatagtatttgtttggcacgagtggagtatgatgttgaacatgattatgcaataattaaaacatgttggcacatatttgcacgttaaaaaagcgataaatacaacagtttcataatttaaagcagcaataaaggaaagaaacaggaagacatgtcagttttgcagttgaaaaggatattaaatgcttaaagtaattaaacaagtaattgcacataaagaggtacaaattcacaagaacaatccaaaatggtaaaaccctaaaaatccccagcagagtcgccatgctattgcgcccccttttttcctctttgcatcggaaaatcgggtttatgacatttttggggtaggacaactcattccttttgggaactgggtttgcatttgaagggtcgccacctaatgatttaaggtgtattaggacacctatagggtttatttctaagtttgtttgataacatagatagggtaagggcttgaaattatcttaaggggaaggtgttaggcgcccctcaggatccactagtgtggttcctggccagacagttttgtgaattttgtacaattagcaaacagacaaatataggctcaaatagtaggggatttaagtttaaacacataagagtttgaaaaacaactgttaaaaggtgaattttgaaaaggagttacattttacaaatacttgagaatgtaaaaggagggggggtcctaggtttatttattatatggatcacatcaatgcgataccaggtatgacactcatcggaagaggggatacacgtggtattagcgcaccgatcatcatatccacatctacccttcccatccagttaaggtattaaagtgcggattggtctcggcctccccatcccattcctattagtcacggaggaatttagcactactattcctataagagggaggattttaggctgactcttgggttttaaaggtaaaaaggctaaggcgatatacaaaacaagtagaactgcatattagaggaaacatataaacaaataagaggcttatatatacctctgcaaaaatgcacataaatagcatgacttaaacacagttagagtcagaatttaaagtactaaggcacggcattttaattgttgaagtagaccaatttattacataactcagataagaagccccaatcatgcctgcctgctagttgtagcagttgttaattaaacaaaggcggattcagttttatcattaatacctgaggcttgcctaagtgtgtattggtaatgtcctataagcatgatatctattactgattaaaaaggtaatagagcagtggttaatttttaaacaggcgatttggatcctataggcatgctttctaaaccgcattaatgaaaggaataggttgttcaaaatgattttgaacagtatgagtcaaactgattttttactaaactggtctcagatcctatagacatgatctctattatcactgattttaattcctaccagcatggtatctaaatattaatggctgatttgggtcctataggcatggtatctagttgaatgtgaagtgaaacatgcaggatttatttgatcacaacgaaattcctatagtcatgacttttataaaaatattgattttaattttataggcatgacatctaatttcaaagcttattttaaccttgtaggcatgatgtctaagtgtggaagtaaaacatgcaaaatttattaaacagatcctataggcatgttatatacccttctaatagctaaatcatgcataatcaccccatccctttttactagccagccctccaatatttgttacaaattattatagaccaaaaatgcatgagttacatcagaaaagtgcaaaaacaaggagttacaaccataggaagcctgattcttgacttcctctctgagttatggaataaactacctcaaaagccaatgttatcaaagcttttctcagacctgggtttgtcaaagttccctaagggtctcaagggaccccgggcagtgcttacactcaggttgcataaccagacatagatgagtgcagtgtggaagggctagcccttatgtgtccaagttcagagggagctcaaggtttccaagtcaaggctcaaacaagaggggtagaaccaaggttataagattatagtggaagtgcagaacatagttgaaagagatttatttaaaactgggttgggaactagcaagtggtaagggtgatttgaaaatagtagtagtaaagctcaaactgaacagaataagtaattacacaaaggggtcaagggggttttgggaatacattgtatgaagcatatgaccccagaaagggtcaggtttgattcatgcacaacaatagataatgctggcatacccacaaaccagccagagaacacaaacacatacaggggatatggggttttgggattcataagtcatcaaatcacataacaagtgactgacagagtacatacataagggaaacattaatttaaaaggggagggagcatattacaacatgctagtaatgtaacttgattgcataaacataagcagaagtaggcaagagtgaaaggaactaagacaactaaagaaacatgttgttgttgatgcttgaaaattaactaggacataccagtagagaaacaaagtgcagaaagaaagaaataagcaagattctacagtctagccttggactttcatgcggctagacaaagaagtagcacaagtagcagtaaagaaaagagacaatgttttgagtgtaagtgtgtgttcttgggtgaagagtgtttatagtttttgaaaatgagtgaaaagtaaggtaataagtaaagtcttaacacaaacatggaaacaattagatcagaatcaattaacataggtagttccctttaattaaggaatcactatttgacgtgtaatagcaagtttatttaaggaaagaaatcataaaagaaaagcctttgcaatcagtcaaaaggtcaagaccaatcaaaggataaacatggttctacacttaagtatataaatagagtgaatagaagcatcagccatgcgaggccaaatacattggcaaaatagataatacaaacatatagtagtggcaaaaataatctaggattcagtagtaagaaaaaatattcgaagtacagtagtcaagtaggtctagtagtcacataaaatcaacagtgaagaagaacatagtatcaggtaagagaaatcggaaacaagtatgtgagaaaaacttctaagaaatttagggcttcaacagtagtcgagtttaacaaatgaaaagaactcaaatcagacaagtctaacaaggaaaagagagtcataaacgaagaacttaagataagcacacatttaagcaaataatttcagaactcggataagactaaaagaactagggttttgaacatgctgactcaagtagaaggaaagcataaacaggtaacatagcaaaatcatgaaacaacaccaaaatcagagaagagatctttaaaagagaggttaagagaaacccttatcgaaaaaaatgaaaagtcattttgaaagaaaaattgaagaaccttcgagaaaacacttaagaaattcataacagatctaaggtagatctgaagaaaactgaaagatcttaaagattagggtttcaaaaaatccagaaaagctgagaaagaccttgaaagttaccgatctaactaggaaagtcaaggatctaccttgaaaggccatgaatgaccggagaaaggtcatggatggccggagaaaggccataaacagaaattgagcaaggactggaccagattcactcgaggtctaaccatgaaaccacagaaacaaacacctaggagccacaggaggctaatacacatctcaaatggccatgagaggctattgattcggcaggggttgaagtggattagggtgggattagatggcggcggctagggttcatgagggattgcagagagagttgagagaagaaggattcaagggcagcgtttggtgaagaatgaggtagggtaaggggtcttttggatttaattatggaagggcgaatggtggcagttgatctgagtgatcaacggcctggattcaaaatggtaggtgggggaatccgggttgggttttttaattgggttaggggtcgggtttgaatgggaattggtccggagaaattgggtttaatttggggtcagatataggctaaaattgaaatgtaactcggctattattgaaatagccaattttccacttttaaaattataaaaaatagtaaattaatttctgaaaataaattgagagcactaaaatgatttataacatataattaacaatttaaaaatacagggcttaattttatgaatataaaacacaattgaatcttaaaagggccaatattgcaattatatgcaatttagcttaaaaatactaaataaatttgtaaaacaatatgcaaaagttaccttagctatatcatagtataaatataaaattccaacaaatgaattaccaaaataatattttggaaacaattattagtttttttatggataaaagagggaaataaattgatttaaaaacctttaaaaattatgaaaaaataataaaacacttggatatgcttacatatgcatatatatgtcattttgaagttatttttcatattgaaaatatataggaaaaaattgaatgtcaacagtatttagaccacgtcagtataaatagggccttcgagggctgccacgtattaccaatgtaactttaagaaaaaacagattcaaggtcgaagtcatatgacaagagatgaagggctagatcgaggggttaacagagatcaaggtcgaggacaaacactctccttaaacagagtaataatggctagttttaggataagactttaaaaagaatatttcacagaatattttctggatctgtactattagggttttgtggcacatgtacccttataaatagaaagagacatagttataggggataatgaacacccatttgtaaaacaacaacactttgatattctttgagattttttctttattacatatatataaaagatacctttttcttgagatccctgcctagattttttcccacgatccaaggaaaatatgaatattcaaaggcttatcaatcatttatcattgtcggaaggaatattagacagcttcattccctttttcggtcacctctgtcacatatatttacataaataccattatacatcatttattgctactgaatgttattcacttcatatttgtgccattaagtgttgttcattattatatatttatcactgttaccacatatcttgtaacattttatcacgacactagttaaacattctaagggatattattattggctaacattaaccccaccttgttaaaaaatctaattgtttaaacttgatctaaattttggtcaaaacgtttggcgtcgtctgtggggatttcttagctaatcttttagtttctattaagtctaaaactcaagtgactttctaacctaagaggccacaaattttttctcctctctgcatgcacaaacatttccctggaaagtaaccaaggaaaagggactagggcgacatgggacataccagtaacctcatgagctccatcaacgagagctatgaaatacagtgcgaggatatgacgcccactgcctcccctaggcgtgagaagtcatctccccttattgcaacacaatgaggctaaacagaaaaggatcttccatgtatacgggagaaaggaagccacctgcaatgaaaaaacccctcgaagcatgactaactgataccctagtaagcgtgctcaaaaaacaagctccatgcacgaccatagaaatcacaagagcccacatggtacaacgaggggacgaacatggcgatcaaccagaccctccaactctaggtataacacacaatgttactgacagtgcagatgacaacgtcctcgccgctattttgaaaagaatggaagaaatggagaatgaaaataagacgctcacagaccaaatgaaggaacatggggagcgagtagacaagatatcgggtgcccctaagttaccgccaaaaagggacgtcggtaggtttgtagagtagccatagcgaggaagaggccctacatgccataccaaataccttcaaaatgccactgtatctctaatatacgataggacaaccgacctcgaaaaccatgtgactcattacgtcaccgccataaagggcaacgacctcaccaaggaacaagtgtcctccactttgttgaagaaattcagtgaaaccctccctagaggggtattaacatggtattcacggctaccagcctgctccataaaaacgttcgaaaaaatggctgacaagtttgtgatggcacatgttggggccaagaaaatcgaaacgagagtaaacaacatcttctccatcaagcaatccttaggagagggactgagggacttccttacccgattcaacagggtaaggatgaccttaccaaatgtatccgaagggattatagtcacagcctttaagaatgggttgagtagatagggttcaagagcgacaagatagctgctgagccaattgatgaagtatcctccaacgacttgggatgaaatccataatacctattgtgctgtagtccgagcatatgatgacgacatcaatggaccaactcgatgactcatcttgatacaaactgaacctaggaaagaataaagagataacatgaggagggattttccaagcaccgcgtccggcgaacgttggaaatcagacctgccttcggggctgcgggagatgatatcctccaccgagggaaaagtttcattctttatggtggtagctgcattctccccttgattagggaacacaaccaccaacggaacaatgtggctcccttcatcaacatcagatgatacatttgacatctttatgagaaagtaaagacggatactggaaagagagtttaggatgcgaaagaaggaaacaatgcataaaatagaggttccaaaaggatgttttaagtctcaaagtttggaagaataaaagattcaaattcaggtttggccatccctacatatagagattgaggcaccgattccgaaatggttgtcataatgggcaccaaatctgaaatggctcatcataattgacaccggaactaaaaccacagatccaatcaaagtgctagcttgagtaagtttgttttgatgattgacaaaggaacacatgcatgaatcaggtccaaggacagtgtacacatgtgatggattaaataaagcaaaaggcttgcacttgaaagagataagtataagtggttatatctaatattccttgaacgaaaaggttgcatatttgataaggagcaggactccttacttgaagagaactctatccaagataagagaagaattataagttgaagttgactagaactcttttaccaaggaagagtaaagtattagaactctagttaatctttatttactaattctataaatattagtgttgttttcttttacaggtgatacacacatacttaagtaaaaagcacaaattgagagcaaaatagcaaggcattttgtgagcaattcctgtgagatttatgagtgcgatcttgatgttacacgaaccagattgaagaaccagctccataaagagttttatgtgtctttctttatttctagttcaaagtgtagtaggcgttttaagttatacctttcagttttctaagaagcaaattatactaggtacctgagttgtatctttcaagttagagttaatttgaagtagtcgcaacagcctgtggctggttgctataagggttagagttaatccttaggtttgcaagagtttgtaaactttgtggttggctcagagttgtggtgaagtgtttggagaaaatcctactgggtagtaaatcgtggttattactccccgcagtattatgtcgatattaggacctgtaatattatatgaagacgatgttacaccctttagtattatacatgaaattatcataagataattgacctcagtttaaggacaagattctttggtgattataagcattaagctatttcaaacaagtgatggataaatttgtgaagatgagagggcaagcaaatcgaagaaaataaattttcgtcaaagtttgatattttggaataaaatacgggccgagctaaaataaccggtacttatggattaataccatctaagttaccatatgaccgtgatagtaaggtgcataaggtgtgttaaaagtgagtatcaatctaagtaatttgagataaatcttaattatgtggattattggttaatggggagaatttgcaagttaattaaaattagtgggtaattaattattaatcttgggataagacttagacccctcccccccccccaacttggtaagccttctttatctatctaatgactattactgaaggtggaaaggtgtcacactttgagaaaggaaagtgacaccaagcttggaatgtggggcctacccaaaaattaaagataacattcataattgaacaatattttctaatctcttaagaagaattttagccaaactttccattacataacgttaattctaaatatcttgagaaagagtttcaacaaaaataattttgcaatagcaacgttttggctttgagcatttcatacggattgtttcctattttgatctcgccattacgtgtttctttacaatcaacgtgtgttggaggaattgtcaatagaatcagataaggtatgttaaagctaagcccttccttcattttgacatgatctcattattacatatggttgataaagaggcataaagagaagttcatgctcccgaatttatatacattatcctagtctcataagttacagtattctaccttattgggacttcatattctattgagtattgtctttttccagtcaagagagtagagagcctatagatacagtattacagtattttcattatcgttgagttataatgtcacgatcccagttctccctccgtgaactatcgtgacggcacctagtctctatgactaggtaagcctaacaaatgtagaaaagaaacaattgtggaaagaaaataattaaaaaccgagataacaaagtgaaacagtgtttaaggtgccgttcggcatataacagtacaagaatctcaacctaacactcccaaaatctagaaccccatgaatcacaagctaagagattacataaaaagctctaagtccagaaatgtctatcaacaaggaaaatacagaagggctatactagtactgagaatagaaagggactcttcggtctgcggacacagcagatataccttggagtgtctacaacagcacctcgcctaaagtgtgataagactgagtggaaatacctggatctgcacatgaaaaacatgcgcagaaagggcatgcgtacaccataacggtactcagtaagtgccaagcctaacctcgatcgggtagtgacgaggaaagtcaaggccctattgagattaaatgaaatataaggtatgacagtatagaataagacagtaaaaattaagtgcaacagtaagaaataacataaaatagaaagaacaacaacaactataacagagacaaaataatcacgaaaaagagtacaactcaacacagagataacatccagggatctctcagtatcccgaggatctcttagtatcttcaatatgtgtgccagggatctcttagtatcccgaggatctttgagtatcctcaatatgtatgttggggatctctcggtatcccaaggatctcttagtatcctcaatatgtattggggatctcttggtatcccgcactacagtccaaatcgatatatatgtgtaggggatctcccgggataccgtcctgtagtcctaaagtaaacacgcagtaacaacacgaagaatactcaattaaattcaatttcacaccaaggtaacaagtatttctaacataacatgcttcacatagtccaaataaggcagtttgagaaaataaaaacaattaaggcaattagacatgattctctaagctaacagcatgcttgattgcaagtagaataaacaagaagggaaaacacaattaaagttacttagtgaaaacaagattttcaacgattagcacaagtacgcactcttcacctcacgtgcaaggaatttcaaatatcaataataccaaatattaaggggagttccccccccccccacaaagttaggcaagccacttacctcgaacaagctcaaaatcaacccgaaaccaggttcttgccacaagtacttgactccaaatggcccaaatctattcaattcaattgcataatataaataagacttcaaataactgattttataaacaaattctaagctaatatgcaaaattagataaaatgaccaaaacgccccctcgggctcacatctcggaatcggataaaaattttattttcagaatcctcatactctcacgagtctaaccataccaaaacttgaaatttatgtctaagaactttctccaaattttcccccaattttcatcccaaatccgaaattaaatgacaaatctaagattagattataggaatacaactagaaagggattaggaatcgttacccacttatttcttcttcaaaatcctctgaaaatcgccatctcccaagatccaaatcggtgtcccaacttttgaaactaaacccttgaaattcttattttctgcctagtaaatccgcatgtgtagtcaaaattcccgcttctgcgctaccgcttctacgattgagggaactgcttctgctgttttcactaaaacctccatctccgcacttgcgacccatattccgtatctgcggtcccgcaggtatggtaacccttccgcttctgcggtatctgctgccttcacttgtggccacatctgcgtctctatgctctcttcttcgagtccacacctgcggtcccctagtcgcaggtgcggttatgacagcaatggaaaaacttcagctgccaaaccaaactaaaaaaccccccgttaaccatctgaaaccaccccgaggcccccgggacttcaaccaaaagcacgaacaagttatataccactatccaaacttatacaaaacttcaaaacacctcaaacaacatcgaatcaaccaattaaccatagattcaagcctaagaacttcagaaactctcaatttatgcttttgatcaaaaactctatcaaacctcgtccgaatgacctgaaattctacacacacgtcacatccaacactatggagctactccaacttccgaaatttcattccgaccatgatatcaaaatctcactatcaaaccgaaaacttcaaaaattcaacattcggcatttcaagcctaatgaggctacggacctccaaaacataatccgaacacgcccctaagtcctaaatcactcaacggagctaacggaaccaatgaaattctattctgaggccgtctacacactgatctgactacgatctaatttctagaacttaaactctcatttagggattaagtgtcctaaaaatacttcgaaactcaaaaccaaacatcccgacaaataaaaatagatgaaaacacggtgaaagcagttaatatgggagcgggcgttaattctcaatacgactagccgggttattacatataatcggtggacagacctctattgggcaacctctaatcagatggtaagttatataccgatcctactgcggctgagcggctatgagcgagcctagttggccgagatacagatcctagtatggttgagcacctatgagcgagcctactacggcagagcagctatatatatgccaaaccttataaggtcggatagctattttacttactatattgagagagttgagccagtatcagcaggtgagcatatcttcagattatctttgactcccagttactttaagttattatattatcaattcagtttcagctttcataatattgccttacatactcggtacattatttcgtactgacgtcccttttttgggagcactgcatttcatgcgtgcaggttcaaacagacagagaggtagacatccccattaggtgttgcccaagtttaacttgatcggtaagctccatgccctttagagttgtcgggtctagagctttacgtacatcttgtgtatatatgtatatatgttatgagtagctcggggccctattatgatcatagtatatccatcagtagaggcctgtacatatatcctgtcagttagtgtggtatattgggcttgtaggccttgtatgtatattttgattggttttccagctgtagtagttatgatagttttgtcggcccaacattatgttgatgtttagttagcatttgcaaattgtcttgcaatgtggcccatggccaaagtatgacattatatgttcaaagtcccttagtcgcaagtttgtacacaaggataggtgaggcacctcgccccccaggttcggggtgtgaccgaagtggtatcaaagcagttctgtcctatggagtctacaagccatgtctagtagagtcttgtgtttgtttgtgtaggtccactgaactatacagtacctggtcctctacaagattctgctgagaatgctaataaaatagtatgtaaatgaggtagaggatttttacgtgaaaaaatcccacacatggagatcaaaaaaactacgacttacacatgtaggcttttaacttcactaacttgtaatctacctattataagccactttacaataattcctgttgtaaaggatttactcaaataacttgtggtactcttaccacaaatcactttgtgacttcctagtaacaaagtctttttctaacttgtgatgctctcaccacaagccactttgtaactctacaattacaatgacttttccttataactaaatctagtcacaacataaactcaaggagtttatggattttcaagaggattcctaatcaaatgcttctaggtaagcagtttaggagataaaataagtatagtaacaaggttacaactcaactaggacaacaacaagctatcttttaggaaatggtccgtagttgcgttcaaccttattcttcaagcttgtaaggattgatttctctatttttgcaagaggcttgaatgagaaacagaaaccttccagtgttgttttgtataaacctcattgtgggtacatcttgatcacatcacttgaaatgatgtgagtactttgttttgttagagaatgagtgggaggacagtgcagtacggcagaaacagtgacgccagtcacttcatttctagttgtgtccaattgactctgtacagctatgacgaaaccacaagagcatcaggtccttgtgtgggtttctagctcctgaagctgtagcagttcacctttagctggaatacgttaaagcttgcagcaatccaagtaggtcaggttccctatctagttcttaacagtaagtttgttagattatcaaaacataaggcaagagtatttaaaatatatcaatttcccctttttgatgatgacaaacttaacatttataaactggaattagggcagtaccagttttaaagtatcagggaacacagagagttccccctaagactatgccttatcttttacatgatcagagtagtaagaactagttcctccatgtgtgttccccctgattattatttttttccttcttttggcatcattaaaaaaataacagcacaaagaagtccagtgaagctaactcatgccacatatgtgcacacaatcatgatagagaatagaacacatagagtactgacataataaaactagaattaatattaataacgatttaatatacctctgcctatgaaaaaggctagaggcaacatttggacttgctaacgggagtagtaatgtttcctcccaaccatcaaaaaaagaaaacaaaaaaacatccgccaaaccatcaacaatgaaacaaaaacataagaaacatatccagaaaactggtcactaaaggggtactttagggcactaggagtaaaaggattggtagcagcagaaaatgcctggagaacgaggtctattaaggtgtttgccgacttttgctcgttgagcagttccgccttcaagttctcaacttgcgccctgagattagcattctcctgtgtcaaacaagccacttcatcattcgacatgggaaccccttgggcttgctgatcttccaggataacattcatggccttcaaccgatgaatttcctcagctgcactgttttggacgttgataagctgagaaacggttgatgtatttcctactcctcccccccaatacttttccacacactcacactcttccaaagttgtctatgagaatgtccgctttcgagaccccactttacctattcccagtggaactttaaagaatttgaacactggagtaagaaagaatccatagggaagtccatgattaccgtccttgaaggtggaaaccttttgcatgtgttcgatcataatagcaggaagaatcataggattgaaaccgtcaagttgctccattaggaataggtcagacttagaagtcactaacctcctttcggctcgaggcaacatgactttgttaaccaatttaaataacaactggtaaacagggagtagtgctttcttatggatctagtcccctttctgattagcattttctttcaccattgcatttctgaagttatactgacaaacatctcgtacactcaacaccctaactgtaggaacttttaaaatctctccaagcaattttacatcaaacacgatgtccaccccattgaccaaagcatagacatggtcagtatcaactggaaagaggctagcaaagaaactttgtacctcctcctcatacaccttaggtgcatccatgtgaaatagatgcacccaacgttgaaactcgaccatttccagaatttggcgcattccagccatatcagagattgttgggtcaaacatacgacccaatagaactttttgatgcctcaaaagctcagagccaaggctgacttcacttctcattttcttcatagaactaggttcgtcaaaagattccgacttgcgtttcccaaacttctctccactgactttgccttttgccttagacttaactagtacatcctcatcagacatagaaaactcactcactacctccttctttttggacttagatgttgaccctttctctattgacacaggctttgtctttttcaaagatcgcctaacaagtgaaccgggttcctctggagttccctcttccacctcgactacaaggatagcctcatcacttacaggtacaccatccttcaccaacttttttctttttttttcttactactcttcttgctcgtttggagagtagagtcgtaggccactttgacttgaagcgtggtagtaggtcgtttgatttcagactcaagggtggacgcaacccttcgcttacttatgaatgcatcaagagccacattatccaggtcttattcatcactagatcgtatttcaggtgcttgaattcccaggggcacaacatcaaatgcaggaatagtactgtcctagggatgagagccctaacctgggtcctccggagagggatcaggttcctcatgtgatgccccagtagtatctgctattgcatacccttcaatagccacaatggccccttattcctccacatcgtgtatctcatttttttgggatgtaatttcatgcaataccccatcagtggatactacaaacatagttacaacatctttcttttcttcaaccggtgcttccaaaaccatgaaatcggtggcaacgatttcagaacccttgtgaactcagtattttgaccttgttctccacttagggtttgattggtgggaacaacagacgatggggagaacaaaatagtagttttaaaggtttctgagttgggaagatattgggaaattggggaaggtgtgactgcagcagcaagagtggtagagggtgaggaaggctcagtcaaaatgaaaggttccatatatgggtcagtggtgtagaacctgctcatctccatagaggcaaagagatcggaagttttttcagccattgaaagaagtggtgttaggatccttcccttttgggtgattctagtgtaggacttatggttaagaagagcagaagagaggggttttaaaaggagaggataattataaagggaaaggaataagcacttgttctgaaacggtggttgggcatggagaattgcaatgtttcagagggagatggaacattttgaattgaaaggacgtgacagcaagatctaaaaagttgatgacatggcagttgtattttgtacccttagacgtgtattaaaaggatgcatagaactactaacctttagtacaagaacctagttcttgaaaaaaaattcttctctttttttttgttttgaaagaaatcaatcctctttcatcaatcttgcattgcatctatttcctctatgctcatcatgtgtgtttacctgcaacggtattgaagtgagttagacatggccagaaaacactttgagccagttatttcttaaggataggtgccaaccaaagaggaaacaggttcttaatttggcttcaacagtcccagctttactatgtttctttcaaactgttccctacttagtgccttggtgaaaatgtctacaatttgatcttttgtgctacataacttcatacatatcaaccctttctccacgttatctctcagaaaatgatgcctcacatcaatatgttttgtccttttatgttgaactagattcttggccatatcgagtgcactggtgttgtcacatagaaggggcacactctcagtgagtaccccaaaatcctccagttgctttttgatccatagaagttgagcacaacaggatgctgtagctacatattcagcttcagctgttgacagagccactgaattctacttccttgttccccaagagataagacatgaacctaagaagtgagccattccagaagtgctttttctgtccacaagataacctgcatagtttgcatcacaagataacctctatacattgtttgattcagaggagatccagtttcatccatgtctagtcgagtggcagttgcaatgggagtgtctatcacctttgatgcttccatgttaaacctctttaagagttccctgatgtatttttgctgacaaatagaagtaccgtttggggactgttttactcgaagacccaagaagaggtttaattctcccatcatgctcatttcaaattcacttcccataagttttgcaaattcttcacatagagagtcagttgttgctccaaaaatgatatcatcaacataaacctgaacgatgagcaggttccttcctcgtttttttaagaaaatagtgttgtcaatttttcctcttttaaaaccattttctaagaggaactttgacagtctttcataccaagctcgaggagcctgctttagcccatacaaagctttgtccagtttgaacacatattcagggtgctcgtgacattcaaaccctaagggttgcttcacatagacttcatccttaaggagttcattcaaaaatgcactcttgatatctatttggaacaaggtgaatattgtatgagatgcaaaagcgattagaattctgataaatcccatgcgagccactggagaaaacgttttatcatattcaaccccttcctcttgattgtagccttggactactagcctggccttgttccttgtggtaactccatgttcatcgagcttgtttctgaatacccacctggttcctataatggtttgatctggggttctaggtaccaggtgctacacattgtttctctcaaactaatgcaactcgtcttgcatggctgtaatccaatctgcatctttcaaggtttccttgatatttttgggttctatctgggagagaaaggctgagaaggcaagtaaattttggctcttgatctggtttgtactccagaatctagaggagtgatgatgttatctatagggtgagagctttggtgtctccagttagacgcccaaggttcattctgagaggaggaaggtatgtttggctgattttcctctatccttctctcagatgctagaggagttccctaaactgcatcaaccacccttttttcagcttcagtggttgtaattgaagtgcttggttctgcttatgatgaggcagcgttgtcttcatttggctcctttacttgactcatcatatctactttttcgtttgtcatgttaatgccttcaccaggaacaagtaagggttctccatcttgatctttctcagcactckcactcttctcaaatgatggatatgattcatcaaaaataacatggatactttcctcaacacattgagtccgcttgttatatattttgtaagccttgctttgagaggagtaaccaagaaatattccttcgtcacttttggcatcgaatttaccaagatgatattttccattgttgagaacataacatttgcatccaaatgttcttaggtgaatcagcttgggttttcttccattcaacaattcatatggggtcttgtttagaagtgatctgatcacgcacctattcactaagtagcaggcagtgttgacagcttcagcctagaagttctttgcaattccactgtcaaatcagcattgttcttgccattttttctagagttatgttctttctttatactactccattttgctggagagttttgggagctgagaagttgtgagtgatgccattttcattacagaattcatcaaatttgacattgtcaaattctgtcccatgatctgatctaatgcatacaactctagactccatcttcacttggattttcttcacaaaagctacaaacacttcaataatttcgtcttttgttctgagaaacagagtccatgtgaatctggaatagtcattcatgattacaaaaatgtatctttgtcctcctctgctttgcagcctcataggtccacacagatccatatgtagaagctcaagcggctttgaggtgctcacatctcttatagacttaaaggatgacttcacatgttttcctctagcacagacatcacagactttctgcatcttaattagtgacaaaggcagaccacaaaccaggtccttctgaattagtttattcagaaaggaaaagcttgcatggcctagtcttatgtgccatagttcatcatcatcatcaacaactttcagacaactcagatcaccactctataaatattcaaagttagcaacatagatgttcttgtatcttttggccaccagtactatttcatcgatcacaaggtcagtgactgtacatattttggacaagaattccatcttgtttcctttatcacagatttgtgaaacactcaggagaccatacttaagtccattgacatagtacacattttcaataggatgagtgagtgacgtcccaactttttcaactccaagaatgtaccctttttaccattgccaaaggatacactccctcattgtagggattttagtgaaagaaagtttgtggtattcctagtcatgtgtttcgaacacccactatccatgaactattgacggccgcctcctttcaccgttccctgcataagagattaggagttagttttaggaacccaaacaagcttgggtcccttgtagtaagcaagaggatgaataagagctctcttagtccatgcagttaatgtgtgtttttttgtaagtggaacctggtccctcttttatggtcacggtttcaacagccactttgtctttctgaactgattgattcttggcctggacacctttcttgaagcgcccagtgttcccacattgggtacgaggctagttatcagagatagtgacatacttactgtgagggttgtgacgcattttctccctttggaaccctgcattcagccttttttcacaatcattattaagtaaggcagtggtagcttctaaggaccgggttcactttaaagacttttcaagatcattcattactctttctagattggtttggagaagctcatttttctcaatttcagcacacatcctaaatcttatagctttcacctcatcttcaagcttaatgtattcctcacttgctatctcctttcctctttcagaactttcaagttttgacttagtccatggttttactattgtttccctttggtatgcaatttttgccaacatatcactcttttcttttctaaggatttcaatggttttcttatggtcagtaactgcagccactaagtcttctatactatgttaagattcttctaattctaagatcaaagaatccctatcctccgcaagactacaaaaggcagtgattaaaacaacacctaaacacatgcgtttttttagagaatagaatttcagatttctcttaacatccctgaagtttacctctttgttgccattgtcttcatcatcatctgattgagccatcaaagcaaaagttgagtcatatccaatctcctcgccttcaactaccatcatggaactaccaccagtattaggtttatcttcagactgttttacttgtgtagttccctcatgagttgtttgcaaagcttcccatatttcttttgcagtgtcactggtagagattctattgtactcttcaggtcccattccatatactagaattttcttggcacaaaaattcttctccaccgctttcttgtctgcttcagtgtattctttgctggtttttgccattgaaaatggaaattcatctagtaacttgattggaacttaaggaccgccgcaaattatatcccatagctcacaatcctcagtcataatgaaatcatgcattctagctttccaccaccaataacattgtccattaaactttgggggtttgtatatggaatgaccttcttcaaaatttggtggagttgccatgaggatccttcctaggtgttagcctaatatgaggaacctgctctgataccaattgttagtttgtatgggtccaccaaactatagagtacctggccctctacaagattctactgagaatgctaacaaaacagtatgtaaatgaggcagagtatttttacgtggaaaaatcccacacaaggggataaaaaaactacgacctatacatgtaggcttttaacttcactaacttgtaatctacctattacaagccactttacaataattcctattgcaaaggatttactcaactaacttgtggtactcttaccacaagccactttgtgacttcctagttacaaaggctttttctaacttgtgatgctctcaccataagccactttgtaactctacaattacaaagacttttccttatggctaaatctaatcacaacataaatttaaggagtttacggattttcaagaggattcctaatcaaacgcttctaggtaagtagtttaggagatacaataagtataataacaaggttacaactcaacaaggacaacaacaggctatcttttaggaactggtccatagttgcgttcaaccttgttcttcaagcttgtgagtattgatttctctatttttgcaagaggcttgaataagaaacagaaaccttccaatgatgttttgtataaagctcattgtgggtacatcttgattacatcacttgaaatgatgtgagtactttgtttggttagagaatgagtgggaggacagtgtagtgtggcaaaaatagtgtcgtcagtcacttcatttccagctatgtccaattgactctgtactgctatgaggaaaccacaagagcatcaggtccttgtgtgggttcctagctcctcaagctgtagcagttcacctctagctggagtctattaaagcttgcagcagtctaagtaggtcaggttccctatctagttcttaacagtaagtttgttagatcatcaaaacataaggcaagaatatttaaaatctatcatcttgtttatgggtgtgttgttcaccacacttataagcaggaggcgacgcatttaggactgtcactctttcttcttactctagatcatgttgtagagcttatttgtaagaattcaaactattaaactctattttattcataataaaacgatacctacatctaaaaatattgttggtaagagatatgtctatggaagagttgcgccagtagaccttgactttgtatcatgtttatgataagtaaatgtgaggtcttcagcagatcatgtgtatactgaaaggtgtaagcttcttgataatgatccctaaggaaagaacatctatccactcttatggtaaaaagcaatgaaagaatcagaagatacaagtttcaacaaataaaagaagcaacgtgaacaagggtacaaggtacctaattagtaaagatgagcattatctacaatttaggaagagaaatataagcatttagagtcaccttcaacaataacaaaggtatgtacaattggccacactcatcttatttatgccctatgagggctaacaaaagaagtataagagagggaaggatattaggattcgactagggttagagcaacccaaaatggtggatagaatgtttgtgtttattcacatttttgaaggatattgcaaatgtgctaatagatctccttgtgagatacctaggtggtgtactctaaaatagtgaagctagatttgtgtactataaagataggcactggaagccttgaagggataaatattaccttagcatggctcccgtccctagtagataaagaatgttacgtaactcgaagagtcagtggatggagcaaggggagctaaaagcaaatgaatatcttgttgaagtatttaaaataaagtgatagacataaatgttagcgggaaataagaagagagataatgaagcattatgagtaagaagtgatacatggatgacaacggtagagtattactgaatctatggtcaaaggaaggaaaagacgaaaggtgacagaccttgatgcaacaaaagagtataagtcataaagtcacatcctcatttcgagaaataaattcgtgaccctaacgtgaataccagaaggaaaagttagaccccaaagtagcagaaatcagtatggattggtgaacaagctaaaataaacatgaattagggactgagtggtttgataatgttcaacatcatgagaatttcatattgcgttctggcgataatagaatggacaacaaacatagattcatgagaaatttagggaatgttcattcaggaagacgcttccttaaagcaagaaatgtgagaaaagttaagcttaagggactgtatgtgccagttacactaagtgtcaccctcgtgaataaggaatttcgttatccttggtacagaaaggatttttgcaagacgagtaagggtcatcgatgatgtgaaaagaagccaaagataaagaggtaaagcatctatacgtagatcttcgtagcactcaacttagcaccttcgtaaagggggaatatggagtaatgtgacattaagtcagaattaagtggttctagtaattatagaatggtaaagaagaatacgacaaaaaaagagggatgagattgcacttattcaaatgctatagataagctacgattctagaacattatgcaaacacgaaatcaaggaggggaagtgagggttcctgcctgagatgttattgacaaataaggagccagtacgagacttaagttaagaaaaaggaaataacccaagaaagattacgcgggatgttaatatgagagtgggctaatgattagtttgtagttgattcaggaagagcctagttatggctagaaaagaggacacagactaatcaataggtagtgcaagataaacatagtaaaccccaacatgcggaattcagtctcgtagatatgacatcatgatccttgagaaatattcagataggagttggggcagttaaaggtaccatatgagtgttactgaaataaaagagaatgccactgggaagacagtcaaaatattagttcagaagcaaccctacaagtacaagggcgtgaaggtaagtaactaaggataattataggtgagtacgaacataaaaaattctgtcgggtaaacgatataaccagcttgtaactttacaagagccaaaaggtccccctaagtactacaatgaaaaactagctgaggaaataaggaagaaggcttcaacctaagaacattgacctaaagagaaaatggtcatgtaacaacagtctcacaactacattatatgcacttcataataaaatggcacctaccgtgggtaatgaacgggaagtaaaattagaagtgatattcaagaccatatgagttttatggaatttcagtatatgtgggaactaagataagctaaatatgcacgcaaaaaggggacagaaagaccattaaaagaatttgcttacgtttgaagaaagctgagatggaacaaaaagaattattcgattaatgctccagagttagttacgttatgaacgcatttaagagttcggagtattatccacttagcatatatgttgacaatcatacagtcgtagaagattttggtataagttaaaagaaaggattgagtccaggtcatcgacaaaggatttaattgttagaagattgtatcctggatcttacatagcgtccatgagaggctaaactaataccatgagccgcagatcgaaagatagcttaagcctgcataaaggatgatcacatggaagaggaaactaaagaattatatcaactaagtaaatcaggagcctgattattggacctagaaagttattgacatcatgatggagaacattgcataatcactcttaatatcagaggtacaagagagatagtataatatctatattctataatggctctacgataaagctagttagaagagtacaagccttataagatgtcagtatgaagctcccaccgtattatgtatgcaccaaaggtgcaagtgttataatgagagattcaagttgtggatgtgaattgtacctatatggaaaggaggtcatgaaagagatagaagatatgatgcgagattttaaggcaaaagtaaacaacgtatgagatactcaaatgcagaaggttgtgaatagtccatactgtagatagaaggctagaagcgctggtatttagtacccaggaatgatagagtcgtcgttagtggcatatattccgtcttatggtttctagatatcgagaggtctagttaagggtgtaaaagaagagttatagacgatgtgatatctagcttgatgttccagaataataaaagaaaatgggtgcaagcaaggttgtgagcaatataaatggatatatgtaggtctcaagataaaatatgataaagcgacaaggttttaggaagacaagagcaaggacaagaaagggtgagtgagaaggtaatgagaaatagatgagtcctcggaattaagcccatgaaaacaagatagctgatggcttctctaagttatagaaagctctgtatagcttgaatggactcaaaggaatctacgactagtagcatttagaaaagatggaatgctaaataattgtgatagataaaggataacatttgtgccttcgaccgagtaatgatttgaagaggatttcatggattttacggaattaaattaccaacgtaaagtgaatcacattggaatgctataaaatacgattattgaagtacaatatcacccctaagtggatcaggaaaatcacttctaatattcctcgatgcagcataagctctagtggtaatgtattatgtaaaaagtttcaagttatcaacggaagattgtagatcaacattgaggtgaatcgataatggatgaacaaaagatacaaagtacgagatgagattaggccatcagacttaagatggatagtaatgaagaagtgttaaaaggcttagctttatgcatataggataagcaatgagagtaacctggagtttggtcgcaggcctcagtaacaataaatcgaagtaagagttatggtatagtatggcctacttagatatagtaaagctaacgattcccagagggacagcttggcatagttttgtatatgttcacaaagtgaggcctagagatcggctaagagctggaggaaataggagagaagcattgcataggcgcacataaagagttagagtcgtacaggcttcatgatagaaggtagcaatagttacgagattagaaggattccgactacatgtcatggtgtgaaaaagatgcttaaaggggggaatgccctagcctttggatttattcaaagaacaattgcctaaatggaaaggagaatattaaagtattcataagggctatgggttatgagaacgataagtgcattagccaacattcgaggacgaatgttccaagggggggggggatgatgttatgccctacagtattacgtcgatattataccctacaatattatacatgaaattgtcataagataactgaactcagttcaaggacaagattgtttagagattataagcattatgctatttcaagcaagtgatggataagttcgtgaagatgagagggtaagcaaatcaaagaaaataaattttcgtcgaagtttgacattttgggataaaatacaggcgagctaaaatacccggtacttatagactagtaccacacaaggtaccacatgaccatgatagtaaggtgtataaggtatgttaaaagtgagtagtattctaagtaatttgatataattcttaattatgtagattattggttaaagattgaattagcaagttaattaaaattagtgggtaattaattaataaccttgcgataagacttagaccccccccccccccaaatgtggaatgccttcttacctatctaatgacttttaatgaaggtgaaaaggtgtcatattttgagaaaggaaagtggccaagcttggaatgtggggcctacccaaaaaattaaagataacattcataattcaacaatattttctaatctcttaagaagaatttcacccaagctttccattacataatgttaattctaaatctcttgagaaagagtttcaacaaagatgactttgcaatagcaacattattgctttgagcatttcatacggattgttccatatttcgatcttgtcgttacgtgtttcatcgtaatcaacacgtgttggagggcttgtcaatagaatcggataaggtatgttaaggataagtccgtccttcctttggcatgatctcgtaattacatatggttgataaagaggcatcaagagaagttcatgatcccgaatttatatacattatcctagtcttataagttacagtactctaccttatcgggacttcatatttaattgagtattgtctttttctagtcaagagagcatagagcctatagatacagtattacagtattttcattaccatcgatctataatcgatgggcaggcccctattgggcaacctctaatcacatggtaagttatataccaagcctactgcggcggagcgcctatgagcgagcccagttggccgagatacagagcctagtatggttgagagcgtatgagcgagcctactccggcagagcagttatatatatactgagccttagaaggccagacaactattttgcttactatattgagagagttgagtctgtatcaatagatgagcatatcttcagattatctttgactcccagttactttaagttattatattattagttgaatttcagattacagtatattgccttaaatacttggtatattattttgcactgacgtcccttttctgggggcactgcatttcatgcgtgcaggtttagacaaacagagaggtagacctcctcattaggtattgcccaattttagcttgatcggtaagctctatgccctttgtagttgccgggtctaaagctttacgtacatcttgtgtatacatatatatatgttatgagtaggtcggggccctaatccgatcatagtacatccattagtagaggcttgtagacatatcttgtcagttagtgcagtttattagacttgtaggccttgtatgtatattttgattggtttgccaactgtagtagttatgatggccttgtcggccagctttatattgatgtttagtcagcatttgcaaattgtcctgaagtgtggcccatggacaaagtatgacgttatatgttcagagtcccttagtcacaagtttgtacgcaaggatagtaaggcatcgggtgccggtatctccccccaggttcagggcgtgacaataggtttttcaccttttgagctgggtgtttttcacgtaaaaatacttgttttcttcactttctgcatttattgttccacaacagtagcataaggaacacatacaagaaccgggttctcctataatctgtgcatgcaaaaaattggataccacataaatcccccccccctcttgtgtggtatggaagtataaaataataattgatatcagagcgggttatccttgatgaggctaacaccttaggaaagatcaagatgagtgcactacctgaaaactataaagagcaatccaccactaggccagtactattcaatgatcgctattatttttttgtggaaggagagaagaagagttcacttgcagatgactgatggatgctccaaatatggtataaagaactacatgatcaagaactttcctatgtgaaaagtcgggtggaaaaaggagaaatctgaaagaaggaaccaaaagaaggaacacgttcatgacaagaagaactacatcaaaaggtcatccaaagcaatggttactacttggaaagatagttcagatgaagacactaatgataatgctgaacgagctctcatagcaattcaagaatctgaagatgaacctgatcaagaatatgagataagttttctagaccttaaggataaaattaaactcctttctaaagatagactattagaattgttgctaactttaattgatgaatccatgaatattgaaaaagaacagttgtcaaaagagtgtaactttttaaaagcaaaatgcaaaaacctggaaataaacatttgtaaaactaaaaaggaaaataatactttgaagaaccaggttcatgcacttgatacatctgtcttagaacttagatctgagaatctaaaattgaagttaggaacaggtaaagaaatagctagtgacacataactctcactagaaaaggatctaggaaaggtaaaagatgagctttataaaagagatgaactggtaagaaccctgaaggaggacttgactaaggttaagcatgagttagatagaacatgtaaaaggaacgtgtcctctgatgaactttcatgggtacaaaaataccatagtagcaacagaaagggacttggctttggaaattctgcacctaaatgggatcccaaaaataagcacctaacattccctgagaataagatttgcacacactgtgaaaacactggtcaagttgggcttaaaataaaaggaaggtcaaaagaataaaaaaattgttctaggaaaaataggctgccaaattgggctaaaaagaacttaatttttccttttgcctatagaaagggacccaaactagcttgggttcctaagactaacctctaatttttttttgcaggtccaagtgggagagagcaaccaaaagtgatatatgataaaaggttgatcaaaacacataataggaaataataaaaggttcctttcacttttggcctttaaatgaggtaatgtctcctttgaaaatggaaatcaaggtaaaatcattggagttggaaagtcttgcagggaagaagagtgatcaatatatatatagtggatctatccacactttccgataatgaactcacttgcttgagtgtcctggacagtgatcccctcatttggcataagaaacttggacatgctagtctaacaactcaacaaactagtctccaaggacttggtgatagggttgcctaacattaagttcgaggaagataaagtttgtgaggcttgtgcaagggggaagcaggtaagatcttctttaaaaagcaagaaaatggtaagcaccaccagaacgatagaactggtccatatggatctttgtggaccaatgagaacattgaccagatatggtaagagatatgttatggtgcttgttgatgattactctcggtttacttggacactgttttttaatatctagagatgaagcatttgacatgatcacttcatttgttagaaaaacttagaaagaactaggtaattaacttgcatcaattaggtctggacatggtactgaatttgagaatgttaaatttgttgaattgtgcgatgagcatggcataggtcataacttttctgcccctaggactccacatcaaaatggagtagttgaaagaaaaataggaattagaggaaatggctaggactatgctacttgctagtaaattgcctcaaagcttctcgacggacgctgtgaacactgcatggtacatcataaatagttgcatgactagacctcttgttaagaagattccctatgagtcacttaaagagagaaagataaatatatcccatcttagggcatttagatgcaggtactttgttcttaataatgaaaaagattccctaagaatgtttgatcccagaagtgatgagggagtattcttgggatattcttcacatagtaaagcttataagatatacgataaaagaactatgtgtgtagaaaaaagtgtatctgttatttttttttaaaactaatattctttctaagaggcaggaacaagataatgaagagattgggctaataaaaaattcaaatagtgaaaccacagtccatcctgaagatgcatcacatgaaggaataggtgatggaataggtcattccacccatggcaacatgacagggagaactaactagagaggaactgatcctcaaacctcgagggaacctgtccatgaacctattcctcagtaacaaaaccaggaaggaacatccaaagaaattgacactcatattgaaacatccatgaatttggatataaatgaacctagttcatctattgatcaaaagttttataggtaaatgattggttctctattatatctcactactagcagacctgatattcttttcagtataggactttgtgattgatttctggcaaatccaaaggagtcgcacttgactgatgttaagaggatcttgagatacttgaaaggcactactggcctttgtcttcggtatccagaagatagtaacttcaacatagtgggatatgttgatgctaattatgcaagttttcttatgtatagaaagagaaacctaggtatgtcatactttcttggctcatgtcttgtgtcttggactaccaaaaagaaaaattttgtggccttatctactgctgaagttaagtatgttgttgctgcctcatgttgtgctcaattgttacggatcaaacaacaattaatggattttggaatttatgaaggttgtatccctatattctgtgataacactagtgcaattagtatgaccaagaacctggttcatcaaaagggaactaagcatatagatgttaggcaatacattttgaggggcaactatgagaagggtttgatcactatagaattttgtgctactgacaagaaaatagctggcatcttcacaaaagctgtaagtatagatcactttgaaagaaacaagttaatattagggatgattaagatcacctaaaaggaaccagttctaactcaaaaatttgttagaaaattgtgaatttttgtacataattagattagattttgctcagtctcatactaccataagtatactcttgtgccatatgataacatgactcattaatatatataatgatattatctctattttcttggaaaattcatactcacacaagagatttttcagtgaagaacctagttcatcaagattatttggtacgtattctccattctgcatagtttgaaataattatattggatcatgattaagagaagagtcacattcaatctcaaaacccattgtacgtatccattataaaaatggaccagtttcgttcaaaagaggagtccaaaccgcattaagtgcctagattctagggaacctctctaacatcttttcaaaacagaaatgcagtttgattagacctctgaaaaggctgtcatcactcaattgaactcctccactttatattgataaggctttacttgtttcttgacttctaaatcttcaagccgtcaaaattctctccaacttctctcatcttccaaacacgctcaaacctccttttctttctccctagcgtagaaatggctaacacctttgataatccctaatcaccaccaaaggaawtttctttctccctagcgtagaaatggctaacacctttgataatccctaatcaccaccaaaggaaacctcaccctcaccatctgatacacattcaactactcccatctctaagaaataaagggtaaaaatgatggctcgtaaggttgttgctggtggagaggaaatcaagaaaataaatgaaaaattgaaagcaagtaaggaagaagaacccaaaaatccgatgagtcattcaagtctacaactgagggggaagaaatggtttcttttgagtctaaacatgtaacgtctggccccaaagttaatcctgaaactatttctaaggttgctacaaatttagagaataggtttgttctagtaggatcgatagcagtattgaaattactgagtctggaaaggtgggtggtaaaaataaaagagaaaagaaaaagagagagagggtgattgaaatactgtgagggtaatgggaaaaggagtggccgaatcttcacctactcttgttgtccttactaaagaatcaagtgatgtggtagtctggggtgaataatctgatggagaaaagcagagtgtgagagtaacaggggaaagtgggtctagagaagttgttgaggggttggttaggctaagaaaaaatgttgaagaacttgttccatctgaacagaaaaccctcagacctactaaaaagggtgactgacagttacaatcccaagaagaaaggaagttcaggagctaaaactcttggcattgctagggaaaacaagaaaaggaaggctgccccttctgttatttctgttattatcccacaagaggcagagccacaagaagccagaaaaagcagaatgaggcagaactggagaaagccttggaaaaaagtagaagaaaagtagttgctaagggaaagaagaagatgagtgagaccgttgagactgttgatattgatgagatggacctagtccgtcgagatgaagataagacagaagaagtggaggttatgactcctaaaccagagaaagccaagccttccacaaaaaagtctatttcatagtcaaagtttgcagaaccatccactttagcaaagagaaccaggtctgctgtaaaatcaagaaaagtgaaaattgtagaggaagaagaatggagtggggaggaagaagaagatgattctgatattgtgaaagacaagctggccaagtttggcaagagaactaccttgaaaggcagacttctcaggaacttagaggaggaaggaattttgctgcttttggaaaagttacaattacaaggctagaataacatggtccttcagatggatggcaggtttgccagaactaaaattattgagtttatgcccaattgtgaggtaaaagatggaagggtcaccagtacagtgaaaggagtgaaagtcgcttttaatttaaaaggagctgggtgagattttaggtgtaactgttgaagggtacagtgactataagaagctcaagtggccaagcctagaaaatctccctattgcccttgccattaccagaaaattcagtgacaataagagagaaaattgagcccaaggttgtgtaaaagagtgagatgaagccaccccacaaagtgatgttcaaatttgtcaacaaatgtattctgccaaggtaggaaatgaggcacattgcaaacttcatggacttggtcctgatggaatgtttggatagtgggaggcagattaattggcctggatttattatccaacttattgatagggttataaatggcaccaaaactcatgcaattccctatggcttcattctcacaactgtgcttgcacatttcaaggtacctatgaagagtgggaggttagtacaagaaaggatcattttggtgcaaatactctgctttcttgtgactacgaagtccatgccactcctaaagaacttggttcatccaacaaggtaccagtgaatagtaaggtgtgggccttggtacaagaaaatgggctaaggatgctgagattgaaaggctgaagaagaggttggcagaggtggagaatgagagagatgctctcagaattgagctggcaagagaaaaaaagaagaatgatggcattcttcaagaagtgctgaaactcctccaagccaaaaaccaagcacatggtccttcccagccttaagcctcctagcctagtgtagatcaaccagtgacctagctcgggatttcttttgtttcttttgcccatgatccagtgtttatatttctttttatgctttgtagtaggatcttatcaatcaatgaaattcactgccttttgctctaactgtttgttgatatttcttagatgactaatatccttagattgatagatggtgcttaaatccatgattgtatttgaagtagccccagtggccatgagtaatttttattaaaatctggttatctaacataattatgcaacttttcgatgatgccagaagggagaattaggttgtgcttttactttaaactgtgatgtttataacctaatgaaccccgtcgttgataatttatgtctttaaaatggaaagttttccaacagtgtattgatgttgagctgagttaaaacaggtttcatgcttatgaagcacggagtttgtcatcatcaaaaaggggggaatttattagcttgagtaagtttgttttgatgattgacaaaggaacacatgcatataaccaggtccatggacagtgtacacagatgacggacagaatcaaacaaaagacttgcacataaaagggataagtataagtggttatatctgatattccttgaacgaaaatgttgcatacttgataaggaccaggactacttactcgaagagaactctatccaatataagagaagaattataagttgaagttgactagaactcttttaccaaggaagagtaaagcattagaactctagttaatctttatttactaattctataaatattagtgttgttttcttttacaggtgatacacacatacttaagtaaaaagtacaaattgagagcaaaatagcaaggcattttgtgagcaattcctgtgagatttatgagtgcgatcttgatgctacacgaaccagattgaagaaccagctccataaagagttttatatgtctttctttatttctagttcaaagtgtagtaggcgttttaagttatacctttcagttttctaagaagcaaattatactaggtacctgagttgtatctttcaagttagagttaatttgaagtagtcgcaacagcctgtggctggttgctataagggttggagttaatccgtaagtttgcaagagtttgtaaactttgttgttggctcagagttatagtgaagtgtttggagaaaatcctattgggtagtaggtcgtgattttttcaccttttgagtcgtgtgttttccatgtaaaaatccttatattctttactttctacatttattattccataatatagtataagcaatacatagaagaacatggttcttttataatacgtgcacgtgaaaaattggacacccctcttgtgtggtattgaagtataaaataacacaaaggttactcgcaaatcgacccaatgcatcgggaacaagcatcgtcataacgtatgacgtcactccctctcttggaccagattgctccaacaaatcacccgggaaatttaagggatttgaaatacgcagcccacagagagccacattgcctgctctctataacgactatgacccatgttatctcttcgacaagcccgaccatgaacgacattatccgctcattgagcgcgcccgcgaagacgacctcaagaagcggaggaactaactgtatgggcaaaaaattatcatagttgtatttagattacgtcaacattaagagggccttcgaaggctatcacgtgtcatcagtgtgacttcaataatagacagattcaaggctgaagtgatttgacaagagatgaagtgctaggtcgaggagtcaacagagatcaaggtcgaggacgtgcagtatccttaaattaagtaataacggccagttttaggataagactttaaagagaatatttcagtgaatattctctcgatctgtattattagggttttgtcacacatgtccccttataaatagaaagagacatagttataggggatattgaacactcatttggaaaacaacaacacctttctttgtgattcttgctttatcacatatatacaaaatacaccttttcttgagatcattgtctagcttttctcttacgatccaaggagaatctgaatattcaaaggcttatcaatcatttatcattgtcaaaaggaatattacacggcttcatctcctttttcgttcatctctgtaacatatatttatataaataccattatacatcatttattgctatcgaatgctattcacttcacatttgtgtcattaagtgttgtattattgcatatttaccactgttaccgtagatctcgtaacactttgttgcggcactagttaaacaatctagtggatattataattggctaagattaaccctaccttattaaaaaaatctaattatttaaacctagatctaaattttgggcaaatattaatactaataaaatacttgcacctccagtaatgagttggattatcatgtgcttcctttattttggtatgatcattcaggcgacaacagcaaaataaaaatacaagtgaaaggtttcgtattttaacaatgttaaaaatgataaacttcttcatcaagtctgaagtctcagagtttggttttcgtgctctttaatttcttgcttctattttaccgacagataggatttaaaaaatatacacatccagtattaattggagttgaagtcttgaagattcctcttctctcttgtattattaccagtcatataaaacgacaagagttgcatatgtatgtatgtagtgttgggagttgacctcgatgctttctttcttgcgaggtgctattcgttgatatatcatcacaaaggacaagacttgctggaaatcatgtgtaactcccgcttttctggtgttatgaataaattaaaaacttagcacatcaaatggttggagaagacttctttgttctcttaggatgcactccctccctcccatttcatatgattgtgattcggagtacaaggatgaagctatctactttttgtgtgaatgtgaacaaagaattttcaaataatttgaaatatcatttacatatttaaaagctacgcaaaataatactataaatcatagtaacaagtaacatttcaaaatatttaatagacatgtgaaaacatgaggtcaaagaaaaactcctttgatatcccatgtgaatgttgagatccacatttatttcttcatgtgtcgcgttccttgaaaaatacattgctataccttctaccaagatcgagtccttggttctactaatttttaggatccgtttggatatagattccccaatatttttgttatgatccgaaattctcaccttcggaagtcgtgatggcgcctactagtagaagctaggcaagccacgaacttagaaatctttaactcttctgttttaatcttttttttttcttttttacaacttatattaacaagtgataaacatctaaatggcagcagaatatgagatttaagtgaaagacttaaataaatataaaaccaaaatgtttcgaaagtcaacacatgcctctacccagaaactggtgtcacaatatccacagactattaagagtactacatacaacggtttgaagcaagaataacattgtttgcctcggatacatgagataacaaaacataataaaagataaaggagacgtcgggcctgcggacgcctgcaaggctacctcgatgtctcggtggactgaaggttggctcccctactgctgctgatcaagtgccgctccggtatctgcacaaagtgcatagtgtagtatcagcacaaccgaccccatgtgctggtaagtgcctggcctaaccccggcgaggtagtgaccaagctaggaccagactccagataaacctgtgcagttatataatatatggcggaaaataaacatgaataagaagtttaaaattggagggggaaacatgcttcggggaaacatatcaattctatcagaaacttaataaactatgaaagaacactcgatgtctacaatcaatacgataacaatactgttgcggcgcgcaacacgatcctttatcatttaacattgttgcggcgtgcaacccgatccacatatataactgttgcggcgtgcaacccgatccaatataatatctgttgcggcgtgcaacccgatccaatataatatctattgcggcgtgcaacctaatccacatatataactgttgtggcgcgcaacccgttccagatatacagtcaacaataatcataattaaccgccccgacaagggatcaataatagactacactatccggcaaaggaactcaacagtacaagtatatacgtcccgataagggagtaaccgccataaccaaacttgttccaacatctaactatctcaactataactcagctagtttcaacatccaactaccccagctataactaaacttgttacaactcctaacacgaagaatcatcaacctaagcgtccgtaatatcaattaagaacacaatgcaagggaacatcaactcaacaatagcccggcaaggggggcaacataatgatctctactctttctcacttttacctcacaattaacttcacaactcgagccaatgctctagagtttcgattatcactgagcccacgctccttaatgttcataggtcacaattctttccacaactttacacaataaatagaaatcttcaccaaggcacgaataatacaacgagatcatgaaaatcacagtataagactcacggtcatgcttgacaccaacgcatagatactcgtcaccatgcctatacgtcgtactcgacaagaaacaaatagcaaataggacacaactcctaatccctcaagctaaggttagaccaaacacttacctcgatgccacaaacacaactcaaggttcaattatagctttaccccttgattccaccgccaattcgctcgtatctactcacaaattacttaattacatcactaaccgctaaatgaatcaattctaatgcatgaaaataggttttaccaagatttccccaaaaattcaaaaattgcccccgggcccacatggtcaaaacccgaggttccaaccaaaacccgattacccattcccccacgagctcaaatatataatttgttttgaaatcggatctcaaatcgaggtccaaatccccattttttgaaaaatataggttttacccaaaacactcgatttcccccatgaaaattattgatttgaagttgaaatcatgttaaaagatattagtgattgaagacaattagttaaaaatgacttacattgatttggagaagaaagagtgtttgaaaaatcacctcttatgtttttggggtttttgaaaagtgcaaaatgactgatagtctcgtctatttatacccctctcagaccctctccgcggaccgcataaaaaggactgcgtccgcggagctccaccgcggactgcgagacctggcttcagagacctgcaacttctctgaatctgcaactttttcctaagtgtaaaaacatcccgaaactcacccgagccctcagggctccaaaccaaatgtcatactaactcaaaaatatcatatggacttactcgtataatcaaatcctcaaaataacctcatgaacatcaaattaaatctcgagatcaatgaaattttctccaaaacttctttaaacataaattttgcaatttaagtccaaatcacgtcatatgacatctgtttttcaccaaattccacagaaaggtcttaaaccatatataagatctgtaccgagcaccgaaacacaaattcggtcccgataccatcatgttctaatcaaattccatttcaaatttctttaaacaattccagaaaataatttcctttaaaaattcatttctcaggcttgggacctcggaattcgattctgggcatacacccaagtcccatattttcctacggatcctccaggaccttcaaatcacgggtccgagtctgtttacccaaatgttgaccgaagtcaaatttatttattttacagtcaaaacttatcatttttcacagattatcatatttaagttgtctggctacgcgcccggactgcgcatgcaactcgaggtgactctaaataaggttttcaaggcctcagaacatggaagtttcatattaaaacaagttatgaccttttgggtcatcacattctccacttctaaaataatcgttcctcctcgaacggacagtacctgaaggaagtacctgagtcgggaaaaagatggggataatggctccgcatatcggactccgactcccaggtcgatgcctccgtaggctgatctctccattgaacatgaacagaaggaaaactcttcgatctcaactaacgaatctgcaggtctagaatagccaccggcttctcctcatacgacaagtccctgccaactgaatagtgttgaagtctaacacgtgatatggatcgccgtgatacttacgaagcatggacatgtgaaacactagatgcacggttgaaaagctcgacagcaatgcaagtctataagccacctctcccactcgatcgggaatctcaaacggaccaatgaacctagggctaagcttgccctttttcccaaatctcatcactcccttcataggaaacactcggagcaatacccgctcaccgaccataaatgccacatctcaaacctttcgttctgcataacctttttgcctggactgagctgtacgaagcctatcctgaataatcctaacattgtccaaggcctcctgaacaaagatctgtacccaacaaccgagcctctcccggctcaaaccatcatatcggagaccggcactgcctaccatataaagcctcataaggagctatctggatactcgactggtagctgttgttgtaggcgaactctgctaaaggcaaaaactgatcccacgagcctccaaagtcaatacacaagctcagagcatatcctccaaagtcgtacttaacctgctgacaattcaaacaccgagctacatatgcaatgatatccttcttcattctctgccaccaataatgctgccgcaaatcctgatacatcttcgcggcgcccggatgaatagactatcgggaactatgggcctcctctaagatcaactctcggagtccatccacattaggcacataaacttgtccctacaatctcaaaactccatcatcatctaaggtaacctgcttggcacctccatgctgcaccgtctctaaggaacacacaaatggggatcatcatactgccgattacggatacgctccaataaagaagaacaagcggctgtgcaagctagcacatggctgggctcagagacatccaacctcatgaattgattggccaaatcccgaacatccaaagcaagcggtctctcaccgcccggaatataagcaagattgcccatactggatgacttcctactcaatgcatcggccaccacattggcctttcccggatgatatawratagtgatatcataatctttcaacaactctaaccacctcctctgtctcaaattcaactcctgttgcttgaacaaatactgaagactcttgtgatccgtgaacacctcacatgccacgccatacagataatgtctccaaattttcaatgcgtaaacaatggctgccaactccaaatcatggaccgggtagttcttctcatgaatcttcaactgccgcaaagcataagcaatgaccttgccatcctgcatcaacactgcaccaagttcaatacgatatgcatcacaatagactgtataaggccctgaatctgtgggcaaaattaacactggtgtcgtattcagagctgtcttgggcttctgaaagctcgcctcacactcgtccaaccatctgaattgggcacccttctaggttaatctagtcattggggctgcgatagatgaaaacccctccacgaaccgacgatattagcctaccaatcccaagaaactctgaatctgtgtagctgatgctggtctaggccagaaatgcaactaaactcaaccagaactcacacttcgagaacttagcatataaccggttatccctcaaggtctgatgaaccactctaagatgctactcgtggtcctcccagctacaagaatatatcaaaatatcatcaatgaagactatcacaaacgagtccaaataaggcctaaacacgcggttcatcaaatccataaaagctgttggggcattgatcaacccaaatgacatgaccaagaactcataatgcccataccgagtgtggaaagctgtcttagggacatcggatgccctaatcctgaactgatgatagccagatctcaaatcaatctttgagaacaccttggcaccctgaagctgataaaacaaatcatcgatcctcggcaatggatacttattcttgattgtaaccttgttcaactgccggtaatcaatatacattctcattaatccgtccttcttcttaacaaacaacaccggcgcaccccaaggtgaaacaagggtctaatgaaacccttctcaagtaggtgttgcaacttatccttcaactctttcaactcagacggagccatacgatacggcggaatagaaacgggctgagtgcccagatccaaatcaatgcaaatgtcaatatccctatcgggtgtcatacctggcaggtctgaagtgaaaacctcaggaaactcatgaacaacgggtacagaatcaatagagggaacctcggcactagaatcacgaacatatgccaaataggacaaataccccttctcgaccatacgccaagccttcacataagagataaacctacgggtagaatgactaggagtacctctccactctaaacgaggtaaacccgataaggctaaggtcacagtcttggcatgatagtctaagatagcgtggtaaggtgataaccagtccatccccaatataacatagaaatcgaccatgtccagaagcaacagatctacacgagtctcaagaccctcaatcacaactataaaagagcgatggactcgatctaccataatagaatcacccaccggtgtagacacatatacaggaacactcaatgaatcactaggcatgtccagatacggtgcaaaataagatgacacatacgagtacgtagaccctggatcaaataacactaaagcatctctatcacaaacaagaaccgtacctgtaataactacatctaaagcctcagcctcgggcttggctggaagagcataacatcagggatgggccccaccaccctggactacatttctgggacggcctgtagctggctggcctccacctctagcggtctgagctccacctctaaatcctctacctccacatctagaacctctagctggctgggtggtctgtggaaaacctggtgccccaaccatagcgcggaaaccctgctgctgcgactgagtacccactaacctcggacaagtcctcctaatataaccatactcaccacactcaaaacatccacctaagtgttgtggctgaggaaactgagactgaccctggcgacctgaataaccaccccgaaaactctggagcagcagtgcactgataggagctggtggtgcactgtaggactgctgatcagaatattgcatctgcggactacggctacctgaagcaccgtgagaaacctgaagagctgactgaatacaacccgatctaaaatactcggtatttatggactagtgccatacgaggtaccacatgactacgacataaggtatatataaagtatattaaaaatgagtagtattttaaagtaatttgagacatttcttaattatgcaaataattgattaattaccgggtaatagaacgttacctaattactggataaagattaagctttcccaccctaaaacgtggcagcaagactagctctaaattgtgactcttaatgtcacatattaaggtgtcaaaacttagtaagatttgtggccaagtcactaaattagtggggcctacagcattaaaacataagacctctctaaaaagagttgcttatataaaaaatggtaggcaatttgccttagtaacgtgactggcattctgtttcaataaattcaagcaagcatatcttagaaatgtgatatttttgaaattctaacgaagcctggtataatttttctcaagaatatcatacggatttttctctacttcaatctgtcattacatgtttttcacataagacgtgtgttagaagaattgttaagagaatcggtccgggtatgttaagactatcccttatttcttttggcatgatctatacgtcacaaacgaaacgagtaaatgcacaatttcaataaatgactctaatcatagaaatactaggggtgtctatattcttgattcccaatgtagattattattatatcttctattcacggtctcagaaaaatacgtatttgataaagtttatccgaaaggcatatgaatttttatggcattctgagaaaatcttattgacatattttcttatgcatttcatgcatttatacatgtacattgacccatgactagatggcgttatatatgcatatatatgtatattatatgtatatgggatatgggaaaaggttacgatattgtatacgcaccaccacctgatcagctggtatacgttgatgattttgcccatagtggacgagatgatatgatgggatgccctcagaggcttgatgatgttatgaacacatgtacctatacacgacatgacattcatacatatatgcatgacactaaaagtatttcataatttacagagttatccagacttacaggttgagtcatttactttatatttcttccatgtcttttacgtacttatttatgtgccttacatactcggtacattattcgtattgacgttccttttgcttgaggactctgcatttcatgtccgcaggtctcgatagataggtcaagagtcctctaagtaggcgatcaactcagcggaagatgttggtgctctccatttgctccggagttgcttgtttggtcagtatgatttatatgtgtattgtttggtatggagggttctgtccctacctttataacaattatgtatccttagaggcttgtagacaaatatcatgtatgtaagagattgtatggccttgacaacctatgttcagtgcacgagtgattattttggtcttagaggctcatatgtcttatgtataagttggtattacatattgtattctacctatttcacggtggcctctccgacccagttatctatgatagtatgatatgaaaagatacattatgttggtactcggttgagtaagatatcgggtgcccgtcacgaaccatcgattttggtcgtgacataattacttctataaacaaacatatatttgaattttttatttttaaaaaaaacttccaaaacttatggccaaacgcctacttaaacttacttatgcttttggcctttgaataaagttagaaaatccatttgtgtattccttgaaagcgagccatgcattgtcgagtcaacttaccagcaaatacttcttgtaagatttaatttttcatataacattttcctttttcttttccttttttttttgtctttttctttgcatgcatgtcatcaggcccagctggcgcctaaggccactaaggcaatggccttaagcccccaaaatacttacggccccaaaatataaaaataatatatatatataatattttgataattatatactattgttagaaattttaaatcatttggttaaaatagttatagctaaaagttttacaaatattaaatttcagttactagttattttctgtctttaattcgtcccaacttaagttgatcttcttacaatgttagtttagaacagtttttcttaattctttgagtgcatttgtagacatttttcaagctactttgattagtaactattaaaatttgtccttaacattaattgactcttgaaacatagtagttactataatattatttgtttcaacttatatttagatttaaaagtgctaagagaaactgtatacgtagaagaatactctaatgggtaaacttaatcagctaaaaagtgttaattcaatattgttaattaacaaattaacttgagatttttaaattaaaataggttggatttttctatatcagttgtctcggttgaaaaagtttttaaaaactaagtcaataaagttcaacaaaataatacaagagagattaaacaaattggttagacattggcaataattaaaactgattataaatttcgataaattataagagagaaaaaaattaaggcctcacttttaattttcgccttaggcctcatattatgtcgatccgccccagcatgtcattatttatagaatatatgccaaaacaataaagtttatatacaatacaggtatgtgttaaaactgatgatcggtcctaaactatatgcacaaaatttaaaaaatgagattatgtgagcagaagggacctacatatatatatatatatacttacggataccctgaacatatccaccattagtggatcatcggataatgacattggactaataaagctcagttagcccatttgttttgaaaatcattgggttgtgtttcattgtagaggaattttcaaaaagtattatagtttagagtccaattattaacatagttatagttggcctaattatcattcgtaggtaatgtatttcaatttcgctgtatcaaacgcatacaaccaaattcaaattttgttgtatcaattcattgtcaggctgcatcaataaataccgttttgatggaaaagttgtattaactatattaattcgtgaataacggttgtatcaatgaatataattttgatggaaagcgatatcaattagaggcagaactaggtgtcggcccaagaaaaggtttgttttgaagattgacaaatgaagatcaggcatgaaccaggtccatcccttgtgagcatagacacgggcagattcgagcatatgggatgcacgtgacgaagataagcttaacttggtatatttgatatctccttatcgaaaaggttgcataattaataaggagaaggactccttacttaaagtgaatactatccaaaataaggaaggagctagaggttgaaggtaactagaacttttccactaaagaagagtagcattagaactctagttattttctactctactaactctataaatcacaggatattctcactttacaggtgatgcacacatactgaagttaagagcaaattgagagcaaaatagcaaggcattttgtgagcaactcctgtgagttttaagagtgtgatcctgaagctacacgaaccagattgaagaaccaactccataaagagttttatgtgtctttctttatttctagttcaaagtgtagtatgtgttttgagttgtacctttcagctttcttagaagcaaattgtactaggtgcttgagttgtatcattcaagttagagttaatgtgaagtagccgcaacggcctgtggcgggttgctataatgattagagttaatctttaggtttgcaagaggttgtaaactcgatttttattattcatgttagagttaacatgaagcaatcgcaacagcctagggctggttgctataagggctagagttaatccttaggtttgcaagagtttgtaaactttgttgttggctctgagttgtagtgaagtgtttggagaaaatcctactaggtagcaggttgtgggttttttacattttaagcgggtgttttctacgtaaaaatccttgtgttatttactttctacatttattattctgcaactgtagtataaggaacacatagaagaaccaggttcttctataatttgtgcacaaaaaaaattggacaccacacaaatcaccccatcccctctcttatgtggtattgaagtaaaaaatatcaattggtatcagagcagattatacttgaagaggcaaataccttaggaaaagatcaagatgagtgcactatctgaaaactctaaagagcaatctaccactaggccaccactattcaatgatcactattattttttgtggaaggagaggagaagagatcacttgcagatgactgatggatgcttcaaatgtggtaaaaaaaaccacatgatcaagaactgtcctatatggaaagtcgagtgaaaaaaagagaaatatgaaataaggaacaggttcatgacaagaagaactacaacaaaaggtcatctaaagcaatggttgctacttggaaagatagttcagatgaagacattgatgataatgttgaacgagctctcatagcaattcaagaatttgaaaatgaacctgatcaagaatatgagataagttttctggaccttaagaataaaattaaactcctttctaaagatagactatcaaaattgtttctaactttaattgatgaatctaagaatataagttatgaaaaagaacagttatcaaaagagggtaactatttaaaaacaaaatgcaaaagcctgaaaataaacatttgtaaaacttaaaaggaaaatactgctttgaagaaccaggttcatgcacttgatacatttgtcttagaacttatatctgagaatctgaaattgaagttaggaacaggtaaagaaatagccagtgacacacaactctcactagaaaaggatctaggaaaggtaaaagatgagctttataaaagggatgaactggtaagaaccttgaaggatgacttgactaagattaagcataagttagatagaacatgtaaatggaacagatcctttgatgcactttcatgactacaagaataccatagtagcaatagaaagggacttagcattgggaactctgcacctaaatgggatcccaaaaataagtacctaatattccctgagaataagatttgcacacactgtagaaacacgggtcactacaagagtgattgcattacaaaagaaaaggcagatcaaaagaataaaaattttattctagggaaaaatgttgccaagttgggctaaaaagaatttaatttatccttttgcctatagaaagggacccaaactagtttgggttcctacgactaacctctgatattcttttataggtccaagtgataaagagcaaccaaaaataatatatgataaaaggttgctcaaaacacatgacaggaaattagaaaatgttccattcacttgtggcctttaaaagaggtaatgtctcctctgaaaagagaaagcaaggtaaaatcattggagtcggaaagtcttgccaggaagaagagtgaaaaatatatatgttgtagatctgtccatacttttcgataatgaactcactttcttgagtgtcctggacagtgatccccttcttttgcataagagacttagacatgataatctaagttgactcaacaaactagtcttcaagaacttggtaatagggctgcctaaaattaagttcgaggaagataaagtttgtgaggcttgtacaagggagaagcaggtaagatcttctttcaaaagcaagaaaatggtaagcaccaccagaacgatggaactggcccatatggatttttggggacgaatgagaacattgagcagaggtggtaagagatatgttatggtatatgttgatgattactctaggtttacttgtacactgtttttaacatctagagatgaagtatttgacatgttcacttcatttttttttagaaaaactcagaaaaatctagataatcaacttgcatcaattaggtctgatcatgatactgaatttgagaatgttacagaagttatgaataatgcatgctacgtcataaatagttgcataactagacctcttgttaagaaggcttcccatgagatatttaaagggataaagccaaatatatatcctactttagggcatttggatgtaagtgctctgcgcacaataatgtaaaagactccctaggtaagtttgatcccagaagtgatgagagagtatttttgggatattcttcacatagtaaagcttataagatatataaaaaagaactatgtatgtaaaagaaagtgtgtatgttatttttgaaactaaaattctttccgagaagcaggaacaagatgatgaagatattggactgacaagaaactcaaatgatgaagccacagtctagcctgaagctgcatcacaggaagaaataggtgatggaatgggggtttccaccgtgggcaacctgacaaggcgaagtgactagagaggaactaatcctcaaacctcgagggaacttgtccatgaacctattccttagtaacaaaaccagaaaggaacatccaaagaaattaacactcctattgcaacatccactaaattggatatagatgaacctcgttcatctgttgaccagaagttgtatagaggaatgattggctctttgttatatctcactaccagcaggcctgacattgtttttagcgtaggcctttgtgctcgatttcaggaaaatccaaaggagtctcacttgactgccatcaagaaagtcttgagatacttgaaaggcaccactaacctttgtctatggtatccaaaaggtagtaatttcaacttagtgggatatgttgatgctgattatgtaggttttcttgtgaatagaaagagcacctcaggtatggaacactttcttggctcatgtcttgtgtcttgggctactaaaaagtaaaattctgtagcgctatctactggcgaatatgagtatgttgttggtgcctcatattgtgcttaattattatggatcaaacaacaattaatggatgttggaattgatataggttgtatccctatattctgtgatatcactagtgccattagtgtgaccaagaatccggttcatcataatagaactaagcaaatatatgttaggcatcattttttgagggacaactatgagaaggggttgattactatggaattttgtgctactgacaagaaaatagctgacatcttcacaaaagctctaagtagagatcactttgaaaggaacatgttagaattagggatgattaagatcacctaaaaggaacctgtcacgaccctaaatccggacccggtcgtgatggcacctctcatgaagacaaggccagccgacactttcttatttcagttttaagcaattaaacaataagaactaaatctaaaacgtaataaataatcccaaagtaagcagtgaatagtacaatgtagaagtaaaaccaacacagcccgataccggggtgtcactagtcatgagcatctacaatccggatgatacaagaaaggtctatatagtctaatacaaatttaaaacagaggaagataagataaaggaagaagctctaggatgcgaacgccgacaactacctagagaatcttcgaatccgcctgagctggaaaagatcaacactcgttagcgggacctgatgcgcttgaatctgcacacgggttgcatggagtaaagtgagtactccaactcagtgtgtaataatcataaataaagactgaaagtaagaaatcacataaggcacattataggctataaggaagtagtaaaagctagtaaaacagtgaagcagtaaagctgtataaaattaccgagttcagtttaaaacttcataaaatgcctttttaacaattaagcaagcaaatgacaggaaattaggaaagataaacatataaaggatcgcccctctggcacagtgtcaacaaatccaccctcgggcaatatctcagaaacaatactagcccctcgggctatatcttacatcacaatgggtacccgcgctcactaggtatgtgcagactcctggaggggctccttaaggaccaaccgcaatatcaagcactcttgtggcatcatcactaggccctcggccttatatcaacaagccaccttgtggcttacaaatctcaggccctcggcctcataatcataatcaggtgtttcctcacaacataggccctcggccttactcagtcaaaattatttcaagccactcgggcaatagtaaaacatgatgcttaactcaaaagatcatttaaaatctcatttaagtgttaaagtagagtaaacacgactgagttatgaaaacagtagaatatagcgtgactaggttcaagtataaagtcaaaacagtgagaaaatatcagtaaaaatcccataagtgttcaaatagttggcacgaggcccaattatggcattcagcccaaaacatgatgataacaaacagtttttagtcaaatacgtggtaaaatagtcattcgggacggactaagtcacaatccctaacagtgcacgaccccatgctcatcatctagcgtgtgcgtcacctcaatatggtataacgatgtgcaatccggggtttcataccctcatgacatcatttacaattattactcacctcaatctagtccaaatctagcccgcaacgcctttgcccctcgaatcgtcctccgctcgcgtcgaatctatccaaaatcagaatcatgatgtcaaaatatgctaagggaatgaagcccatacgaaaataatcaatatacaacacaaatcccaaaattaccaaaatccgacccccgggcccacgtctcggaattcgatgaaatttacatcaataggttccttacaatccccacgagttcatacatatcaaaagtaccaaaatccgaccacaaatagtccctaaaaccctcaagtctaggtctccaatacaagccctagtttccctaattttaacccttaaattccattaattacggctctaattcgtgaaataataccataggaacgagttttaggtccaaaatccttacctcaatgaagttcccttgaaatcattcttcaaaatcgtccaaaaagctccaaagcctacttagaaatggtggaatagctcaaaaatcacgaaggaaacaatttatatgttctggcccagggatttcgcatctgcggccaaattcccgcttctgcggtattgcttctgcgctcaagaccaccgcatctgcggtcctcacttaagtcctcattttcgcatctgcaattcactatccgtgcctgcgccatcgcaggtgtggttctccaaccgcttctgcggtttctgcctccctatctcctttccacttctgcggccccctttcatcgcatctgcggcatcgcacctgcggtccccaatccgcaggtgcggaaacaacagaagctgaaaatctgcatcttcaccacgaattccaaactctctgtcaaccatccaaaatcaccacgaggcccccgggacctcaaccaaaagcacaaacatatcctataatcttattcaaacttataccaatctttaaaacacctcgaacaacatcgaatcaaccaaaacacatcaaattcaagcctacgtttccaaaaaccttccgaattatgcttttgatcaaaaacccaaccaaaccacgttcgaatgacctgtaattttgcacacacataccaaatgacataatgaaactactgcgactttcggaattccattctgacccctatatcaaaatctcacctatcaatcgaaaaacgccaaaaatccaatttcgctaattcaagcctaaatctactccgaacctccaaaatacatttcgatcacgctcctaagtcccaaatcacctcccgaagctatccaaaccatcgaaactcacaatctgagccctctaacacataagtcaatatccggttgacttttccaacttaagcttactcaaaagagactaagtgtctcaaaccttaccaaatcctttctgaaccccagccaaccaacccgatcacatatagaaccgatagataaagaaataagaagcagaaaatggggaaaatggagtggtaactcaggagatactagtcggatcgttacatcctccctctcttaaataatcgttcatcctcaaacgagttaagaaccatacctgaagcctcaaacaggtgaggatatctgctccgcatctcccgctcagcctgctaggtcgcctcttccacgggctgacctccccactgcactttcactgaagctatatccttagacctcaactttcgaacctgacgacccaaaatagctactggctccacatcatagatcaaatcaccatccaactgaaccgtgctgaaatccataacatgggacggatccccaatatacttttcgagcatagaaacatgaaataccagatgcacactcgacaagctgggtggcaaagcaagctcataagccacctccctaatcctgcaaagcacctcaaaagccccaatgaaccgaggactcaatttacctttcttcccaaatatcataacacccttcatgggcaaaaccttcaacagaaccttctcgccaaccatgtaggacacatctcgaaccttcctgtcagcataacttttttgtctcgactgcgctgtacgaagcctctcctgaatcaccttcaccttttctaaagcatcctgcacccagtctatccccaatagcctagcctcacctagctcaaacgaaccaactggagatctacaccacctctcatacaaagcctcatatggagccgtctgaatactcaactggtttgttgtaataagcaaactctacgagagatggaaactgatcccatgaccctccaaaatcaatgacacaagcacacaacatgtcctccaatatctgaatagtgcgctcggactgcccgtccatctgagggtgaaaagttgtgctcaactcaacctgagtacccaactctcgctgcacaaacctccaaaactgcgaagtaaactgagtgcccctatctgaaatgatggaaactgggacaccatgcaatcgaacaatctcccgaatatagatctctgctagccgctctaaacaataagtagtacacacatgaatgaagtgcgcggacttggtcagccgatccacgatcacccaaatagcatcaaacttcttaaatgtccgtgggagtccaactaaaaagtccatagtgatcctctcccacttttactctggaatatccatccgcggaagcaagccacctggtctctgatgcttatatttcacctgctgacatttgagacaccgagctacaaatcccacaatgtctttcttcattctcctccactaataatgctgtctcagatagtgatacatcttcgcggtacccggatgaatggaataccgcgagctatgggcctcctccagaataaactcccgaaacccatctacattgggcacacatatctggcccatcatcctcaacaccccatcatcaccaatggtcacatctctggtatcatcatgatgaactttgtccctaaggacaagtaaatgaggatcatcatactggcactctctgatgcgatcatataaggaagaccaaaaaaccacacaagccaatacctgattgggctccaaaatatctaacctcacaaactgattggacaaggcctgaacatcaactgcaagaggtctctccccaactggaatatattccaaactccccatactcactgcctttcagctcaaagcatcggccaccacattggccttccccgaatggtacaatatagtaatatcataatcctttagcaactccaaccacctccactaccacaaatttagatccttttgcttgaacaagtgctggagactacgatgatcagtaaacacctcacaagacacaccatacaagtaatgtctccaaatcttcaacgcgtgaactatggcaaccaactccaaatcatgaacggggtagttcttctcatgggacttcaactgacgagaagcataagcaataactctaccctcctacatcaatatacacccaataccaactcttgaagcatcacaatacacggtatataaacctgaagctgatggcaaaactagcattggagtcgtgatcaaggctgtcttgagcttctgaaagctctcctcacactcatttaaccatacaaatgaagcacccttcggagtaaacttggtcaagggcggtgcgatagatgagaatccctgaacaaaccagcgataataacccgccaaaccaagaaatatgcaaatctctatggctgaggacggtctgggccaactctgaaccgcctttatcttcttcgggtcaacctgaataccctcactggacaccacgtgtcccaagaaagccactgaactgagccaaaactcacacttgaagaattttgcataaagtttctcctccctcaatctctgcaacacaactctcaaatgctccatgtgctactcctaactacgcaaatacaccagaatattgtcaatgaagaatttgacaatcgagtctagataagtaaggaacacgttgttcatcaagtacatgaatgctactggggcattggttagcccaaggtgataacctgaacagagatcaatcttgaagaacactctcactccctgaagctggttgaagaaatcatcaatatgaggcaaaggatacttattcttaattgttactttgttcaattgcctataatcaatgcacatccttataatgccatccttcttcgttacaaatagaactagcgcaccccaaggtgacacactaggccaaatgaacctcttatcaaggagttcctgaagttgcttctttaactccttcaaatctgctggtgccatacgatacgacataatagaaatgggctgagtgcccggcaccaggttaataccaaagtcaatatccctgtccggtggcatgcccggtaggtctgcaggaaacacatcatgaaaatccctcacaattagaacgaaatcaatactgggagtctctccaccgacatccctcacaaaggctagatacgaaagacaacacttcccaaccatacgttgagccttcaaaaatgagattactctactgggaacataatcagtcaaaccttgccactcaatctgtggcacacccggtatagccaatgtgactgtcttaacatgatagtccagaatagcatgacttgtagataaccaatccatgcccaaaacgacatcgaaatccaccatacacaataataaaagatctactagggtctccagatccccaatagtcactacagacaaccggtacacattgtctacaataatagtatcgcccatcaggatagatacatgaacaggtgaaacaagagactcacggggcatacccaaataacgagcaaagtatgatgacacataagaaaaggtggaaccaggatcaaataatatagaggcatctctagggcaaactgaaacaatacctataataacagcatcaaaagcaatagcatcgggtctagatggaagtgcatagaaacgggcctgaccgccatctgatcgacctccccctttgggacggcctctagatacctaacctccacccctagctggctgggcaggtgatggtgaagtaactcgtgctgaagccgatgactgactcctctgctgagatgaacccgcaagacgacgaggacactgcctccacatatgacccatctttccacactcatagcaactctcgagtgctggagaaggggactgaagggacccctagcaccggaatgactagtagatgcacctagcatagaagatccctgaactgattgagcacgagataaactctaagctagaaaggcactaagtgatgactggccctgatgagaactgtgagaaccatgactcgatgatgccccatgataacctgggcgagctggctgagcatgcctaaatggatgccctctgccgtgctgaaactgacctctcgaaggagcactactctaactaccagatcctcgaggcctcttggcatccctctcctctcgctcctagcaatgaacaaactcaatctcactagcgatgtctacaacctcctcaaaagtcgcaccagtcacactctccctggtcatgagagtacgaagctgataagtaaggccatcaacaaacctcctactcctctctctatcaatccaaaccaaccaaatagcataacgagctaactcgaagaacctcatctcatactacatcatagtcatctctccctgatgcaaccacttaaactacctacgcagctcctctctatgagactgcagcacatacttctccaaaaagagaacggagaaatgctgctaggtaaggggtgctgcaccaataggcttacgcctctcaaaagtctcccaccaagtgaaggatgttctagaaaactgataagtagtgaaagcgaccacgctggtctccagaatacccgttgtacaaagcatcctctaacacttatccaagaaaccctgggcattctcgccatctgcaccactgaaggtcggaggctgaagccaaccaaacctctccaacctatgttgttcgtcctctagcatagcaggaaccacatagtcctgagcagctataaccggctcggctagatgcatccccggtgtctgaagtccctgcacgacctgctcaagtgtgcaagcggcgggagtttgagtgcctcctctagcctaagaagtagttgtggctgtactgactgaaactgcctgagctaggccagtgcatactgataaaatctgagccaaggcctcctgaagaccctgaatcacaatgggcacaactggtgcctgagctagtgctgctggagcgtccacaactgggacctgatcctgaactagggcgatagaaggattttgcaggtgctgctctagctactatgtgggccacacctatgtccctacggtaaccacgaccgcatcctcggactctagtggccacgctggtggtgctggtggtcgtccatcttgactggtagcgcgtgtcctcaccatctatgagagaatagaataacataagtttagtactcggatcaacaaattcgcaagacaagaatttcaagaatatgaaggtttccctaaagattctacagcctctcgaggataaatacaaatgtctccataccgatccacgagactatactaaacttgctcatgactcgagagacctatgtatcctaggctatgataccaacttgtcacgaccctaaacccggacccggtcgtgatggcacctctcataaagacaagggcatccgacactttcccatttcatttttaagaaattaaacaataagaattaattctaatacttaataaataaacccaaagtaagtagtgaatagtacaatgcagaagtaaaaccaacacaacccgataccggggtgtcactagtcatgagcatctacaatccgtatgatacaagaaaggtctacatagtctaatacaaatttaaaatagaggaagattagataacggaagaagctctaggctgcgaacgccggcagctacctagagaatcttcgaatctgcctgagctggaaaagattaatactcgctagcaggacctgatgcgcctgaatctgcacatggggtgcagggagtaaagtgagtactccaactcagtgagtaacaatcataaataaagactgaaagcaagaaatcatataaggcacattataggctataaggaagcagtaaaagccagtaaaacagtgaagtagtaaagatgtgtaaaattactagttcagtttacaacttcataaagtgcctttttaacaattaagcaagcaaatgacaggcaattaggaatgataaacacataaaggatcgcccctcgggcacagtgtcaacaaatccgcccctcgggcaatatctcaaaaacaatactagccccttgggctatatcttatatcacaatgggtacccgcactcactgggatgtgcagactcctagaggggccccttacggcctaagagtaatatcaagccatctcgtggcatcaccactaggccctcggcctcatatcaacaagccaccttgtggcgtacaaatctcaggccctcggcctcataatcataatcaggtgtttcctcacattataggccctcggccttactcagtcaaaattctcttaggccacacgggaaatagtaaaacatgatgctcagctcaaaagatcatttaaaatctcatttaagtgttaaagtagagtaaacacgactgagttatgaaaatagtagaatatagcatgactgagttcaagtataaagtcaaaacagtgaggaaatatcagtaaaaatcccctaagggttcaaatagttggcacgaggcccaaatatggcattcagcccaaaacataatgatagcaaacaattttcagtcaaatacacggtaaaatagtcattcgggatggactaagtcacaatccccaacaatgcacgaccccacgctcgtcatctagcatgtgcgttacctcaatatggcacaacgatgtgcaatccgggatttcatacgctcaagacatcatttacaatcattactcacctcaatctagtccaaatctagcctgcgatgcctttgcctctggaatcggccttcactcgcatcaaatatatccaaaattagaatcacgatgtcaaaatctgttaagggaacgaagcctatgcgaaaataatcaatatacaacacaaattccgaaattaccaaaacccgacccccaggcccatgtctcgaaattcgaggaaattcacatcggtaggttccttatcttcccacgagttcatacatatcaaaagtaccaaaatccaaccacaagtggtccatcaaaacctcaagtctaggtttccaataccaagccctagtttccccaattttaacccttaaattccattaattacagccctaatccgtaaaataataccttaggaacgagtttaggtccaaactccttacctcaatgaagttcccttgaaatccttcttcaaaatcgtccaaaaagctccaaagccgacttagaaatggtggaatagctcaaaaaacgcgaaggaaacaatttatatgttctagcccagggatttcgcatcttcggtcaaattctcgcttttgtggtatcgcttctgtggtcaagaccatcgcatctgtggtcctcacttaagtcctcattttcgcatctgcgattcactatccgcacctgcgccatcgcaggtgcggttctccaaccgcttctgcagtttctgcctccctagatcctttgcgcttctgcagcccccttttattgcatctgcggcatcgcacctacggttcccaatccgcaggtgcggaaacaatagaagcagaaaatctgcagcttcaccaaaaattccaaagtctccgtcaaccatccgtaatcaccccgaggcccccaggacctcaaccaaaagcaaaaacatatcccataaccttattcaaacttatatcaatcttcaaaacaccataaacaacatcgaatcaaccaaaacacgtcagattcaagcctaagcctccaaaaatcttccgaattacgtttttgatcgaaaacccaaccaaaccacgtccaaatgacctgaaattttgcacatacatcccaaaggacacaaaggaactaatgagactctcagaattctattttgacccatatatcaaaatctcacgtatcaatcgaaaaacgccaaaaatctaattttgctaattcaagcctaaatatactccggacctccaaaacacatttttatcacgcttctaagtcccaaatcacctctcgaagcgatccaaaccatcggaactcacatccgagccctctaacacataagaaaacattcggttgacttttccaacttaagcttcctcaaaagagactaagtgtctcaaaccttaccaaatcctttctaagcccgagccaaccaacacgatcacatatagaactaatagacaaagcaataagaagcataaaagggagaaaacagagtggtaactcatgagacgactggccgagtcatcacagaaccagttctaactcaaaaatttggttagaaaattatgaactttgtacataattaaattagattttgctcattctcatacattcataagtatactcttgtgccatgtgctaatatgacttatctctaatgatattatcgctattttcttgggaaattcaggtttacacaagagatttttcaatgaagaacccagttcatcaagattatttggtacgtattctctactctgcatagtttgaaataattatatttatatcatgtttaagaaaagattcccattcaatatcaaaccccactgtacttatacattacaaaaatggactagtttgttcaaaagaggagtccaaactgcattaaatgcctagattgtagggaacctttccaatgtcttgtcaaacaggaattcagtttgattagacttctgagagactgtcgctacccaattaaacactcctctttaaattgattaggcttagtgtattcttcacttaaactttttaattcattaatctactcttcatcttttctcatcttcgaaacacacttaaactttcttttcttacttccaagcacagaaatggataacatctctgataatccctcttcaccacccaaggaaaacttacccacaccatatgatacaccttcaactactcccatctctaataaaggaagggtaaaaatgatggctcgcaaggttgttgttggtggagagcaaattaataaaatcaatgaaaatttgaaagcaaatagggaagaagaaccccaaaaacctgatgagtcattcaaatctacaactaagggggaagaaacagttccttctgagtgtgaacaggtaacgtctagccccaaagttaatcttgaaactttttttgtggttgctatgaatttgaagaatacgtttgttcttgtaggatataggccaggtgttgaaagtactaagtctggaaaggtgggtggtaaaaataaaaagagaaaagataaagagagagagggttatcgaagtactgtaaggggaatgggaaaaggagtgactgaatctttacgcactcatgttggtctaactaaagagtcaggtgctatggtagtttagggtgaggaatttgttgaaatagaggagagtctgagaaaaatagagggaagtgggtctggagaagttgctgaggggctggttcaactagggaaaatgtagatgaacctgttccatctgaacaggagtccctcacagacctactgaaaagagtgattgaaagctacaatccaaagaagaaacgaagtctaggagttaaaacccctggcaccactagagccaacaagaaaaggaaggttgtttattccatccctgtagaaattcctcccacaaaaggaagatctgctaggagttagaagaagcagagtgaggctgaactggacaaagccttagaagaaagtaaaagaaaagttgctactaagggcaagaaggagatggttgagcctgttgaggttgtttaaatttatgagatagacctggtccttcaagatgaagatgagatagaacaagtggagactgtgactccaaaagctaagataggcaagacttctacaaagaagtctacttcaaatacaaagtctattgttccatccactttgtctaaaagaaccaggttttctatgaaatcaagaaaggtaaaaatggtggaggaagacgaacagagtggagaagaagaagaagaagatgatgaagaagaagaataagaatccgatgttgagaaggacaagatggttaagcttgggaagagaaccatcttgaaaggtaggctgcttatcttcccacgagttcatacatatcaaaagtaccaaaatccaaccacaaatggtccatcaaaacctcaagtctaggtctccaataacaagccctagtttccccaattttaacccttaaattccattaattacagctctaatccgtaaaataataccttaggaacgcgtttaggtccaaattccgtaccttaatgaagttcccttgaaatccttcttcaaaatcgttcaaaaagctccaaagccgacttagaaatggtggaatagctcaaaaaacgcgaaggaaacaatttatatgttctagcccagggatttcgcatcttcggtcaaattctcgcttttgtggtatcgcttctgtggtcaagaccatcgcatctgtggtcctcacttaagacctcattttcgcatctgcgattcactatccgcacctgcgccatcgcaggtgcggttctccaaccgcttctgcggtttctgcctccctagctcctttgcgcttctgcggcccccttttttcgcatctgcggcatcgcacctgcggttcccaatccgcaggtgcggaaacaatagaagcagaaaatctgcagcttcaccacaaattccaaactctccgtcaaccatccgtaatcaccccgaggcccccaggacctcaaccaaaagcaaaaacatatcccataaccttattcaaacttataccaatcttcaaaacaccttaaacaacatcgaatcaaccaaaacacgtcagattcaagcctaagtctccaaaaatcttccgaattacgtttttgatcgaaaacccaaccaaaccacgtccaaatgacctgaaattttgcacatacatcccaaaggacacaacggaactaatgagactctcagaattctattttgaccacaatatcaaaatctcacgtatcaatcgaaaaacgccaaaaatccaattttgctaattcaagcctaaatatactctggacctccaaaacacattcttatcacgctcctaagtcccaaatcacctctcgaagcgatccaaaccatcggaactcacatccgagctctctaacacataagacaacattcggttgacttttccaacttaagcttcctcaaaaaagactaagtgtctcaaaccttaccaaatcctttttaagcccgagccaaccaacacgatcacatatagaactaatagacaaagcaataagaagcataaaagggagaaaacagagtggtaactcatgagacgactggccgagtcatcacagaaccagttctaactcaaatatttggttagaaaattatgaactttgtaactaattagattagattttgctcattctcatactttcataagtatactcttgtgccatgtgctaatatgactcgtttatctctaatgatattatcgctattttcttgggaaattcaggtttacacaagagatttttcaatgaagaacccagttcatcaagattatttggtacgtattctctactctgcatagtttgaaataattatatttagatcatgtttaagaaaagattaccattcaatatcaaaccccactgtacttatacattacaaaaatggaccagtttgttcaaaagaggagtccaaactgtattaaatgcctagattgtagggaacctttccaatgtcttgtcaaacaggaattcagtttgattagacttctgagagactatcgctacccaattaaacactcctatttaaatttattaggcttagtgtattcttcacttaaactttttaagtcgttaatctactcttcatcttttctcatcttcgaaacacacttaaactttcttttcttacttccaagcacagaaatggataacacctctgataattcctcttcaccacccaaggaaaccttacccacaccatatgatacaccttcaactactcccatctctaataaaggaagggtaaaaatgatggctcgcaaggttgttgttggtggagagcaaattaataaaatcaatgaaaatttgaaagcaaatagggaagaagaaccccaaaaatctgatgagtcattcaaatctacaactaagggggaagaaacagttccttctgagtctgaacaggtaacgtctagccccaaaattaatcttgaaactatttttgtggttgctatgaatttgaagaatacgtttgttcttgtaggatatatgccaggtgttgaaagtactaagtctggaaaggtgggtggtaaaaataaaaagagaaaagataaagagagagagggttatcgaagtactataaggggaatgggaaaaggagtgactgaatctttatgcactcctgttggtctaactaaagagtcaggtgctatggtagtttaggttgaggaatttgttgaaatagaggagagtctgagaaaaatagagggaagtgggtctggagaagttgctgaggggctggttcaactagggaaaatgtagatgaacctgttccatctgaacaggagaccctcacagacctactgaaaagagtgattgaaagctacaatccaaagaagaaacgaagtctaggagttaaaacccctggcaccactagagccaacaagaaaaggaaggttgtttcttctatccctgtagaaattcctcccacaaaaggaagatcttctaggagttagaagaagcagagtgaggctgaactggacaaagccttagaagaaagtaaaagaaaagttgctactaagggcaagaagaagatggttgagcctgttgaggctgtttaaattgatgagatagacctggtccttcaagatgaagatgagatagaacaagcggagactgtgactccaaaagctaagataggcaagacttctacaaagaagtctacttcaaatacaaagtctattgttccatccactttgtctaaaagaaccaggttttctatgaaatcaagaaaggtaaaaatggtggaggaagacgaacagagtggagaagaagaagaagatgatgaagaagaagaagaatctgatgttgaaaaggacaagatggttaagtttgggaagagaaccatcttgaaaggtaggctccttatcttcccacgagttcatacatatcaaaagtaccaaaatacaaccacaaatggtccatcaaaacctcaagtctaggtctccaatatcaagccctagtttccccaattttaacccttaaattccattaattacagctctaatccataaaataataccttaggaacgagtttaggtccaaactccttacctcaatgaagttcccttgaaatctttcttcaaaatagtccaaaaagctccaaagccgacttagaaatggtggaatagctcaaaaaacgcgaaggaaacaatttatatgttctagcccagggatttagcatcttcggtcaaattctcgcttttgtggtatcgcttctgtggtcaagaccatcgcatctgtggtcctcacttaagttctcattttcgcatctacgattcactatccgcacctgcgccatcgcaggtgcggttttccaaccgcttctgcggtttctacctccctagctcctttgctcttctgtgaccccctcttatcgcatctgcggcatcgcacctgcggttcccaatccgcaggtgcggaaacaatagaagcagaaaatctgcagcttcaccacaaattccaaactctccgtcaaccatccgtaatcaccccgaggcccccaggacctcaaccaaaagcaaaaacatatcccataaccttattcaaacttataccaatcttcaaaacaccttaaacaacatcgaatcaaccaaaacacgtcagattcaagcctaagtcttcaaaaatcttccgaattacgtttttgatcaaaaacccaaccaaaccacgtccacatgacctgaaattttgcacatacatcccaaaggacacaacggaactaatgagactctcggaattccattttgaccaatatattaaaatctcacgtatcaatcgaaaaacgccaaaaatccaattttgctaattcaagcctaaatatacttcggacctccaaaacacattcttatcactctcctaagtcccaaatcacctctcgaagccatccaaaccatcggaactcacatccgagccctctaacacataagacaacattcagttgacttttccaacttaagcttcctcaaaaaagactaagtgtctcaaaccttaccaaatcctttctaagcccgagccaaccaacacgatcacatatagaactaatagacaaagcaataagaagcataaaagggagaaaacagagtggtaactcatgagacgactgaccgagtcatcacagaaccagttctaactcaaaaatttggttagaaaattatgaacttggtacataattagattagattttgctcattctcatactttcataagtatactcttgtgccatgtgttaatatgactcgtttatctctaatgatattatcgctattttcttgggaaattcaggtttacacaagagatttttcaatgaagaacccagttcatcaagattatttggtacgtattctctactctgcatagtttgaaataattatatttagatcatgtttaagaaaagattaccattcaatatcaaaccccactatacttatacattacaaaaatggaccagtttgttcaaaagaggagtccaaactgcattaaatgcctagattgtagggaacctttccaatatcttgtcaaacaggaattcagtttgattagacttctgagagactgtcgctacccaattaaacactcctctttaaattgattaggcttagtgtattcttcacttaaactttttaagtcgttaatctactcttcatcttttctcaacttcgaaacacacttaaactttcttttcttacttccaagcacagaaatggataacacctctgataatccctcttcaccacccaaggaaaccttacccacaccatatgatacaccttcaactactcccatctctaataaaggaagggtaaaaatgatggctcgcaaggttgttgttggtggagagcaaattaataaaatcaatgaaaatttgaaagcaaatagggaagaagaaccccaaaaatctgatgagtcattcaaatctacaactaagggggaagaaacagttccttctgagtgtgaacaggtaacgtctagccccaaagttaatcttgaaactatttttgtggtttctatgaatttgaagaatacgtttgttcttgtaggatatatgtcaggtgttgaaagtactaagtctggaaaggtgggaggtaaaaataaaagagaaaagataaagagagagagggttatcgaagtactgtaaggggaatgggaaaaggagtgactgaatctttacgcactcctgttggtctaactaaagagtcaggtgatatggtagtttagggtgaggaatttgttgaaatagaggagagtctgagaaaaatagagggaagtgggtctggagaagttgctgaggggctggttcaactagggaaaatgtagatgaacctgttccatctgaacaggagaccctcacagacctactgaaaagagtgattgaaagctacaattcaaagaagaaacgaagtctaggagttaaaacccctggcaccactagagccaacaagaaaaggaaggttgtttcttctatccctgtagaaattcctcccacaaaaggaagatctactaggagttagaagaagcagagtgaggatgaactggacaaagccttagaagaaagtaaaagaaaagttgctactaaggacaagaagaagatggttgagactgttgaggctgtttaaattgatgagatagacctggtccttcaagatgaagatgagatagaacaagtggagactgtgactccaaaagctaagataggcaagacttctacaaagaagtctacttcaaatacaaagtctattgttccatccactttgtctaaaagaaccaggttttctatgaaatcaagaaaggtaaaaatggtggaggaagacgaacagagtggagaagaagaagaagaagatgaagaagaagaagaagaagaatccgatgttgagaaggacaagatggttaagtttgggaagagaaccatcttgaaaggtaggctcctcaggaacttagaggaggaaggaatggtaatgcttctggagaagttacaggtgcaaggatggaaggacatggtctttcagatgatggaaggttggccataactgatattgtgcagtttatggcaaattgtgagatcaagatggtagggtcaccagtgtggtaaagggtgatggtgacttttgatgagaaagagctgagagagatcttggggtgcattctaaaggatacaatgactataagaagctcaaatggacaagcctagagaatctccctactgcccttgccagtactagaaaattttgtgacaatgaggaggaaattgagcccaaggctatttacaaaaatgagatgaagccacccaacaaagtgttgctccaatttgtaaacaaatgtgtgctgccaaggtaggaaaggaggcacatttccacattcatggacctggtccttatggaatgtttggacaataggcggcaaataaattggcctgggtctaaaattcagcttcttgacagggttctaaatggaactaagacttatgtcataccctatggttttattctcacgattgttcttgcacatttaaaggtacccatcaagaaatgggaagttggtacaaacaaggatcattttggggctaacactttgactgcttgtaactatgaggctcaaatcactcccaaaaaacctggttcatccaaaaaggtaccagtgaatagcaaagtgcgagttttggtgcaagaaagtagggcaaaggatgctgagcctgataggctaaagaagaggttggctgaaatggagaccgagagagatgctctcagagctgagcttgcaaaagagaatgagaagaattagggcattcttcaggatatgctgaaactgctccaagccaaaaaccaagaacctggtccttcccagccttaatcctcctaacctactgtagatcaaccagtgacccagcttaggatttttttgtttcttttgctcatgatccaatgttcttattctttttatgctttgtagtaggatcttatcaatcaatgaaatttactgccttttgctctagctgtttgttgatatttcttagatgactaatatccttagatttatagatgatgcttaaatctatgattgcatttgaagtagcctagtggccatgattaatttctatttaaatttggttatctcacataattatgcaacttttcgatgatgccaaaggaggaattaggttgtgctttttctttggactgtgatgtttataacctaatgaacctggtccttgataataagtgataaaatgttctaacattgtgttgatgttgagctgagttgaaacagggcttaagcttatgaaaagcacagattttgtcatcatcaaaaagggggaatttgttggcccaaataaaggtttgttttgaagattgacaaaggaagatcaggcatgaaccaggaccccttatgaacatagacacgggcagatttgagtatatgagatgcatgtgaaggagataagtttaacttggtatatttgatatctcctgatcaaaaagattacataattgataaggagaaggactccttactcaaagagaacactatccaacataagaaaggagataggggttgaagttaactagaactcttccaccaaggaagagtagcattagaactctagttattttctactctactaactctataaatcgcatgatgttctcactttacaggtgatgcacacatactgaagttaagaatgaaatgagtgcaaaatagcaaggcattttgtgagcaattcctgtgagttttaagagtgagatcctgaagctacacgaaccagattgaaaaaccagctttataaagagttttatgtgtctttctttatttttagttcaaagtgtagtatgcattttgagctgtaccttttagctttcttagaagcaaattgtactaggtacttgagttgtatcattcaagttagagttaacttgaagtagtcacaacagcttgtagcatgttgctataagagttagagttaatccttaggtttgcaaaaggttgtaaactcgagttgtattattcaagttagagttaacctgaatcagtcacaacagcctgtggatggttgctataagggttagaattaatccttaggtttgcaagagtttgtaaacattgttgttggctctgagttgtagtaaagtgtttagagaaaatcctactgggtagtaggtcgtgattttttcaccttttgagacgggtatttttcacataaatatctttgtgttttttactttctgcatttattattctgcaatagtagtataaagaacacatagaagaactaggtccttttataatctggtgcacgcaaaaaattagacaccacataaatcacctccctcttgtgtggtattgaagtataaaacatcaattggtatatgagtgggttatccttgaagaggctaacactaggatttgaacattctgggtgccataaattttgaacgtagacatatcataatttatatgctccaaatagggtaacatttagtcggttttatctatttgtatttctctcacgacctggattttccaccatcgggagttgtaatggcgcctactagtgaaagctaggcaagccaaccattgagcaatttacctttttcccatttttaatactttaataatgataaactaacagtttataaacagcgaaatttaaataagcggaagaaaaacaaataaaatcatttaattatttccaatacaatttcttaaataaggactacccagaactggtgtcacaacttcacagacggtctaggaatacaataatcaaggtctaaaaaataaatacaacattgtttctgaaacacgtaaatgaaacatgacaaaaggatagagggagatgccagggcctgcggacgcctgcaggactatcttggatctctgtatggactgaaggcagcaacccaaaagctaaggtccaaaagttattgcgtcgggatctgcacacagtgcagagtgtagtatcatcacaactgaccctatgtgttggtaagtgcctagcctaacttcggcgaagtagtgacgaggctaggaccagactaccaaataaatctgtgcagttatatcatatatagaggaaaataacagtaggggtgtacagttaagaatgggagggggaacatgttgcgtggaaacatcaaatgataatagaaggacaacaggtaattacaaggaacatcataactcaattatcaacaagaatcagaaatcaaacaagtgcacgatatcacccttcgtgtttttactctcgtcctcaccataagagtcaatataatgtacacgacatcactctacatgcttttactctcatcctcaccataaaattaatataatcggcactgaattgtatatcgtgcggcacggcatcacccttcatgcttttacactcttcctcacaaaaattatacacggcatcacccttcgtgctttaacactctctcaccaaaacaatgtacgacatcacccttcgtgctttactcttcctcacccaatcaacaatcataaaaaataatggaaaggaaataaatgaaatcataataaaatcccagcaaggaaataatagtacacaatcatatcctggcaaggaacaatatcaagaacatcaatatcccggcaagggagatagcactaaaagcaacaacatctcgacaagggagacaatataataatcctcttctctttttcacgtttacttcacaactcactacacaacttgagccaatgctctattaggttcaattactaattttacttccacaattcttttacaacttgagccaacactcctcaatattcaattaccaacactacttccacaagctttgctcaacaatgaaatcatcattaaaggcatgaacaatacaaacaaagtcataataatcataatataagactcacgggcaagcttgacaccaaggtgtagatactctgtacgcggcaaaatcagaagacttgatttctggctgtcgagtcatttcggaagcatgccttgggaccccgaggatgggaggccacaatcgagttcccaacctcggggctcattgaagcctgactcataagaaatggagatcgaagccaggacagatggggaagctcccaaggcacacgactaattctgacagggccggcctatccagagcctatgttgaggcatcacgtcaagccatcatatccccatactttgtaattaatctctacatacttgtagtcgagtcccccctcttatataaaggggactcatcctaccttgtaagggcctgatgttgctccatttctccacaagtgcaataatatatctctctcttttctttctagcttgttcatcctcactggcccgaggccgctttaatatatatcgtccttttacttgttcttcaatatatagctcattattggctgaaaagagccttgcttcatcgtatccttaattgttatcccattcctggctgcccccgatagctcgagcccgactcaaacctcgaccccgaggtcctctctgaccggtcctgcatccgggcaacaggccccttcggtttctttactgcctcattttagctcacacttcatcgttaaacctcacaatcttagcatcatctgctctaacaactagctcgagatcatgtatttttagaatctcatttacaaatttaattgttgttaccattttcacggtaaacagtttggcgcccaccgtagggctaaaaataatagtgattattttattgctggttttattgcacaaatacacactatctttcacactttttcttgtccaagatcctttgatttcaggttaaaatgtccggctcggtaagcaaagtcgagaatgactaccccaaaaatcacgacgaaaatggtatggctgttccagtggctggcgtgacaccgcagtaccccgataacacatctggatcaattcaagcggacgcgggcttgcaaggcgcacaataggtcgatgaagcctcgcgcaccgatggtagcatacaacatatcgaccaacaggaagctcaaaaacccccggcctgggaagaataggaagttagtattcatgttatttttggaatgttgcaggcatagtagtttgctatcgctcagctgcaaagccacccagagactcccagcgtagtagccccgaaaacatctccctacgccgagcgagtacccgggagatcaagcaacaacggatcggtaaccgaccccaggatgcttgggaatctcttcgaaaggatcgagtcaggttcgtggaagttcttacagcaaccgtctcctaaggaagcggtcccggaactctcttcacggaaatctggaacgccaaaactccctaggtgcgataggaccttgggtccctacgagcgcaccaccgcttacacgtgcttattcaaaggcagagacctccataatgatgagtgtgagtctgactcattgaggaagttcgaggaaacactctcgaaaaaaaccttgatgcagcaccgcagcctggcacctggcctcgcaaactcgcttaccatatcagcagaccactccacgggagcacacaccgatgttatcgaagcagtaacaaaagggctcgacacacctggggctagacaaagagagagtgaagcactacaagaagtcgcgtctcgttccctgttaggatgaatgagatcgctcccggtttcggatgactggacaacccgggcctccgcccgaaggttaaacgaaatatgcccgacgactccaggacatttcaaacaaatcctgaccagatacccagtcgagatatggtcggatacacgcacctgacactatccacggagcagggccgtggacttccgtccaggaacctcctcaggtttggtatgccgacaaagaagatgatgccaaacaaatggaggtaccctccatgcaccgcgaatggaaggaacgacatgagttgttacttacctcccaatgatagagaaatagctcgagggaaacatccccgagaaatctccaatggaaccagatttgacaaggcacagctagcaggggaaccccgctcagctaagtacaatttcaacattgctttaccgaacatcatgatcaccttaagctaaaacaagaacgataggcgactcaaacctattctaccaagaccccttcaaaagaaccatagcccgacgcagaaaccgtagggcgcgcacagctacggagtaaaaaatggccacccgctcaaaagaacgacaaccgtgctattcaataaaaatcaccaccgagtatcgtcgagcggtcaggctcgaatccaactccaagggaggaaggagaccgggaagaatgaagatgacaagccacgatgtattaccacgacagtgaaggggcggcgacacccttcaaaggccataaaatgtaaagtgaaaatgctcatcaccggggaaacactggtctggggaatattccaaaggacacccttgcttccaaggaaagggacgccgagacttcgcctcggcctcgtattgatgtgttggtaaccctctcactcatttgacctattccaaataaaacatgtgttcatgaatacaggttgttcaattaattataccaacgatgtcaaaccaaagccaatggggcgattcggactaacgaaccaagtcactcccacatctcgaatctttgacagattctaggcaccgatcgccacatcaggaagaccactcccttaatacaacccgtatcagctcggactggaatgccgaacacgcaaggcacgtacgtcttattcagatgacaacgggcacgcctccccggaggcaacttcgaccctactccaccaaatggatgaaaccccaggacaagggtgggactaaagtattcgacaaggagctgcacacgacgagaggaaaaccctcaccatgtaacgcatcgccggcatcaatacgtccgccctcaaaaggatcaaagggtaagcagaatcgcatcttctgctaagcttggttgaacacagcagaaggctgtattagggctcgtgcctcggaacagcagaaacatcccgaacctcgaaaggttacctacgcaccccgcggtgaggaggaactacttcactccttcattattttttcactaacttatatgcaggcaatcagccggggcattcgaaagttctaactccacacggagatccaaggccttagcagggcccgttgtgctctattccctcgatcagactttagacccaaagagggtcccgccaaaaagattattagcagagcagtgtacccccaaagagggtcctgccagcaggatacgacaaaatcacatgccttcttctacaatcgaacgacgggcgatgatcttctttcaagggcaccattccctcagaaggaccgaaaatatcagactgagtgtcaagagggaaccttgtaacgaatcagatggtccgaagagtcgtacctacgtgggccgagctcacaacgacgagagaacatgtatttacaacatatatttatgacaagtaataaagaatatcttttcggcatttcgtacttcggaaaaggggatttcaacatactcatggcaagggcctctctaccgaatgcatcccgagatactcggagacttagcatcagcaattcaatacccgcacgaccccagggttagaactccgggctcaacaagcccctacaaggcaactccgagctcatgaggagcggtcttcaagcttaaacaaattatatgactcagagactgccattgatcgtcatatgctggaaaaatcgaaactgtgagacccctagcaggcagcctcaacgtaaccagatctattatatattacacaaactataagaccttaacaggcatgataaactgtaagacctcaacaggcatgacaaactataagacctcaagaggaatgattaactgtaagacctcaacaaacatgaaaatcctgaagtttaggttatacgtcgcatgtgtaaaaatccctaaagggcataccctcggtgtagacacctaaactatcaatcgggattaaaaatggctacggccaaacgcacatgactatgatcaaaacggttaatacagccaaaataacatgactcggggacacccgactgttactaaaatctcaggacactactccaaatatacttcgaaaagaaccggttaaaatagggttcccttaacaggcaaaaacgaaccccgaccatgtcgactccaaaccgccaaagtgttgatctactcaacctacgagctatgaaccttttgaggtgctcaaaacatcgccgacaacgacttgaaatcgaagttcctctagaaccgaagacgggtcaagcaaaaatattccaaaagaccttaacgagcagaaaacaaagcctacaaaaaagcccacaggcaaaaacagcgtaagagccattgtcgccatctaagcaagcctccgggccatatattaaaaggtctctacgaccaaacagcgtaagagccattgtcactagctaaaatttgacaacttgaggattaaaatgagctcaaatcgtaacccggttcagagatcggatccaaaatagttaactatgcaaacctccgagccacatattgaaaggtctcaacgaccgaaatagcgtaagaggcactatcgtcagtctgaaaaccagaggtacttaagggtcaataaaagatcaagtcacaacgcgactcggaggcttgacccggaataattaaactacaatatgcctaagggcacgacataaatgccactatcgccagccgagcaaatctccgggccatgtgccagtaaggtcatttcgacccggagcacaaaaggccatcatcatccgcctatgcaggcaggaaagagcttgagggtcaattgaagctcgagtcacagtacgactcggagactgaatccaaaatagtcgaaacggcaaatgcccaagagcaagaaataaaaataattaatgcctgcccgagcgggcataaaagattcaagggcaaaaggcttgagacgaagcccgactcagagactaagcctaaaacagtcgggccaagcatggaggccccagcaccagctcacgtaagggattacacttaagagcccctaggtctatccgaccagttccggacctacgaggatcccgccaaacaccaaaaccggcctgcccagtcgaaaagcaataacaaaaaagaggtacagaaaaaataaagcttcaagtttcttcctacatattatatgcgcgaaaagggcgcattctccatctacaagcatgctctacatatatcagaaacaaagcgacaaaatggcgaaatctacactccgcactaaagggctacaacttgtcaaattctccctccgcgacgtcagcaagaagttacagagcgtcgcgctcatccacccttgctcgagccaattctttcgagagaacgaagccccgtacactggcctcctcgagtacctctctccgagatctgcaacgaacatactcctcgatcctcttctcccggtcgagggctcgctttagctcagcttgggcatcagcaacatccttcatatgaatcgccatctcctgatcagccttggtccggcttagcgccactttagcctgggcattaattatctcagctctgaccttcaagagatcagattcgagtttcccaatcatgtccgcttgaactttggcgttatcacgagtcaagcagagttgggcctcgatggcagggaccctggctgaggcacatatctcctctaaagctcaagcttgctcttgagcccttagctccccacaaacaactctgacgcggttgacgtcgcctttgaggtactccaaggcctctgcctttttttgcagctgatataacaaaaggggtgagccttaaggttagagaggagcaaagcgcatactatataaagttacctgctctatcaaacaactctcatagtttgagctctgatacgcctcatatcgccaacgtgccaacttagccccattctcttggctaaggagcctaaaggactcgccatcgttcaagaatttctggagcctggccccttgacagagcagcttagacataagcccatcacaggcctatgcaaggaaaactcaataaagggaggagggcgtgacatacaggaaaaaacgcgcctaaactcacctcgaagagaagccgatggacttcctctaagccagaacacattcctgttgatcctgcctctccggccccaggagaaccaacctcgggcagagcatattcactcggaggaatcgccgcccgggaatctgatactccgggaacatcaggctcagacgatgccctctactcaaagatctgagcccgcccaatgccactaaaagctccatcacaccgcgggtgccgatcccccttatcaccatcctccctcggcttggaggctgacgactctttctcctcttcggaagaacactgtctcatcccaaacaaccgccctgtatctacaaacggtgaatccagtacaaatgaaaggggaaaatattacctcgaatatacgaaggccaagtcaaaggcaacatacgcacataccttggtatttcactccccatttggtacgaaatacagctcgccacctgcgctcgtcgcaagtcgaatgggtcgccaacttatggacccagacgggaaggtcaaggactttgcccggcatccacgaagttgctgcaacaaggtagacaacattattactcaactgattttcgctataggcaaaatttaaaaaagcgccagacactccactcacgtgcatgattccacccttcaggaaatggcaaaagccctgttgggataatgtcagcagtttgagcctgaataaaccaactggcccactctcggtccttgtcttcttcatcatcgacaacaaagggcgtggacaaacggcacctcagagttagcaggcctcgataatgaaatggccggtatagtctaacgaggtgattaaacgtgaattcgagcccaaccttctccacgaagaacctcattatcattaccattcgccgaaacgatggataaatctgcgccagagtaactcgatacttcaagcaaaaatcaagcacaaccctagcaggggggccaaatgcgaaagggtataggtatacgctcaaaactccatcagtggagtctgtaatacccttatttggagaaagcacctgcagtgttaccccctcgctccacccgcagtaattcctcaccatctccaggtgttcccctcttatcaaggatgccgtcttcaaagcaaactccttcggttcttgagcgctgggagcaacacccccccccctgttccctgccgaatcggccctgaagtggtttccatgactatggtaaaactaatagttcaaagcaagggcgtgcaccagcactttttatgcctggagagatgaagtaccctgtgccaaagcaggaaatcgtctatctaaaaatagtgaggtcttgcgaagaagccgaagccgccccacatatatgcgagaagcagcgacgactcgcctacccgatgcgagacccggggagccgacagcctcgatacagatcgacaaatcgatacccaatctagatagaatccttcaatgagaagtcaagacccgaggggccatccatattatctccaagctcgagacaacatcctacctcgaggatccctgacccaaagaagtcggacttcgggaagttttgtaacaccagcactcgatgcagggcaagtacctggtctcgtgattccctctttctaaaaagaggaataaatgtaggaagctccaatctcgaaagctccacaaaggtctgaggcagcaggaaactcctcagcataagtctatcctatacgctttaaaaaagggagggctatctacatcaagattaaaagggaccctcgggtacctgaagctgaccttcatttaggataacattcccgaaggctccaaaattcgacgcattatctccatacagctcgaagggcctcggtagcccgggcctatcaaatcaatctgggattggtctgaagtacgacgatgagttcgaaagagagccatgtcgatcagtagaggatcggaaggaatgtccgcgcccaagtcacatatcagtagtcaacgaataaaagaaggcattcaaagggcctcaaagggcatgagatgatacagaaacaaagtaaagatctaaagcaaacgtcactggagtatattccatttcataaaagatccatttacaacaaccctcaaggggacattacatacaattacaaaatcctacggaggatctctgcgcctaaaagaagagacaaagggatgcacacgccaagtgaaagcccgaaagactggtccacctttgaactccgcaacaggtgcctccggacgtgcatcctcgaaagtttcatcccaaccttccacactgatatccccaagggacaaggtgagtggcggggagggatgaaaaaatggcatagctctccgaaactcgaggaccctctttggccaagggaactctggagtgacatcggaccaaacaaaccttgatcccgcttgcacgactacttagaatccacttcttggaacgtctagccatgcaagcccccaactcggagcggagcaccacatcgagctagggtatgaaggtgagaaacggtgtttaatccgagcccccttttgagcagcggtgcataatccgaatgactgtctacacgaggggaaaattgaccccccttccatcatcatctcgggccaacaacaatagccacagtgaatatgttaacggccacagtagtagcgggacaacatggttatgctcaacgaagggaagcccctgcaaaaggccacgacacagtctaaggaaactcctccaaaaggacttaaggtcatgagcccctagcatgatgttcaagggtgaaagaagatgataagaagaaataggcaagcaagccaacggaggcactgtgataggaaaagcaaagccaaggcacccccatttatagggggttacaacacgctcatctaggctttggaagattgactgacgggcgcagtcaatgcatccatggaaaaccaaaccaacagtggtaccttcaccttgggaagtgagaattaggagtacaatgaatgaggtcagaaatcacgagctcgtggatgtccggttaccacaaagctcacgaccagagtcgcatcatcgatatggcatcgccgaaagaagctcgaggagtcgagtgtcaaaatcatttcccatcacttcataataggaaatgcggagacaatctatacacagcaaaattagaagactttatttctcactgttgagtcatttcggaagcatgcctcgggaccccgaggacgagaggccacaaccgagttcccaatatcagggctcgttgaagcctgacttagaggaaaaggagaccgaagtcagtacagagagggaagctcccaaggcacatagctaaatctgacagggccggcctatccagagcctatgttgaggcatcacgtcaagccatcccatttacatactttgtaattaatctccacatacttgtagctaagtcccccctcctatataaaggggactcaccctaccttgtaagggactgatgttgctctatttctccataagtgcgataatatctctctctctcttttctttctagcttgttcgtcctcactggcccgaggccactttaatatatatcgtcctcttacttattcttcagtatatagctcagtattggctgaaaagagccttgcttaatcgtatccttaattgttatcccattcccggctatccccgatagctcgagcccgactcaaacctcgaccccgaggtcctctccggccggtcctgcatccgggcaacagaccccttcggtttgattactgcctcattttagctcgcactttatcattaaacttcatgatattagcattgtttgctctaacaactagctcgagaatagatcacgtatttttagaatcccatttacaaatttaattggtattaccattttcacggtaaacatactcgtcactatgtctatacgtcgtactcaacaaatagaacatagcaaataggacacaactcctaatccctcaagctaaggttagaccaaacacttacctcgatgtcaattcgctcgtatctagccacaagttacttaactatatccataaatgctaaatgaatcaattccaatacatgaaaataggttttctaaagtttttcccaaaaagtcaaaaatcgcctccgagaccacatggtcaaaatacgaggttcgaaccaaaactcgattaaccaatcccccacgaacccaaatatacaatttgttttgaaatcggacctcaaatcgaggtccaaatccccaaaatttgaaaaacctaggttttaccaaaaatatccaatttcccccatgaaaacccttgattttgagttgaaatcatgagaaaagatgttaaagaataataaaacaagttataaatgacttacaatcgatttgcaagagtatttgtctttgaaaaatcgcccaagagagtttatgttttgaaagggtttgaaaaatggttgaaatgcgtctaagtaatgaatttgcaggtcgcagatgtcgcaattgcgacaagggttcgcaattgagaacccttaaggacttgctacactcgcatttgcgaccattgttcgcaattgcgaaatcgcatttgcgatggggaagtcgcatttgcgaccatcgggatttctaggcctcttcgcatttgcgaagaaatgatcgcatttgcgatcagccctgcccaggccttctctcgcatttgcgatgggttattcgcatttgcgatctcgcatttgcaagccaggcttcacaaatgcggagcctgcagacctgcaacatgctagctaaaaacctgcaacttctcaaatccaaatttcactatgtggcatatccgaaactcacccaagccctcgagactccaaaccaaacatgcacaccaacataaaaacattatacggacttgctcgtgcaatcaaatcatgaaaataacatgtaaaactatgaattaaacctcaaaactcatcattttcatcaagaacacttaaagttcatagctcttcaaccggaggtccaaatcacgtcaaataaactctattttttaccaaattttatagttaccatttaaatattttaacaagtttgtaccgggatctggaaccaaaatacgggcccaatgccaatgattttaaacattaattcttttctttatttcataaataattcagcaaaacaatttctttcaaaaattgatttctaaggcttgggaccccggaattcatttctagcatacgcccaagtctcatattttattgcggacctcctaggattgtcggcatatagatccgagtctgtttgctcaaaatgttgaccaaagtcaaccaaaatcaaattttaactctagaaatttttatttctcatattttcacataaaagctttccagatatacgtccggaccacgcacgcaaattgaggtaaggtaaaaaggaggttttaaggcctcagaatataggatttgtttctaaaataagtgatgaccttttgggtcatcacatcctccacctctaaaacaaacattcgtcctcgaacggacataagaaggaagtacctaagtcggggaaaagatggggataacagctccgcatattggactcggactcccaggtcgatgcctcagcaagctgacctctccactgaacacgaacaaaagggaaactcttcgatctcaactaacaaacctgccagtctagaatagctactagctccttctcataggagaagtctttgtccaactggacagtgctgaaatctaacacgtgtgatggatcaccgtgatactttcaaagcatggacacatgaaatactagattcacgattgataagctcggcagcaacgcaagtctgtaagccacctctcccactcgatcaagaatctcaaacgggctaatgaacctagggctaagcttgtccatctttctaactatcatcacgcccttcataggagacttccgaagcaacacccgctcacccaccatgaacgccaaatcacgaaccttatggtcggcataactctttttcctggactgagtattacgaagcctatactgaatgatcctaaccttgtccaaggcatcctgtaatagatgcgtacccaacaaccgagcctctctcggctcaaaccatccaaccggcgactgacaccacctaccatataaagcctcataaagagccatctagatactcgactggtagttgttgttgtaggcaaactccactagaggcaaaaactgatcgcacgagcctccaaagtcaatgacacaagctcggagcatatcctccaaaatctgaataatgcgctcggactacccgtctatttgaggatgaaatgttgttcttaactcaacccgtgttcccaactcccgctgaactgctctccagaaatgtgatgtaaactatgtacctctatccgaaatgatagacatgggcacaccatgaaaatgaacaatctctcgggtatagatctcagctaacctcttagaagaataggagactgccaccggaatgatatgtgctgacttggtcaacctatcaacaataacccacactacatcgaacatcctctaagtccgtgggagtccaacaacgatgtccatagtgatatgctcccacttccactcaggaatctcaatcttctggaacaaaccaccaggcctctgatgcttgtacttaaactattgacaattcaaacatcgggccatctatgcaacaatgtccttcttcattctcctccaccaataatgctgccgcaaatcctgaaacatcttagcggtacccgggtgaatagagtaccgggaactatgggccttctctaaaatcaactcctgaagcccatccacattaggcacacaaactcgaccctgtagcctcaaaactccataatctcctaatgtactttgcttggcacctccgtattgcaccgtgtctctaaggacacacaaatgaggatcatcatactgccgatctcggatacgcttcaaaaaagaagaatgagcgactgtgcaatctaacacacggtccaacctcatgaactgattggccaaagcctgaacatccaaagaaagtggtcactcaccgacctgaatatacgcaagactgcccatactagctgacttcctactcaaagcatcgggcaccacattggcctttcccagatggtataagatggtgatatcatagtccttcaatagcttaaaccaccttctctgcctcaagtttagctccttatgcttgaacaagtattgcaaactcttgtgattcgtgaacacctcacatgacatgccatatagataatgcctccaaatcttcaacgtgtgaataatggatgctaaatccaaatcatgaaccagatagttcttctcatgaatcttcaactgatgtgaagcatatgcaataaccttgacatcctacatcaacaccgcaccaagtccaatacgagatgcatcacaataaactgtttatgtccctgaacctgtgggcaaaaacaacactagcgtcgtagtcaaagctgtcttgaacttctgaaagctcgcctcacactcggccgaccacctaaattgggcacccttctgggtcaacctggtcatcagggctgcaatagacgaaaacccctccacgaactgatgataatagcctcccaaacccaagaaattctagatctttgtagttgatgctggtctaggccagttcttgactacctctatcttcttaggatctacctgaataccctttgctaatacaacatgacccaagaatgcaactgaacttaactagaactcacactttgaaaacttagcatacaactgactatctctcaaagtctggaggaccactctcagctgctcatgctcctcccgggtgggagaatagatcaaaatatcatcaatgaagactatcacaaatgaatccaactaaggactgaacactcggttcatcaaatccataaaagctgttggggcatttgtcaacccaaatggcatcaccaagaactcataatgcttgtgccaagtgcggaaagctgtattagggacgtcagatgccctaatcctcaactgatggtagccagatctcaagtcaatcttcgaaaataccttggcaccctgaagctgatcaaacaaatcatcaatccttggcaatggatacttattcttgattgtgaccttgttcaactgtcggtaatctatacacatcatcattgatccatccttctttttaacaaataacatcggcgcaccccaaggtgagacactaggtctaatgaagcctttttcgagcaagtcttgcaactgctccttcaactcattcaactcaggcagggccatacgatacggcgggatagaaatgggttgagtgcctagagccaaatcaatacagaagtcaatatccttgtcgggtggcatacccggcaggtctggaggatatacctcaggaaactcacgaacaataggcacaaaatcaatagaaggaacctcggcactagaatcatgaacatatgccaaataagccaaacacaccttctcaaccatacgtcgatccttcatatatgagataacactacgggtagaatgaccaggagtccctcttcactgtaaatgaggcaagcccgtcaaggctaaggttacagtcttggcatgatagcccaagatagcgtggtaaggggataacatgtccatccccaatatgacatcgttcagacgtaacaaatctacatgagtctcaagacccccaatcacaactatacacgaatgatgaacacgatctaccataatataatcacctaccagtgtagacacatatacaggagcacttaaagaatcactaggcatgaccagatatggtgcaaaataagagtacgtagatcttggatcaaatagaactaaagcatctctactacaaaccagaaccgtacctgtgataactgcatcggaagccttagcctcaggcctcactagaagagcataacatcggggctaggccttaccaccttgaactacatatctgggacagcctgctgctagctggcctccacctctagcggcttgacctccacctctaatacctctacatccacctctagcacctctacctccacctctagatggctgagcgagctgtggaacactcaatgcctgaaccatggcacgagaaccctgatgctgagagctactcaatgcttgagggcaaaatatagcaatgtgacccatatgaccataagtataacaagccctcggctgctgagactactgaccctgacgacctgaatgaccacctcgaaactctggagcggcgaggcactgataggagcttgcggtgcactatagtactgttgatccgaatactgcatatgagaatcacggccacctgaaaaactgtgagaaacctgaagtgttgactaaaaaggcctaggatgatggcatctaccgtacaaatccctgcctccagatgaggccccactaaatctgcctaaatgacgaggcctcttgtcagacccctgaccacctccctgtgatagaactatctcaactctcctgtccacattggccgcctcctaaaaagaaatctcactctccgtctccttagacatctaaagtcgaataggttgaatgagtccctcaatgaacctcatcactctctctctcttagtgggaagtataagtaaagcatgatgggccaaatcaataaacctggtctcgtactgagtaacagtcataaaaccctgctagagatgctcaaactgcctctgatggatctctctctgagtgatagggagaaacttctccagaaatagctgagaaaactgctcccaagtcaaagctggtgacccgtctggtctagccaaacaataatctctccaccaagtcttggcggatctagacaagcgaaaagtagcaaagtcgaccccattggtctccactatccccatgttcttgagaacctcatgacagctatctaaataatccaggggatcctcagaagatgcactgctgaaaatggtagtaaagagcttggtgaacctgtccaatttccacaatgcatcggcagacatagctgctccatcaccagtctgagctaccatgcccggctgaacttctccaactggctgagctgttggagtctgaaactagggagccatctactccggagtgcgagtagcaggattctgggctcctcctctagctcgagagatggctggtgctacaggaagcaagcctctccataaggcccaccagacggactagagcatcctagagcactggtgtagtaatgaacccatctgggacctgatctgggcccaccggaactacctaggccggaacctcatcatcaaactcaacctgaggctccgccgctggtgctactactttgggctaagctctgcccctactacggcgtctagcacggcctcggacttgccctacgaacctcgtgggagctgctgctaggggctcggttgctgatcagtggatgaggaagcgcgtgttctcgccatctacaaaagaacagagtagaaattcaattagcattgagaaaccaaagcgtgcaacaggaaattgtgaagtttttcctaactctgtagctgctgggatacatacagacgtctccgtaccgatccctcagactctactaagcttgtccgtgagttgtgagacatatgtaacctagagctctgataccaacttgtcatgacccggatttcccaccctcgggagtcgcgatagagcctactgctgaaagctaggcaagccaaccattgagcaatttacctttttcccatttttaatcctttaataatgatgaaccaacagtttataaacaacggaatttaaacaagcggaagaaaaacaaataaaactatttaaatatttccaatacaatttcttaaacaaggactacccaaaactggtgtcacaacttcacaaacggtctaggaatactacaaacaaggtctgaaaaataaatacaaaattgtttctgaaatacgtaaatgaaacaggacgaaaggatagatggagatgtcagggcctgcggacgcccacaggactaccttggatctccgtatggactgaaggcagcaaccccaaagctaaggtccaaaagctactgcgtcgggatctgcatataatgcagagtgtagtatcagcacaaccgaccccatgtgctggtaagtgcctatcctaacctcggcgaagtagtgatgaggctaggaccagactaccaaataaacctgtgcagttaaatcatatacagtggaaaataacagcaggagtgtacagttaagaatgggaggggggaacatgttgcggggaaatatgaaatgatactagaaggatagcaagtaattacaaggaacaccataactcaattatcaacaagaatcagaaatcaaacaagtgcacggcatcaccctttgtgcttttactctcgtcctaaccataagagtcaatataatctgcacggcatcatccttcatgcttttactctcgtactcaccataaaatcaatataattggcacaaaattgtacatcgtacagcacgacatcacccttcgtgattttacactcttcctcacaataatcaaacacggcatcacccttcgtgctttaacactctctcaccaaaacaatgcacaacatcacccttcgtgttttaacactcttcctcacccaatcaaaaatcacaagaaataaggacaaggaaataaatgaaatcataataaaatcccggcaagggaacaatagtacaacaataatatccaggaagggaacaatatcaagaatatcaacatcacggcaagggagatagaattaaaagcaacaacattccggcaagggagatagcattaaaagcaacaacatcccggcaagggagacaaataataatcctcttctttttttcacgtttacttcacaactcactataaaacttgagccaatgctctataaggttcaatttctaattttacttccacaattcgtttgcgatgggttattcgcatttgcaatctcgcatttgcgagccaagtttcgcgaatgcaaagcctgcagacctgcaacataccagctaaaacctccaacttcccaagtccaaatgtcactctgtggcctatccgaaactcacccgagccctcggggctccaaaccaaacatgcacaccaacctaaaaatatcatacgggcttactcgtgtaatcaaatcatgaaaataacatgtaaaactatgaattaaacctcaaaactcatcattttcatcaaaaacacttaaagttcataactcttcaatcggaggtccaaatcacgtcaaataaactccatttttcatcaaatttcacagttaccatttaaatactttaacgagtttgtaccggactccagaaccaaaaaacaggcccgatactattgattttaaacattaattctttttttatttcataaataactcagcaaaataatttctttcaaaaattaatttctaaggcttgggacctcggggttcatttccgggcatatgcccaagtatcatattttactgcagaccttccgggatcgtcggaacacagatccgggtccgtttgctcaaaatattgaccaaagtcaaccataattaaattttaactctagaaatttctatttctcatattttcccataaaagctttctggatatacgtccagaccacgcacgcaaatttaggtgaagtagaaaagaagattttaaggccttggaatacaggatttatttctaaaataagtgatgacctttcggatcatcacaatttcgatccaaaaagaaattgtgtaattatttatgataacttggtgaaaaacaaaataaactcagtcgaagtatacatgattttaaataaaaagaaaagtgtatgtattttgtacaagaaatagtgactcactaataacaatgcataattaaatactctacggcaaaaatttatactaataagcactttgaactttgaaacagtagcaagtttcgagacgtttttcaactcaccatttttcatgaaaattgattcatttgagattattatgtataattgtccttctacagaataatctgacaaaaaaatataactccaatccttgattaaattagtaacttattcaagtattttattttctaaaaaaaatctgtaaataagttaagtggagttatgctcacaaagaaaaatatttaattttccattatttattgataaataattgaaggagctaggaaagcacaatagtagggatttctttcttacgagaaggggtgatgaagagaagccattttcacagccatcttcacacagaaaagagaaggacgaagaagaaatatttcagacagacacttagcttttcggacttctctatattgtgttgaagtgcccaagtgttttatcaattgtagctcagccttacccgtggaagaattatggagggtcatgatcttttattctcaaccatctgatcaatatttaaatagttgtacttaaggaagcttccaagaagccaaactcatgtgtttctcgcttgagcacatgggaaagaatattttttagttttctgttacatagtagacaaataagagtagtacaagtgtataggaatattctttattttttattttactgtaggataaatctatataattagggatttacattatcaatacaaggcagagaaatttcacaattctttcctattttctttcatggtatcagagcagtagtagatcgatccaaatttccttttttctcagaatatagtattcaactatggcaggagaagaagttcctccgactctttttactcccattatctctggttcaaccattcacaggatgtgaatcatccttatttcctttactcgtctaattctcctggtttgagtcttgttaccacactatttgatgatagaggctttgagggacggaggagattaatttttgtagcactttaatccaaaaacaagataggcttcataaatggtgtgtgggaaaccaaaacctgatgtacgagatcaccttcaatggagcagatgcaacttcatggtgacatcttggcttctgaactctttatccaaagagataggtggcagtatcatctattcataatctacaaaagatttgtggaatatccttgaacacagatttgggcaaactaatagagccaagctgtaccaactgcaaaagaaaatatcagtgttagttcaaggtaacaacagtattattggatactttaccatacttaagaaattatgggatgaacttgactccctcaactctcatctagtctactctagtaactgagtttgtgatggaaaaagaaaagtcacaaagtttttagaagaccaaaggatcattcagtttttaatgggactaaatgatgtctattcccaggcaagaggaaacatccttatgatgaatccattgtctagaatagatttttcttattcacttcttctacaagataaaaatcaaagggagatatatgcaagatcacagttcaatgctgatgcttcctcattcatggtaggagttcaaggtaaggctccacagaaaaacaacaatcagtcacaacaaaagtcatggactaattcacaaaaggttaataacacacagcagaaacctaagggaaggaaagcaaaatttaatcctaatatgaactatacatattgcatgagaattgggcatgtcagggtagattgttataggctaaatgggtttccagatgatttccaattcaccatatcaacacaggtcaaggctaatgctatagttaaaggacaagacaatgacaatggaagcactcaaagcaatgatggaacaccttaaactcagtttttcagtaaggaacatatgtctgagctgatgaacctaatcaagcaggcacaacttggaaatatagcaacattaggaactacaatcaatgcaaatgcagtggctgatacaatacttaaatatactaaaacttggttggcagctattaacacaaaaacctggatcattgatttaggggcttctgaacacatgtgttttgattcaaattgtttcttaactttagatccacttcctattcctgtatatattagcctacctaacttatttcaattatatgtcaaacacataggtagtgttcctattcagtctaatatgattcttgaaagggttctttatgttccttctttcaaatataatttactcccagtccataagttgtgtgtccagttttattgctcactcaatctaatttctagtggatgcatcatgcaggtccctttaatgaagagggacaagtttttgatgaattaagaggagaattgtacctgctggaacctagtacacctaaaatagattctggttttagtttaaataccaatatattttcaattccacaaggaagtgattccattctagttcctagtgaagtttcttgttctgtttctaattccaatatagaggtctccaatgtactccaatggcatttttagattggggcatctgccatttttagtaatgaaaaatcttcaattcatttattttccttccaatttcaattttgtgtgtgatatttgtccaaaagctagacaaactagattaccttttcccttgagtcaaatcagaactcatggaattttttatcttattcgtattgatgtatgaggaccattcaaaagtactacttacaatggatataaatatctcttgaatgtggttgataattttagtaggggaacttggactttccttttaagttccaaaagtaatgatttcactatcttacaatctttcttagttatggtagagagacaatttgcaaggaaagttaaaagaattagatctgataatgcaataaaatggggaagggatcttttcagtctgattttctttagtctcaaggcatcttacatgagacttcatgtgtagcaagtccccagcagaatatggtagttaaaagaaagcataggcaccttttggaagttgcaagaggattttattttcagtcacatgttcctatccaatactagggagagtgtattttgactgttacatatctaatcaataggtttccttctagagttctaaaaggaaaaacaccttttgagattttgtttaaaaggagtccacagaatgaacaactcaagtcctttggatgcttatcttgtgcctctactctaacacaaaacagaagcaaatttgatcccatggcacacgcttttatttttctgggatatgcacaacatcagaaaggatataaattgctagagttacattctaagaaggtctttacctcaagagatgttaagttccatgaagcaatttttcttttgtttctgctgctccaacctcattctctcctttcccccttatcttttcttccctcacccatctaccactactgaaactacttctcaagatttcctatctcccaactcaaccatcaatcattagtcacactcacatgtccctctatatccaaatacttctgagaatagcacccttatttctctcaataatcctggaaatcctgtatctattaccagctccccagattctccttttcataatccatctcatactgattactctatttcacagcctacaatcccaataccaccacctcctcttagaaaatctgagaggatttcccagaaacctacctatctcaataaatatgtctgcaatagcattgttttctctaatcttacctcctcctgtttttatcatatttctcaccctaattgtcacgaccctaaatgctcggtcgtgatggtgcctatcacaatactaggcaatccaacccaaaccatcaaccacaataatttcttttataaaaaccatttcctaacattgatttaaatctcaaattctcataagaaatgtataaaacagctaaaatgtgtggaatttagtaaaacattaaaccaacatagcctaaacatctggagtcacaagtctagagcctctaaatatataaatccgactatctaatacataacaagtctaaaatacagaaaaacaaggataggaaggaagaaagcagggctgcggattccatgcatctaccttgcagtctctggcaaactctgacaatgctgaggaccctcactctgccgctcgggcacctagatctgcacacaaggtgcagggagtaacgtcagtacgccaactcaataagtaactaaagtaaataaggtctgaaagcagtgacgagcagttataaaatcatatagaagagtaaacaacagaataacaaatcaaactcaacggttttagaccagtttcttcataaaacttcagtttcaattgaaatactttgaaatcatttaaaaaatttcagcagggcttattttaaaagaagagtgaaatcagcaaaagtatcataaatgggcccctcgggcaaagtatcactcaaaaatatagcctctcgggcaaacctcttggtcacccatgactcagctctcatcactcagtactcacactcagcactcaggctcaaatacacctcataatagtaataatcataataattgctgcgacgtgcagcccgatccatagtttatagacgactatgcttactgggggtgtacagactctggaggaactcctacagcccaagcgtcatatcgctgcggcgcgcagcccgatccaacatatatatattgttgcagcatgcagcccgatccataatatatacatataatattgttgcggtgtgtagcccgatccgtaatatttataatcctcaccattaggtcctcaacctctgtcagtcattaacctcacaaccactcgggcataacagtagaaatcagggaaactcagttcgaagagttctcacattttaagaagtagaatgataaaaccagttttaaataataaacaggtaaaacatgactgaggatatgctttcaaataaatagagtgaggaaaacagtaaaaatgcccctaagggtttcaacaggtcggcacaaggcccaaacatggcatacaacccataatacaatataaatgtctaaaatatgagattttataagatttcaaatcaagtacgcagcttaatagtcgctacggggcagaccaagtcacaatctctaccagtgcatgcccacacgctcgtcacctagcatgtgtgtcacctcatttatcaaaacatttcgaaataccggggtttgtaccctcagttccagatttacaatggttacttacctctaaccggatgaattactactccacaatgcctttgcctctcgcctcggcctcaactcgcactgaatctacccaaaatcagaatcataacattagaatatgctaagggattgaagcccaagcgagaataatcaaattataccaaaaattctgaaattgaccaaaacccgacccccgggcccacgtctcaaaatatgataaaatttgcatcaacagaatccttatcactccatgagttcatacatatcaaaagtcccaaaatccagtcacaaatgacccctcaaatcctcactcaaaggtcttcaataccaagccctaatacctcaattttcttccttaatttccactaacaccatgattaaacaatggaaaaatgatcataaactcaagtaatgaagcttagggaacttaccaaactgatattcctcaattttcccttgaaatccactgccttagcccatttcccgtcttcaaaaatggagaacttagcaaaacttcacgaaggaaacattatatactttctgacctaggggttctgcacctgcggtccatccaccgcatctgcggtactgcttttgtggtccaagacatcgcacctatagttttccacttaaatgtccaaagtcgcatctgcgatcaaataacaacacatgcgccatcgccggtgcgctcaacataccgcatatgcagctcccacccctcgcatccttgaacgcatctacggcatcgcacctgcggtccccaatccacaggtgcggaaacaacagaagcagaaaaattctgcaacttcaccaaaaaatcaaactcttcgtcaaccctccgaaatcaccctgaggcccccgggacctcaaccaaaagcaccaacaagccatataccaccactcaaacttgtaacaatcttcaaaacacctcaaacaacatcgaatcagccaaatcacattgaaatcaagcctaagattctaaaatatttcgagttttgcttttgatccaaaaatctatcaaaccacgtccgaatgacctaaacttttgcacatacatcccaaatgacacaacggacctactacaactctcagaattccattctgacccctacatcaaaatttcacctatcaaccggaaaacgccaaagtttcaatttcgcaaattcaagcctaaatctattccggacctccaaaacatattccgatcacactcctaagtctcaaatcaccccctcgaagctatccgaactatcagaattcatatacgagccctatttcacatacgtcaacattcagttgacttttccaacttaaactcactcaaaagagactaagtgcctcaaacctcgccaaaatttttttgaacccgagccaaccagcccgataatacatgagacgactagtcgggtcatcacactaatattttttcttttggagacctttctctcaacaatcagactattttcaaatctatctccacagtttttgagcctaccagctatacacaagcttcccaagatcttggatggagaaaaataatggaagctaaaattcaagctcttcaactcaacaacacctggaatgttgtttctttacccccaggcaagaaagaattgccttgtaaatgggtttacaaggttaagcacgaatcagatgggtcaattaaaaggttgaaagccaggttggttgtcggggggacatacaaagggaaggcattgattattctgagacttttagtccagtggtcgagatgaccactatcagatgcttattgactgtagctgtgaataaagggtgggaagactcacaactggatattaacaatgcatttctacatggagatctataggaagaggtgtatatgaaatttccagcttgtctcactccctctcatcctaatcaggtgtgtttattgaagaaatcactctatggactaaaacatgcctcaaggcaatggtatgctcgtttagcaggtccctagcagagtcgctagagctgtcacacctcctttttaccacccccaaaagggatataagggagattttttaaatttaaataacaatcgaaacggtattatttatttaagatcagagtcgccacttgggataattaatggtgtcccaagtcaccggtttagaattctgaatcgaggaaattgactctgttttatagtccgcaaacacaaaaatccgggtatagaattctgttctcctgggagaaggtgttaggcatttcccaattccgtggttctagcacggtcgctcaactattattattggcctatttatctgatcttttacacgttttaaaacctactgtgcatttttaactttttagcccttttaatattttaggaaatttcaaggttatttaaaacgcatcgtaatccctgctatatgaaatgcaattgtggttcacgacacgttctatttaaccttattggaaaggagaatcaggtcacatgaaatgtacacccggatttataacatatttattccattattattatcaaaattatggcagggtcacatgaaatgcacactcgagcccttttaatctagttggcgtagttcagttgatggatagcgactcaattctatactatgacaaaatcatgtttagatataaccaattcgagtaaacacgagcagataaccgagcaagaaaattcagaaccacaaaaaataattacggaaacaacggaatcgcatcaccaaccaaattattaacattaagcttgattaaaacgaatagagtataaaagaattggacctcaatatagccggggaattgtttgtttcaatgtttaacgctcaaaaatgtgacgaaccatggacaaaacccgaattagcaacaaaaactcaactaaacacggattcaaacccatgctttaatcattgttcacgccagaatcaagcaaccaaaataatagtctttcagccttttcagttctcacgttttgaaattagagttcatttcaatctcaaataccccataacacttacgaaatcttctgaaaaaacataaatggatagtgtttcgtttgttgataaataacagtaactatacgaccaaagttttaaaaaaacaaaacgggtggagctgttttggtacttgaagatgactggtttgagctactattttcgtatatttggagctggttctatggctagttgcaacgggggttggaggagaatctaaatctattttggtggctgaaaatgccactacctctgtcgaacaccgaaattctgcgactgtaacaatgctttttaagaagaggaagatgaggcgctgtagctttttttgtatgaagaagcctggccgctgctagctattagggatccaccatttttgggttcaagatggaggggtgtgggctattcatgctttagcacttaagaagatgaaaggcaaagtcgtttggggttgaacggtgctggtctttggcttggtgttgctgatggtgtatgttgatggatctagcggctggggtggaagggtttgaagaagaaacgtgggggggctcgtgggtgtcagcggcggatctgatgtgatttttgggatctaggtttttgttcctcatttcagattttccttaggtccttttttcatttttctgttgtcttttttggctcttagggtcctaggctctatatataaaatctcatcactttaggtcttttagggttatattaggttagggggtatgggcttgaaaattatgggctaggtccgaaaattaggcctaaaatgggtcgttatcccaaattttattctttccgcaaacgagactaaaaacacgatctcatttactaattgatcctacttaagtaaaaataactattaaaataagactaacaattaaaacaaacttattttttggtgttttcaaatatcatattaaaataataataaggtactatttttgtatttttcttaatttttacgaaaggtatataaactaaaagcaactaaaaacaagaaatattttttgtaatttttattttgtgataaaaataaagtaaaagggtcaaaactagttaaaataactatattagacctaaactaaatatttaaatacaaaaatgtgtaaaatcttggggagggtcaaaaatcacatgtctacagctattctatttccctgaatgactattccttattctacaaacacacaaataagaggatatccatcatagtagtatatgttgacaatattctcatcacaggaaatgatgccacataaatacaacttatgactcaatttttgaattctgaattcaaagtcaagaacttgggacatacatactatttcttaggcatggaaatactcagagaacaacaagggtacatagtcagtcaacaaaaatttaccttggaactattggttgagtttgattgtaaagggcctaccgtctcatctcttcttgatccatactccaaattgcacgctgaattagaaccaccaatggaggatcccactctttatcgatgatcggtaggtgaacttaactatctcaccaatactcggccagatatttgttttcttttctttgccttagtcaatttatgcaaaggccttctctttcacatttttctactggtctcagagtgttctgatatctttgatcagacccaggccaaggtatccttctctcttctgctccctcttttgatcttgtcgctttttgtgatgctgactgggctgcttgtaaagattctcgtcactccgtcagtggtttttttattactcttggaggtgcccctatttcttggaaatcgaagaagcaaatctccatctccttgtcatccgctgaatttgagtatcgatccatgagatgggtgactgctaagatcacttggcttgttcgactccttgctgatttatctactcctccaactttgccggttcctttacactctgacagtctggcggcgattcatatcgcccgcaatcccatcttccacgaacgaactaaacatgtagagttggattgccatttcgttcgatagcaatttctcgctggattgatatccctttcattcgttccttaaaaatcccaaattgcagatctctttaccaaacccttatctagggtttctcacaccaacatcatgagcaagctggggtttttgtctctaccctccagcttgaggggggatgatgaagagaagccattttcacaaccatcttcacacagaaaagagaaggaagaagaagaaacatctcagacaaacacttagcttttcagacttctctatattgtgttgaagtgcctaagtcttttatcaattatagctcatccctacacgtggaagaatcatggagcgtactcataatcttttattctcaaccatctgattaatatttaaacagttgtacataagcttccaagaagtcaaactcatgtgcttctcgcatgagcatatgggaaagaatattttttagttttctgttgcacaacagacaaataggagtagtgcaagtgtataggaatattctttatttgttattttacaataggataaatctgtatatatatatgatgactcggccagtcgtctcatgcgttaccgctccatttccaccatttatgcttctttatgctttgtgtatctgtgttatgtggtatcaggttggttgaatcgaatccgaaatgattttggaaaggtttgagacacttagtctcttttgaggaagcttaagttggaaaagttaaccggatgttgacttatatgttagagggcttgtatgtgaatttcgatggtttagatagcttcgggaggtgatttgggacttaggaacgtgatcggaatgcgttttggaggtttggagtagatttaggcttgattggcgaagttgatattttggtgatttccggttagtaggcgagattttgatataggggtcggaatggaattccgagagttgcactatttttgttgtgtcatttgggatgtgtgtgaaaaatttcagttcatttgtacgtgttttggttgggttttttatcaaaagcgaaattcggaagattttagaaacttaggcttgaatccgatgtgtttttgttgatttgatgtgttttgaggtgttttgaagattggtacaattttgaataaggttttgtgatatgtttgtgcctttgattgaggtcccgggggcctcaggtgagtttcggatggtcaatcggaccatttcttgccttggagaggttgcagattttggttaagttgttgtagagcttttactcttcgcgatcgcgtagggagtctcgcgatcgcgtagagctattgtggggacagtacagtttactcagtgccttcgcgaagatggggatgtgatcgcatagggtaaaggcattgttgatcgcgaacgcggggagtgggtcgtgttcgcgtagagttaagtggaccaggggtcttgtcttgaagttgttcattgcgaatacggtagccagtccgcgatcgcatagtgttgggagcttgatcatcgcgttcgcatgggatattacgcattcgcatagggttaaatccgggagctgaggatttgtgcttcgcgatcgcgaaggatgtcctgcgatcgcgatgaaggaaattaggcctgggcagaaggtttaaaaggtcgtcttatccgtgaatgtggggtttatttcttccattgttggtcatttttggagctttttgaaggggattgaagagggattcaaggagaatcacttggaggtaagattcttggacttaaaactcgattctaatgtgaattccacatagtaaatcatggaaattaagccaaaaataaagaactagggcttcactatttagacctttgattgaggatttgaaagaccatttgaggttggatttcagaacttttgatatgtatgaactcgtggggagataagaaatctattgatataaaaattattgaattccaagacgtgggcccgggggttgggttttggtaattacgggatttatgttgtaaattaattatattcgcttgggcttcattcctttagcatattttgacatcctcgttctgattttggagagttccgacgcgattagaggccgattcgaggggaaaaggcatcacgagctagagatttgaccggttcgaggtgagtaatgattgtaaatgatgttctgagggtttgaaaccccggatttgcacatcgtggttctatattgaggtgagacacacgtttgatgatgagcgtgaggtcgagcactaatggggattgtgacttggtccatcccgactgatgattttaccgcgtatttgactgaaatctatttgatatcataattatttgggctgaatgccaactatttgaacccttcagggatttttattgatatttcctcactgttttaactttatacttgaactcaatcatgttattttccattgttttcatactcagccatgttttactcagttttaatacttaaatgatactttaaatgatgtttgggctgagaaacactattttactattgcgcgagtggcttgtcaggatttttgactgagtaaggccgagggcctatgttttgaggaaacatttgatactgattatgaggcctagggcctgaggtatgtacgccgcgaggtggcttgattgatataaggccgaggatgtagtgatgatgccacgaggtggcttgatattgcgcttgggccgtaaggggcccctccaagagtctatacatccccagtgagaacgagtacccattgtgatacgagattgagcctgaggggctggtattgttctaagataatgcccgaggggcaggtactattctgagatgttgcccgaggggcggatttgttgatattgtgcctggggggcaaacctttatgtgtttatttttcataattgactgtcaattacctacttaattgttgaaaaaggcttttaaggaagtaaatttgagttaaaggattttcacctatctttcactggtttactgttttaaaaagtgttttcactgcttcattatagcatgcttttgtgccttgcatgatttcctgctttcagtctttatttatgattattactcactgagttggagtactcactttactccttgcaccctgtgtgcagaaacaagcgtatctggtcctgctccttagtgttgaccgttccggctcaggcggatctaaggagtctctaggtagctattggcgttcgcagcccggagctcttccctattttacttcttcattttcttagtttctatattaaactctgtagtttgatttgtagtattccgaattgtttagatgctcatgactactaacactccggtatcagtatgctattaattgttgtgtttgggctgtattccgcatattattctattaattgcttaaactttggtttatttcttcatgtttagatggtatcttaaatgcttaattattaataatcggataatgggaagtgtcggctggccttgtcttcatgagaggtgccatcacgactgggttcgggtttggagtcgtgacaagttggtatcagagcctaggttatataggtctcacgagttataagcaggtttagtagagtctcgtgtatcggtacggagatgtctgtatttatccttgagaggctgcagaacctttaggaaaaacttcacattcttgaattcttctcgtgcgtccttgattcagcttgaaaagtaactctttgaattctttccacacgttcgtatgtgcgcatgagcgctcggtatcagatgtgcattgatggcttgtgattcctcaatctaggggtgagatgtgatctctgtgcattgatgttgggccagtttggaggactcgaggccggatttttgcctatagcttgagccctgagctgttgatttcatgagcgcagtttctggatccatatgttctgttatgtccctattaagggaggtgatgactggatagttacgtgatgaatgtgatgtgactgcgagatgtattcatgtgatttggaagcaacgagaagggtttgctggaggatagaaggactattaggtgctcgatttttatcttgatttgaggtatagccccgagttatgggtgtgtgaagaatctttctatgtttcctagttgggagtggagtaaatttcatgttgtggtctgagttcagactcaagaagtttaagtaactgcgtaatgtttatgatggtggaaggtatacagaaatgtttgtttgaggcaaagcaggtagggttatctcctgcggattattctgaagtttgtgtaatcccttgtgtcatttgttaccagggaaatatatgttttacaatttgaatttgggttgctcaagagagtaggctttactactacgagagtgaatgcgagatttgcagaagatataaactacaagatggtctgtgttccacgagcttataaaggattgagtttaatctcaatatggtattatggcaccaataaagtatatgcgttatgagttattgtatatgttttggtctatggcttcgagccaagtgggggagtccactattaattagtcgattgcacggttatgtgctatgttagttccagtttgaggcatgcgggtgaatcagttatcggcttcagcaccagttacttcaccaccatccgcccagccagctaggggtcaccccagagagggaggttgatcaggtggcggtcaggcccgtttctatgcactttcgggcagacccgatgttattgcttcagatgcggttattacaggtattgtttcaatctgccacaaatattcctctgtattatttgatcctggttccaccatttcttatgtgtcatcatactttgctcgttatttgggtacatgtatctactccggtgggtgatactgttgttgtagactgtatgtaccaatcgtgtgtggtgactattgggggtctggaggcccgagtggatctattattgttaagtatggtggatttcaatgtcattttaggcatggattagctatctccgtgtcgtgctattctagactatcatgctaagacaatcacattggctataccgggtgtgccacggatcgagtggcgaggtgtgactaattttccagtagagttatctcattcttgaaagcccagcgtatggttggtaagggttgtctttcgtatctagcatttgtaaaggatgtcagtgctgagactcctagtgtttattctgttccagttgtgagggattttcttgatgtgtttcctgtagacctatcgggcatgccaccaaacagggatattgattttggtattgacctggtgccgagcactcagcccatttcagtttcaccgtatcgtatggcaccagcagagatgaaggaattaaaggagcagcttcaggaactccttgataaagggttcattcggcatagtgtgtcaccttggggtgcaccagttctatttgtaaagaagaaggatggcactatgaggatgtgcattgattataggcaattgaacaaggtaacaattaagaacaagtatcatttgcctcgcattgatgatttattcgaccagcttcagggagcgagagtgttctccaagattgatctccgttcaagttatcaccagttgaagatcaaggactcggttattcttaagacagctttaaggacccgatatggtcattatgagttcttggtgataacttttgggctgaccaatgccccagcagcgttcatgtatttgatgaacagcgtgttccagtcttatctcgactcgtttgtcatagtctttattgatgatattctggggaattcgcgtagtcaggaggagcatgcggaacatttgagagttgtgttgcagagattgagagaggagaagctttatgcagagttcttcaagtgtgagtttttgcttagtttagtggctttcttggggcacgtggtatctagcgaaggtattcaggttgatccgaagaagatagaggtggttcagagttggcccagaccgtcctcagctacagagattcgcagctttcttggtttggcaggctattatcgccagtttgttcagggattctcatctatcacatcgccttgacaaagttgactcggaagagtgcttcatttgtatggtcagacgagtgtgaggagagcttttagaagctcaagacagccttgaccacaactccagtattggttttgccatcagcttcaggttcatatccatgtattatgatgcttcgagagttgggattggttgtgtattgatgcaggagggcagagttattgcttatgcttctcgtcagttgaatccccatgagaagaactaccctgttcatgatttggagttggcttccatagtccacgcgttgaagatttggaggcattacttgtatggagtatcttgtgaggtgttcactgatcatcgcagtcttcagcacttgttcaagcaaaaagatcttaatttgaaagatggttggagttgcttaaggattatgatatcactatattgtaccatccgggaaaggccaatgtggtggctgatgctttgagccgaaagatagtgagtatggggagtttggcatatattccagttggggagagacctcttgcagttgatgttcaggccttggccaattggttcgtgaggttagatatttcggagcccagtcgggtattggcttgtgtggtttctcagtcttccttatatgatcgcatcagtgagagcttgtatgatgatccacatttggttgtcattaaggacagatttcagcatgatgatgccagagatgtgaccattggtgatgatgaggtgttgaggatgtagggccggatttgtgtgcccaatatggatgggcttcgagagttgattctggaggaggcccatagtcgcggtattccattcatctgggtgccgcaaagatgtatcaagatttgagatagcacaattggtggagaagaatgaagaaagacaatgtgagatttgtagctcggtgtctcaattgtcagcaggtgaagtatgagcatcagagatcgggtggcttgcttcagcagatggatattcttgagtggaagtgggagaggatcgctatggactttgttgttagacttccacggactttgagaaaatttgatgctatttgggtgattgtggatcgtctgaccaagtccgcgcactttattcatgtatgtactacatattcttctgagtagttggcagagatttatattcgggagattgttcgtttgtatggtgtccccgtttccatcatttatgatagggcactcagtttacatcgcagttttggaggtctgtgcagcaagagttgggtactcaggttgagttaagcacaacttttcaccctcagacagacgggcagtccgagcgcactatttagatattggaggacatgttgcatgattgtgtcattgattttggagggtcatgggattagtttccaccgcttgcagagtttgcttataacaacagctaccagtcgagtatttagatggctccatatgaggctttgtatgggaggcggtgtagatctctagttggttggttcgagcccggtgaggctaggctattggggatagatttggtgcaggttgctttgtagaaggtgaaggtgattcaagagaggcttcgtacagcacagtcgaggcaaaagagttatgctaacaggaaggttcgagatgtgtcctacatggttagtgagaaggttctgttaaaagtttcgcccatgaagggtgttatgagatttggaaagaaaggaaaattgagtctgcggttcattaggccttttgaggtgctttggaggattggggaagcggcctatgagcttgctttgccacccagcttgtcgagtgtgcattcggtattttatgtttctatgctccagaagtatattggggatctgtctcatgttttggatttcagcacggctcaattggatgatgatttgacctatgatgtagagatagtagctattttgggtcgtcaggttcgaaagttaaggtcgaaggatatagctttagtgaaagtgcagtggagaggtcggtctgtggaggaggctgcctgggagaccgagcgggagatgcagagcagatatccttacatgtttgaggcttcaggtatgtttctttactcgttcgaggatgaatgtttgtttaagttggggaggatgtgacgacccggccagtcatctcatgagttaccgctccatttcccctatttcttctactttatgctttgtgtatccgtgttatgtggtatcgggttagttggatcgaatccggaatgattttggtaaggtttgagacacttagtctcttttgaggaagcttaagttggaaaagtcaactggatattgacttatgtgttatacggatcgtatgtgaattcccatagttcggatagcttcgggaggtgatttgggacttaggagcgcgatcggaatgagttttggaggttcggagtagatttaggcttgaattggcgaagttgatattttggggatttccgattagtaggcgagattttgatataggggtcggaatggaattctgagagttgcaatagttctgttgtgtcgtttcggatgtgtgtgcaaaatttcaggtcattcggacgtggtttgcttgggtttttgaccaaaagcagaattcggaatattttagaaacttaggcttgaatccaaagtgatttggttgatttgatattgtttgacatgttttaaagattggtacaagtttgaataaggttttgggatatgttggtgcctttggttgaggtcccgagggccttgggtgagtttcggatgatcaatcggacaatttcatgccttggagatgttgcagattatggtttagccgttgcagagcttttactcttcgcgatcgtgtaaggagtctcgcgatcgcgtagagttgtagtgggagcagtccagtttactcagtgcgttcgcgaagatggggatgtgatcgcatagggtgaaggcatttttgatcgcgaacgcggggaatgggtcgcgttcgcgtagagttaagtggaccaagggttttggattgaagttgttcattgcgaatgtggtagccagtccgcgatcacatagtgttgggagcttgatcatcgcgttcttatgggatgttacgcattcgcatacagttaattctgggagctgaggatttgtacttcgcgatcgcgaaggatgtcccgcgatcgcgatgaaggaaattagtcctgggcagaaggtttaaaaggtcgtcttgtccgcgaatgtgggatttatttcttccattgttggtcgttttcagagctttttgaagggaattgaagagtgattcaagggaatcacttggaggtaagattattggaattaaaactcgattgatcataggctaaaaactcgtattttagtcgttgtaacaacactttaattattgcattttacaaaagtttgagcttaatccgacttaagaaataaatttgggatgaatttaattgatttggggctttgaagtctgagtaaaagctaaataaatcaagtcaggatcgagttcaggggtcgcaaagcaagcccggatagcaaaacaaatgaaaaaatgaagcatcacaaaattttgcactgtcgcaccgtgggaggcgccgtggcagtgcaagaatctgcactgcattgtatttctccgttaaaatgcattttgcctctgtccaatccatgtacacgctgcggggggcgctgcggacgtgaaaaaattgcagaattactctatttcggtctaaaaaggcataattgtcaaaaccccttcacacacgattaaaaagagaaaagcatccattattgatggaccagacctgttttgagagagaaagagacgaggagatccatcttggaggatcaaaatcaagaggagacaatactttggatcaaggattaaaagtgtttttctaaactttcttctagtatctatttatttgatgtttgtataattatgagtggctaaaaacccaaatattttagggttatgggtgttagatgattatgttgtttgaaacttagattgatgatcttgaaattatcgttaagggttgtttatttgattctgctgttaattattttactacgtagctaacaatgaaatactatttacgaatcttgagttaaacttgaaaaaggaaattgttgattgcatatagaatcaaatagagcaagatctggatcctgggcatcgggtgaaagattcgcaattaagatagaactatacttaattgccttgtttggttgagaaataggatttgtaaatgcatttgagttaatattaataccatagaaatataggtattgatttaacttgaataggcgcataagaaatcgatagattcttctgggtattattaaccctataatcaataacccggataattcaataaatcatttttaagctaaaaacgtagcatgatctctatcaagcccataaccccgggatatctcatttattaattgttaaaagaaaaactcataagtggcgtagtaactttgcgttgtattattgtttgtctactagttaaattgtaaattggttatttatgtattttgtgatgaattagcttgaatcgataattgtttaagtttgcatcagtcgttaagttaatcataagccctcatgggaacgatactctacttattactatattacttgaagatcgcgtacacttgcgtgagtgctttggtcgcaacaagtttctggcgccattgccggggacttggaaattagctacttgactaagttaagcttttatcagccattggtttaagtattaattttcagttcacattgtttgtgccacgcaggctcttctcttgaatgcggaggagtagaagaacaagcaatctcttccctcttgatcctgaaattgaaagatcacttcatagagagaggaaggagttggaagctagatacaaaacagaaagagagttgggcattttagttcaaccacagccaatagtgatggcaggtaatggagggcgttcggtgatagaagctcgaaggccaaatcttgctaatatgactcaggctattgttaagcctgatatcactgattactttgagcttaaacagtacacggtacagctaattcagtccactaggcaatatgtaggtctatctcatgaagacccgcagaggcacattcagaattttttggaaatcacggatacttacaactatccaaatgtttccaaggactatgtcaggctaaccttgtttcctttttcattgttgggggaagctaaagaatggttgcagaaggagcctgctaattcaatccatacttgggatgatttatcaaagaaatttttaatcaagtttttccccactaaaaagacaaagcctttgcggagccagattcttgggtttcaacaacgggatggtgagactcttcgccaagcttgggaaagatacaagaaactactccgagactgtccacatcattgtcaaactgatgaattattgggccatacttttgttgatggattagatgagacttcaaagatgaatcttgattcagcttgtggacgtagttgcatggcgagactatatagtgaaatacaacttttgctaaacaacttcactgttaatgatcataattggcaaggtgagggagaaccaaggagagcaatgaaacagaaagcagcaggggtacttgaacttgatgatttttcagccatgagagcagatatagcaaaattggcaaatcaaatgaatagaatgacaatgaactagacacaacaattgcaacatgttcaacaaatgtcgatttgttgtgaaatgtgtggtgacaatcatacaagtgacatgtggccaatgaatcctgaatctatttattatgtgagacaacaaagcagaggtccgatgaaccaacaggcacaatatgggaacacttacaatgcaaattggagaaatcatcctaatttctcttaggatggaaatcaattaaatcagaatcaatatagaccccaaggaaatttcaatcaacctcaaaggccacccaacaggtagaagaaagtacaaatgatttgttgaagaaattgttgcatgacaatcaacaactcaaaactgatttcagaaatcttgaaaggaaaatggtcgcaacatctattctaatgttaattccacctagtaaatcatggaaattaagccaaaaattgaaaaactagggcttggaaatttagacttttgattggggatttgaaggaccatttaaggttggatttcagaactttttatatgtatgaactcgtggggagataaggaatctattgatgtaaaaattatcgaattccaagatgtgggcacgggggtcaagttttggtaatttcgggatttatgttgtaaattgattattttcgctcgggcttcattcccttagcatattttgacgtcctcgttctgattttggatagattcgatgcgagtagaggccgattcgaggagcaaaggagtcgcgagctagagatttgactgattcgaggtgagtaatgattgtaaatgatgttctgaggggttgaaatcccggattcgcacatcgtggtgctatattgaggtgagacacacacctggtgacgaatgtggggtcgagcactgatcgaagacaaccatgcactactattgagtagcgagagaggtcgaagcagcttttacctgattaaggtcgggatgatttccataggaatctagaagttggagtcaggtgtctatctaaagtggagttgagtatttgctcttaactaaacttctaaacattttgggttttgttttacttctaattgtatagaactacaatgatcaattaaactaaaataatctaggattaagctattgtgagttgttcaaatgattaaaaggcactagggtagtgactttcgcctaggtggttaattgacgggtacttgagtataagatatgattgtcacatttggggagtatgatacaaccattgcaagattctactcactatacacctctcggtagttcgagtgattttgtccaaattgactttctcaagaccaattgggtatgtaaatttgtaaaagcaatcaaggttcaagttaggtattattatctctaggtttaaccctttaattggggctatcaatcttttgagtacgccccaattccttgttggaccaatttcagagactcggactctctttctcaagaaaagccaaagtcaactaaacacaaactagtgtttgcaaccactaattcagcaattaaacatgaaattagtccaaatatcaaacacccctagacaatcaagcatcaaaacacaagacccatcaattacccacactagggttaagccgcaaccctagcttatgggtctagctactcataattagagaagaaaacaaagaaatagatgaagaaaaactcatattaattaattgctaaattaaacttgaagattcaatgttgaaataaagctaaaattactcaaaatagctaaaaataacgaagtcacgagcgcagccagtgtacaaaattatccgatgacctaaaatgggaaaagaagctatttatactaagctgaatattttggacaaaaatacccctgcggggttagtgcggaccgcacaaaatcacatgcagccacactagggctttggactttaataaacggctctctgaagttgggcaatgcagaccgcacataatcgattgcggctgtggtggcttctagtacggtccgcatgaaatggagcgcggaccgtattaggcttcaaacttggaactgggaactctctgaaccttctctctgcggaccgcactaaatcaaatgcggccgcattaatcctagtgcggaccgcacaaaacctcgtacgtctgcattgccttttttgcctgaatagcagcctctctgaacctcacttgtgcagaccacacagaatggtgtgcggctgcactggccctattttgcctaagcttgttttgtcttggtacttgtgcaagtttcactcctttttgagctgatctttgacatcttgtcaccttgttgatcaaacctgcaatcaagcacaacttgtgagtcttttgggactatttgtacacatttctaatcaaaacttaagcatgaaggagtattaaatgtatcaaaatccctagttatcaactcccccaaacttaagcttttgcttgtcctcaagcgaacaaaataagactcaccccttaagagaaaatccaagagaattcagttatcctaaagtgaccttatctagcatcaattgggactaacaattgccctcaatacaaatgaatcattaacaacatttactcttttaaataccatggattaagtgcaacacaagagcatcaagagttgactcaacacatcaaagaactctttctattactttggtcattgtggaacccaaactcacacatcctcagcatctccctaagtaaacctcacctttagaatagtggtactcagaacgaggttaatggaaattcactcatctctctcaaggaaaagtcacaagtccggctctaagtaccatatgcttgccccttatatgagtcaccactaatgtaagtttcattcaactagagatcatatagggcttttgtggagacatagtgaaggcttttggttccaggtaggtaatgtttggtctatgtaggttccatcttcccttaagcactttttttgtttcattttggcacacattcacttgactttttgagtctcttcacttctttctaaggggttagagagacacactgtcactctttcttatacatttcaaatcttttcttctttctcaactttcaacaccttcattctttacttttcttgaatccctttttattcaattctacattgaacattctttttgtctttttgcatttatttctttttcattgcctttctttttcttcattttatacctttttaccactttgttgccatcctcgtctctccccccaaacttatacttttgccatgtgctaaggaaagattaggtgccaagagaggatatcttttagagcgggtaaaggcttgtagcatggttcttaaaggaaaaaggtccaaggctcaaaagggttgactagggattttattattggtaggctatggaagtgtttaatctatcatttggatcaaggagagcctataatcatgtctcaagtcaaaattcacttaggatttcttctcaacaaaaattcagggcaagttctagaccaatggctcgggacttggacttgcaatgcaatttctcaccacacaagctatgggatcgctaaagacacagagtcggggacccaaaacgaccttagataagattcgagcacacaatagtcccgaaacaccacttgatgattatcggtcaacacaagagtctcaaggtcacgactttcaccaccctaaacacaacaatttgtttttgaccatgaggtcaaatgcgctaggcccaagtgacgctttgcttgaggcacccttaccactaactactaaaagcaaaacgaaaaacggactcaaacccttaagaaggttgtcacgccatccataaatgggaagagctactcggttcacacaaactccacctttggaaagaatcgtggcattaagaaaaccaaaggcttattgcaaacattcaaaacaagaagctacgaacataaataagaagctacagaaaagaaaaatgcagaaagtaaaataaatatttacatgagggaatttaatcgaatatacaatagaggggatgaatatatacaatgtaacataaactttatatacagacccaaagtaaaaagtacgaaaaaatgaaaaaatgtaatgaagtactaaaattatatacataccaaagataaaaagaaagaaatcttaaaatctgtcgaatatatacattcatccaaatcaataaaagtagagactaccccctcaaatgaaagttggcattgtcctcaatgccaactaaacaaaataagcaccaagaataaaagggaaaaggatatagagactctctatggcccgtctgtctgcatgggatcctgagtggtccctggatccttaatatgctcgggaacctcagactggttccctatggcctactgctctactgctgggacctaggcctagacctagacaggctcctgggctgcatcctacgactgactagaggaggtctccggtaggtctgccaactggatgactgcatcatctgctcggggaatcatcctcttcctcttgggaggcctctgggactgctctagctgagggtgagatgttggcacagggtcttgtagcaataaatccaaagcgtctttctgccttcatcctatcaaccttaaccctcaactccttcacggactccttggaagcccgcgtctttctcatcttcttggcctccctagcaagctctttgagagcttttccatatgactccacagcgtccgtaagaaatttttgagtgtcaagaatttttttctagttgtccagaatatccttgagggcatcctcatagactgtaggacctgtagaggtggaggtgtcgactgagatgctactgcagtagtgagggcaaacaacttagaggaagctgtctgcatccaactgttgatgctaagaagggtctggcttagacattgtgcagtcactggatgagccgaggtagagggtatctctagagctgctaaaatggatggaccagggtggatgtccattgaggtggaggcaagatgagtaggagccactaccacaactggctcttcagacttgccagttggatcagtggatgttcccttgtagttcttgcctttcgggttgtcatcaccctgtatgttataccatgagaacggggcctttgcttttaccttgatatcaaatggccgcttttcaactttgcggtccctaaagtacatggtcaagaagctagggaagggttagttctatcaccttcactaactacctgtgtaatcacccgagacatcaccttcccgacgttaattgggtaccctaccatgattgatgctaccaatactgcccggtgaagagggagtgagttttcatgagtagtggggtccaatctgctacacacaaatgtttcccaccccttggcctcgaaattcaaacttcttatcaaaattttcactcccgcattcaaccaatcgggggtgatacctgggtttgccagatactgtgccaaccaaggacagacctcctcacctaattccatcttttccaaatacagcgactcatccttctcatcgaagtccaagtagtcatttattgttttcctatcaaacaacactttcaaattgcacaccttggtcactttggtgcccttcttgatgtgggcaacattggtgtagaattccttgactaggtgctcgtttgcatcctcacaattgtttaagaaatactcccagcccactctatctctaaattgccttctcacattggggttgtgaggcaaaaggtttctatctacaaaaattctctccgaaattaatttcctcacaggccaccattctttgaatttatggtaggccacctcactcacaaagtggtcttgccacacctccggatttctagttcgttctaccctaccaacctggggctgacccccttctcctactacctcttcttcccctactacaccctcttcggataatgaagttgtgggagaggtggagtattcatccccactaccttcagctgagccctcagacgaaccagaagatacatttactgacgcttggacagtggggaaaggtggaagagtgtctcttagtctgtttctctccggccagtcagggatgtactctgggattgagtctgaagatatatctcgggagggctcgtattcactcccagactggtcaatggacctatcagcagctttagtgagcttccttgtgtttttaatgttttgtcgggcttggggagtcaatcttagcatcttctgtttccctccccgggaggactctcccctgcctggttgtttagaacccttgcctcttgtttcaccattgtctgcaaacaacatccattagacttgttagtatcagtagaagaaattaagttcacaattgtagaaaataaaaagatgcagacagtagcagatgttgcacagtgcggaccgcacaaaatataaagcggtcgcatagaggccaatgcggaccgcacaaaaatgctaatactgtctgcatagaggtggtgttcagactacccactctctgaacaattgcaccacggaccgcacaaaatggtaatgtggtccgcattgaggcaccgtggaccgcacaaaatacaaggcggccgcggtggcaaacttcagagagctagtattttcatcctttatcaatgcggtctgcactgattttgtgccccccacactgagttatttgcggccgcacacaatgtagtgtggtccgcattgaaaacttcagagacttgaataatttttccaccatatgccgcactgcataaacacaaacatgtaacatctcacaaccggtcaacctaaaaataaatcctatattacaatgaaaatcaaagaaaaacaagaagaaaaacacatgggttgcctcccaaaaagcgtctgatttaacgtcgcagcacgacgcaagttaccatcaaatcatttgagatgaagaagtgccaccatgtggctatcatcagttttgccgaagtagtgcttgaccctatgcccattcactctgaaaacttccccatttttgttctttaaatcaagtgcaccaaacgggatcacacataccacttcaaaaggtccactccatttcgacttaagcttttccggaaacagacgtaaccaagagttgaacaagagaaccaaatcacccactttgaaatccttactacgagcatatttatcatgaaggtacttcatcttgtccttgtacaaggaagaactggagtaggcatggaatcgaaattcatcgagttcattaagctgctccacacagagattggctgcaatatcccattcaagatttagcttccataaggcccacatggccttgtgctctaactcaaccggtagatggcaagctttcccaaacaccaaccgatatggaaacataccaatcggagtcttgtaagaatcttataagcccatagagcatcatccaacttctttgaccaatcgatcctataagcattgaccgtcgttgacaatatctttttgatttccatgttgtagacttcaacttgaccacttgcttgaggatgatagggagtagaaactttgtgattgacaccatactttgcaagaaaaatgtcaaaagctctattgcaaaaatgagaccccccatcacttatgattgcacgaagagtaccaaaccttgtaaaactgctcttcttgagaaatgcaacaacactctgcgcctcatagttgggaaaagccacggcttcaacccactttgaaacatagtccaccgccacaaaaatgtatgtgttcccacatgagctaacaaacggacccataaaatcaatgcctcatacatcaaaaatatccacctcaaggatggtattgagaggcatctcatctttcttcgaaattccgccccctctttgacattcgtcacacctctttacgagttcacttgcatctttgtacaaagttggccaataaaatccacaactaagaactgtggaagtcgtcctcgccccgccattatggccaccatagggagaggaatgacaaacctccaagatactcaatttctcttcctctgggacacaccttcggatcacaccatccgtgcaaatcttgaacaagtatgtctcataccaatagaaatccaaactatctcgcttgagcttcttcttttggttagaagagagctcacacgggattataccagtcacaaggaaattagcaacatctgcaaactatagcattccattcatcgacaccgaaaggagttgttcgtcgggaaatgaataattgctttctaggccatcacgaggcctcccctcctcctcaaagcttgaagtaacaagacccatcgcatcagtctagctttggaatccttcttcgtcatcaagtatcggagtgcggcatgatcggtatgaataataaccttagcacccatgagatacggccgaaatttttccattgcgaacacaatagacaaaagctcttgcttagtcaccgtgtagttcacttgagcatcatgcattgtcttgctcgtatagtacaccggatgaaacattttgttcactcgttgacccaaaaccgctccaaccacaacgtcgctcgcatcacacatgagctcaaagggcaagctctaattaggtgcggtaatgataggagtggtggtcaacttatgcttgagaagttcaaaggcttgcatacatttttcatcaaacacgaacttggcatctttttctaacaacttgcacaaacgattcactaccttcaaaaagtctttgataaatctccggtagaacccctcatatccaagaaaacttctaactccattgatagatgtagggggagggagacctgaaatcatatcaatttttgctttgtctacctcaataccatgctttgaaattttatgcccaagaactataccctcttccaccataaagtggtatttctcccaattgagaacaagattggtttcttcacaacgggccaaaactctatcaagattcttcaagcattcatcaaatgaatcacccacaacactaaagtagtccatgaacacctccaaaatgccttccaccatatcggtgaaaatggccatcatacaccgttaaaatgtagccggtgcattacacaatccgaaaggcatcctagaaaaaaaaatgtgctatatggacaagtgaatgtggtcttctcttgatcttctggagcaatcaagatttggttgtacctagaatatccattcaagaaacagtagaaggcatgcccagcaggtcggtctaacatctggtcaagaaaagtcaaaggaaagtgatccttgcgggtcactttattcaacttgtggtagtccatgcataccctccaaccagtgatggttatggtaggaattaactcattttgttaatttgcaaccagggtcatgccacccttcttcggtatacattgcaccggtgaagtccaagagctatcagaggtggggtacataacccctgatcacctcctttttcacaacttcttgcattgcctggttcaacttcctttgatgctccaaggagggctttacatcatcttccagaataatcttgtgcatacaaaatgtggggcttatcccccgaatatcagctaaagtccatccaattgcctttttccacttttgaagcaccgctaattggcatcaacatgcatgttagtaagacaagaggaaagaataactggcaaagtagagtttgagcctaagaactcatacctaaggtgtgaaggaagtggtttcaaatccaacaccggaggctcctcaattgaaggctttgttggtggagtcttcctattctcgagatccagagatagtttcctaggttcataagagtaagagcccatcccatgtaaagcattcacgcactccactcggccctcatcatcattgacatcaagattcaacaatacggcctccaatgagtcctccacattgatcattacactggtgtcatcaattatcactattgtgacgaggtccataaaagagcacactttggtactgttgggctgtttcattgacttgtaaacatgaaagaccactttttcatcacccacccgaaaggtgaggtcccctacttccacatgaactaaggccttcccggtagcaaggaaagatctccccaatatgataggaacttcataatccacctcacagtccaagatcacaaaatcagctggcaagataaatttgtccacccggataaggacatcatcgataatatccaatgatctcttcatcgttctatccgccatttgtaatctcatggaagtcggcctaggttgcccaatacacaaaattttgaaaaccgagtaggaatcaaattgatactagcccccaagtcacatagagccttggcaaaatccgcactcccaatggtgcaaggaatggtgaaagcaccgggatcttcaagattcgggaccattgattgcactattgtactaacttggttagtcatttttatagtttcacaatccatagaccacttctttgtcaccaagtccttcatgaattttgcatagcccggcatttgctcaagagcctccaccaaaggcacattaatggataagctcttcatcatgtcaatgaactttttaaactgattctcaattttctacttatcaagactttgaggataaggcggaggtgatcttggaaaaggtaccttggctttaggcaccaccagctccgacatatctattacgtgttccctagacgggttcacgtcattttgagtttccacctcggcatcttgaatatcaatcatcacttcttcattcatattgtcatctatcacattttctacaaccaaaggaacttcatcttcttgcaactcaatatcatcactcaaaacttgcttttgtttagaggcattcacatcaccgcctcgtccactccttgtagttactgccataacatgattgttctcaccctttgggtttactactatatcacttggtagagcacccttagggcgtgtattcaaggactgagagatttggcctatctgaacctccaaatttctgattgaggtattgtggaaagccaactgtgcatcagaatctgcatttttcttcatcatctgttcgaacatcatttcaattctacccatatcattgctagaagaactaggaccttgggatggaaatgggggcggattgttcggttgctggtacattaggggcctttgaaagccttacccccggtttccttggtttctattgttccatccaccttgattgttattaccaccccatttattgttatcaccattccaatttccttgatggttttgattgttgttctgatcgccccagttgttgttttgattgtttctcccccaattaccattgtcgtgttgttgttgattgccccaattgccttgggatctccattattgttgattgaaagaattgcccctctggccttgataattaattattcatatacggcacctcctcattttgttcatcataaccatcattttggaatccaccacaactattgtcaaatttctccgaattcccttagttttgttgccctctttgtctttttttgttgacaagcatgttgacaccctctatagcattcacttggcgaggattttgaacttgctgcaactgtgcctttgctaattggttcattatagttgtgaactcagctatagtctgcccatgatcatgtaactccttgtgcaaatgagtaatcgtggggtcaccctggggcacattagctctactttgccaaagtgtcagccatcttgtcaagaatgtcacaagcctcatcataagagagcttcatgaagttgcctccagcaagttggttcactatgcattggtttgtggtgttaataccccggtagaaagtctgttggatcatcaccttggtcatatcattgttggggcagtccttcaccattgttctataacgctcccaaatctcatgcaaaggttctgtgggatcttgcttgaataccaagatctcatctctcaatgcatccatatgccccggtgagaaaaattttgcaatgaacttatcagccaactcatcccaagtagtgatggaatggttgggaagtcgctcaagctaatcaagtgctttccctctaagtgaaaatgggaagagtctcaaccaaagtgcatcctcggacacatttgtttgcttgctcccccaacaggtatccacgaaccccttgagatatttgtaagcattttgatttgcagcgcctgtgaaatacgcacactgctccagcaatgtcagtatcacattggttatttgaaaatttcccgcccggattcggggtggaacaatagcacttgcatagccttggttcggaagcactctaggagccactcttggaggtggcggaggagggtctggaatattatcatttacattagcattggcctggcggcctctacgttgtccttgaggtacaagaggcacctcatcatccccgatatcatctacctcctcccccacaatcacatttccaagagggccattggcgttgtttgcttccatttggtacctgaagttgtgacacacacaaattagtaacaaagaaggaaagaagaacaatacacaaaactatttagatagatagccaaaaccgttagctccccagcaacggcgccaaaaaggtgatcgaagctaaccctacactactattgagtagcgagaaaggtcgaagcagcttttacccgattaaggtcgggatcgatttccacatggagctagaagttggagtcgggtgtctatctaaagtggagttatgtatttgctcttaattgcacttctaaacattttgagttttgttttacttctaattgtatagaactacaatgatcaattaaactaaaataagctaggattaaactattgcgagttgttcaaatgattaaaaggcactaaggtagtgactttcgcctaggtggtcaattgacgggtacttgagtataagatatgattgtcacatttggggagtatgatataaccattgcacgattctactcactctacacctctcagtagttcgagtgattttttccgaattgactttctcatgaccaattgggtatgcaaatttgtacaagcaatcaaggttcaagttgggtattactatctctatgtttaaccctttaattggggctatcaatctcttgagtacgccccaattccttgttggaccaatttcagagacttaggctctctttctcaagaagagtcaaagtcaactaaacacaaactagtgtttgcaaccactaattcagcaattaaacatgaaattagtccaaatatcaaacacccatagacaatcaagcatcaaaataaaagatccgtcaattatccacactagggttgagccacaatcctagcttatgggtctagctactcataattagagaaggacaaagaaatagatgaagaaaaattcacattcattaattgctaaattaaacttgaagattcaatgttgaaataaagctaaaattactcaaaacagctaaaaataacgaagtcacgagcgcagccagtgtataaaactatctgatgacctaaaaatggaaaaagaagctatttatgctaagctaaaaaatttggacaaaaatacccctacggggttagtgcagaccgcacaaaatcacatgcggccgcactagggctctggacttgaataaacggctctctgaacttgggcaatgcggaccgcacagaatcgagtgtggttgcgatggcttctggtgcggtccgcatgaaatgaagcgcggaccgcattaggcttcaaacttggaattggcaactctctgaaccttctctctgctgaccgcactaaatcgagtgcggccgcattgatcccagtgcggaccgcacaaaaccttgtgcgtctgcattgccttttttgcctgaatagcagcctttctgaacctcacttgtgcggaccgcacagaatgttgtgcggccgcattggccttgttttgcctgagcttgtcttgtcttggtacttgtgcaagtttcactcctttttgagctgatctttgacatctttttaccttgttgatcaaacctgcaatcaagcgcaacttgtgagccttttgggactatttgtacacatttctaatcaaaacttaagcatgaaggagtataaaatgtatcaaaatccctagttatcaagcactattggggattgtgacttggtccgtcctgattgatgattttaccgcctatttgactgaaatctattttctatcatcactatttgggctgaatgccatatttgggcttcgtgctaactatttgaacccttcggtgatttttattgatatttcctcactgttttgactttatgcttgaactcagtcatgttattttccattgttttcatactcagccatgttttactcagtttttatacttaaatgatattttaaatgatgtttggactgagaaacactgttttactattgctcgagtggcttgtgaggatttttgactgagtaaggtcgagggcctatgttgtgaggaaacatttgatactgattatgaggccgagggcttgagatatgtacgccacgaggtgggttgattgatatgaggccgagggcctagtgatgatgccacgaggtggcttgatattgcgtttgggccgtaaggggcccctccaggagtctgtacacccccagtgagcgcgggtacccattgtgatacgagattgagcacgaggggctagtattgttctcagatactgtcatcttcttagatgttgcccgagggacggatttgttgatactgtgcccgaggggttaacctttatgtgtttattttcataattgactatcaattacctgcttaattgttgaaaaaggcttttcaggaagtaaatttgagttacatgatttttacctatctttcactggtttactgttttaaaaaggattttcactgcttcattatagcatgcttttgtgccttacgtgatttcctgctttcagtctttatttatgattattactcactgagttggagtactcactttactccctgcaccttgtgtgcaaattcaggcttatctggtcccgctcccgagtgttgatcattctggctcaggcggatccgaggagtctctaggtagctattggcgttcgcagcccggagcttccctatcatacttctttatgttcttagtttctgtattaaactctgtagtttgatttgtagtattctgaattgtttagatgctcattactagtgacaccccggtatcgggctgtgtttgggctgtatttcacatattatactatcaattgcttaaactttggtttatttcttcatgtttagacggtatcttaaatgcttaattgttaataatcggataatggaaagtgtcggctggccttgtcttcacgagaggcgccattacgaccgggtctgggttttgggtcgtgatacattatcaatacaaggaaaagaaaattttcacaattctttcatgttttctttcaggggtaggtttgagggaaagaaaaaaacctccatattttatgtttactatttcaaaaaaaaaggagaaaaataattcaaaatgaattagtgaaatagagaaactaaggagaaaattttttcgtgtagctgtaactaactgccttgccaatggcaccttgtacacttctattaatgcaggtgtcactgaactatttaggaatttgcaattaggttctgatccgtcacaaatccgtcgaggatgctatttttatggttttgcgtcggattggtccgtcgcatattctaaaaatttggtggtgaaaaaacactttgatcgaaaactatcgatttatatttgtctatttatatctatattattataaagtatgaatacaatgtcggtttacaaaaaaaaaattataatattaaatataataactcacaataaaagaacattactgaaattcttgacattaatattgtaatcctattaattttaggacataagactacacttaggaatcctaaataaaccaaacgaagaaagacaaaactccaaattggaaggaactattatacattcaaagtcataaaactacggtaggtttatggcttcatatatagcaagagagttcttctggtgtgatcttttaagcaactaaaagtaaaaaataacaaatagaaaaaaagatgtaatatgtcatatatctatgcataaagagtataaaatttatttaaaagttaaaacacaaaagacagatgttgtccttttcattttttatattttttgctttttaagtaatatcttaatttggtctattctaaattttaagttgcaacaggtaagtcattgttatgtttactactttagtaaatcagtataatatttgaaaatatgtaggtattctttattttgtttagcgacgtgattatttagttaaaaaaaactaaatggaaggtttagagataggtcgttgaattctctttcctttatattcagtaaacaaaaattacttttatatcgtaaaaactgtgaacagactcatgaagattaggtgcaaagatcaaatgaaagcaactaccatatagttttgtgcttacgagttaggaaaattatgcaattgataatactgctaaaacttatgttgcagaaagcaaattcttgtggtgctaaaatactgagttttcatctgcaacattgtactcttttattttatcttgcagattttaaggtgagtttaacgttttaattataatttgtaaatatgacatacttttattttctattttacatgtaaacatagttactctataaggcgggaagaaattaaaagtgttaaacatacgatctagagtttagaaagaacgaatgagtcatgctcattaaaatagaatctaagattttctcttgtgtttatttatttactatacttttatgtaatatctatttataataccgtcaaaatgacttgtctcttcatgttttagtttcgattaagatcaaattctttaatttttctggattttatagtatttgttttaattaaattagaatgttaacctttttgtttttttccatcgtaccttttaagtaaaaattaaacagtataagcaaattatatagtataattatccataaaaaagaaagtgaatcaatatggatatcttacaaaataagagaagaggataagaaagaacagaaataaccatcttaaagttgattgattatcttttgcaggtaaatataaatttatgttgaaagaatatttgaaattcttcctaatgcgtatgaaaaagactaccatgatgagaaaaaaacttatggaaatggaaggaatatattttttaaatatcatagcttattctttgtgatcactataacaattaaattaatttctaataatattattactgtagacatttagaaataaaaaaagttagccactaatgctatcatcattataatagaattagttagtctgtccgcgcttcgtgcggtcataaaaaggtgaacttatgatgtgatcttgttgtaaatttaggtgagatagagtcaacaaaatatttcaaagctcctcatattacaaatttcacgactaatttttattacatatgaaaaatagacaaatgattattctctaacatatgattatgaacatcactaatcccaagagataatatttaaaattgaaaattttcaattaacagaaagcctccccacgtaaaaatatcaaattcttgaactttgctataaagcattgaccacatcgttctctacacctgtatttatcacacaaatgtttggaatggtcaaagcttctatatatgcacatacttatacttgcgattacgtatcttgttagttgatcatcaccaaagtgtcatccatatgcagttatgttaatctccacctccaatggtgtacgtaaaattcaaagaccaccaaaatcaaaagaccaaagacattaagatcacccacgtttagtttagactatagagctatctattacgttaaagtcttgtcaaagaaggttttatttatgtcaagaatttagtaaatctggtaaattatataaatttaactgaattaaagtataaatttataataactaacagaggaagtcctctccttaaagcatcaaccgtggtttctccagttcttggtatatatagtgatgaacttcgttggagatattacttttgaattgcaatatgaaaaagaacacttcaaagttcaatagcaatagttgaacaacagccatgactgcagaaccaatgatgaatagagaggaaaaccattgttattccatgagcaatgattgttgaacaatcctgcagtttgtgaacaaattaatgagttttgacaacaaatattttacaataaacgaaaaaggacagagttcttagtgtaagagtttccaactgttagtcgtgataaacataccaagaataattgccattaatataagattatcatgagaaagaatggatattgatttggctatacttgtagatatttcaatgttccacctgaaacgattgaaaactatatgttgaaagagaaaaagtgaaagagcaaaacaaatggcttacttacaagaaaattaatctgaatggctaaaaatgtccggtgaaaaagaagtacaaaaacccaaaaataatacagtcatttcaagaattcattttcatgttatggattttcagatctgtaagaaacgcttaagatcacacaggaacgttgaccactatccaattcctctccattttcttaatatgctctttgcttcttcataaccatttcttggcaattttaaagaaggggaaaactgtagcaaatgggtactaaataccggcaggtgggaggaattaagaagaggctaattaagtgaattaaagatgtgaccgttttcttgtaacggaaaagaagcgtgttcagtttttcttagtagaacattttaaaaaatggaaaaatttaaggaaaatgctaaaaaaaataacaaaaaagataaatagtaatgctggtcaatggagggtgccacatcacttattctatccccaactttatatatatactagggaatttgccgcgcgtttcgcgcgatttcagaaatagcagcccatttcgaaaggattttatttataaatttattaagaattaaagatagaatttttcagctgtttaactaaaaaactaattttatatattgatgaaaaaaatcacaagataaatgttcttgtaaaattagagcttagaaaactacattttttattatcaaatattcttaaaaatgaaaaaaaaacttttaagggaaaaatcatatatttttttgtggagagagattaatacatgattctcttagtcttatatatttcataatacatgatctaaggacttgatgtttttaaattttattagatattagaacttttgtttgatgaacttgtcttctattcaaataaataaaagaaaataaaacgaaaagcaacgaaactaagtacccgtttggacataaaatttgatggaagatttcttcaaaaaaaaatcacttttttttcgaaatcagcgtttgttcataaaaattttaattttcacttgaagatgcatttaggaaattttcgaaaatttgaaaaattgcaaaaggttgtttttcaaaattttcactcaaatcactcataaaacttcaaaaacaacccaaattgaaatttatatccaaacacaattctaaatttcaaatactattttcactttaaaaaaaaattcaccatttttttgaattttataatttttatgtccaaatgcctactaaaaagtccggaaaaaaaacatattacggacaatgcctgcttgtacacatttaatttccttcacaatcttcccagaagcaactaattagtagtaaatccaagaatttttctcacatcacttttcagtcacttccaatttaaccaaaagaacataacggcacatttacctcttagttccatctccaccacattcaagctaagtttctgcttacactttttaataaaatacatgagatgggccttcacggtttttttcagttgaaattaaaaaattattttttttagattttttatttgtaaaagataaatctcttatgtgtaaaacatagatctctaatgtgtaaaaacaaatctcccataagttaaaaaaaaaaaaaagaccgaatcataaacctaaaaataactttgtaatggcccacaaaatcatttgactgcagttataatatagttatatatattccaaaatagagggaatgggaagtattaattattacataaaaagaaatagaaaataattgatataaaaatttataataaataaaaacgtgctatcacttcaagaaaatttataccattagaaatcaaattagaaattcacttctaagatcccaaagaagaatgaaacaataaagaacaacatcaattaaaaatcataattacctgtcaaacacaacgcatcaatgaattaccaaaaagcaaaaacatgataaataaaatggcatccaccatataagagaaataaatagaacaaacaacacttgggaacatttattgtcaggcaaaaataaaacatcaatgaattaccaaaaaataaaaaattatgataaatggatttacatccaaggtagtattgttctaagcctacaattacaaacagataaagaacctgcaagaaaagaagattccaaaagaacgaaaaaaagaatgaaaaaataagttggtggtgagcaactgattaaatttgtgttactttcatctaaagactatttagtttgtatgatactaaataatgttccaaatttattcacggtaaaaaattaaatatctgtatcttatatatatgaaattttcaagaaagatacctggaactattccgagagcattcacagtttgaaagtttgtttggtataataacatctgcagttgcaaaatttcccgtattggcgaaaatatgaaatttagaattaccttatggaacatgatgagttttgactaagcttgttgggaagctgacagaaccttgtgtctacagcctctagcattttgttgggttgttactaccttcaaacgttataattattaggaagaaactaaagaggtggggaaaagaaaaggaagagatagatgcgcaataaagagaatttagagtgaagcagtaattattgagtcatttaatgttatcaaataaggcacataaaaatagaagaagaagaagaagaagaagaagaaaaataagaggaaaaaaaaaaagataaatgtgtttcttggccacagaggtatgccaaatcatcttgcctatgcccacttatatatatatatatatatatatatatatatatatatatatatatatatatatatatatatatatatatatatatatatatattaaaagaaaaagttgcaaatttgttttaggaggagcataattttcatcatattctatttttattgtgaatagaaatattataaagtcttaccctttgataaataaaacttcttatttcctataattgttgtagaactttgattgaataacgtgcaaccaaacgtgttcgcacaagaatttaacttcctacactaaaaatgactaatattttttaatacttttacaacaaatgctcacggctcaatccctaatattgaattatttgtcttaccatgattttccatttgggaagtaacaaaattggaaatgtatacttagaacatcatttttaaattaaaaattattaagaggatatgattctaatattttgttcctcataaaataaatataataaaataaaaataacactaactaaccttaaaaatttatacgattgacgggaatatcgtgcaacgcatgtttgctcggagttctacagatatattggatatcaatgaactgtttggtgaaaaaataatcaatcatattaaatatgtttaaactataatatataattatctaactaacataactaaattgatcatttgtgtaagttctgatgatgtctttttattttgaatttatgtattatgctaatgtaataatatttttcactatttagatgattgttgtattattatacataaaatttatgttacaccctgtaactttaacaaacttgataccgttatatatgtatttgatatggtattttgagtaaaatatttttgtgatgaaaaaaatagtttgaaaaatatgactttatatagttattaatattactactttcgaatatgttttaaattatacacctaatatgagaaaagtttatgggattcctttttttgtaaagatatgaattattttcttacaagaaaagaaggttattttttttttaccattttaagaattaaggatacgaaaatttgtactctttatgtgagattaaaaaaattagaagttgagaaaatttatgcattttttacacgtatgttttaataaaataataagtgtatgtatttattttgtatggcaccacatgaccatgataataaagtatattatatgttattgtatgatatataaagtgtattaaaagtgaatagtactttaagtaatttgggataattcttaattgtgtgaataattgggtaattaattcaatattttggataagcttgctcatccttaacgcggcagcaagccaaccatatatgattatgactccgacgaatgcggcaggccgaaaatgacattgcaaacatcagtcgtgactccgacgaggaccgacaaacggcagccatcgaaactgccaatattcatggcaaatttgaggacctccaacaggagcgtgccgacgatttagcccatcagcaacatgaggcagacagactgactgccatgcagcaaaccataaacgacttgactgacaagctcaacgttgtcaatgctgccttacagagcctacttcgagaaggcgatcatcacatcaggggtgcaacaaacctcacccccattccacaaaagcttaagttggtcattaattaataatagatgtggcaagtttagaaatgtaaggatttggcaaatcttataaagtgagtcatttatccacttttaagaaagagttaaatattcattcctaacatattcattcttaagtaagcaaataagttctctttgttatgaaataaaagcaatttagtaaaacgtgaacaagaaatagagatagagagaaggaagagattttcttcttcaattgtgtgtattttcctatctattacaaggcctttatataggcataaatagtgaagaaaatatgtcatggaatatgtcattgaacatacaaattatgtcattgaatatgtcattaagcatttgagatgaagatcatggaggaagagtagacatccaccataatatgatatttatcataacactcccccttggatgttcatagataatgtgcctcgttaaaaccttactaggaaaaaaccctatagaaaaaaaattatagtgaaggaaaaagagtacacaggtttagaaatacgcattttggttgccccgttaaaaaccttgcaaggaaaacccagtgggccaaaaccttgtaaggaaaaaagagtacaacgcatatcaactccccctgatgagagcaccaattcacatccttgatcattcacatcccaatcttgaacactagtttcttgaaggcgtgacaaaactttttcagttaatgtcttagcgagataaagctctactcctacaaggaactctagagggtgtgtactctatggagtgacctcacaatcatcagggtactctatggatgtgctttatccacatagaatcactttaaaatcttttcagtgtatgctgattgatggacaaaaatttcatctttcatatactcaatctgtaggccaagacaaaattttattttttgtctttaaaaaatcattcatttcaaattctttctttaaacagtctactgcttcaggaagctccttgggagttctaatgatatttgaatcatcaacatacacgacgattataacaaattcaaatccagatccttttataaagacacaaggacaaattgaattattcttgtaccattctttcaacaagtactctcttgggcgattataccatatgcgcgctgattgtttcaatgcgtataaggattattgaagctttatttaataaacttggaaaccataatatgcttcagaacaatttaaatccttcaataatttccattatacgcatatcaagtttttcatatattgccagattaaaacctgaaatgccaggatatttataaatcttcttgtgacacaagtcgtctttatgtctatcgacttgtctttcttcttacaagaacacatttataccttcactggctttatactttcaggtgtttggactatccgtccaacttcacatttttcaggtgaaatcaatcttgattgcgtattttttattttattttattttggccaatcatttatctatccaaatttcatgacagatttgagctgaagatcctcgtcaatattaataatattgagtgcttcattatattaacaatatcgtcgacgatcactttacgtcggttccattattacctaataaagacataacttattgagatctctttatctcattgttttcaggtaactgagcctctcacatgaggtcttacgaagtgttatatcgtggtgctcttctagatcacttgcctccttattatgaccatctcgaacattttcccctctccttcttcaaggagttttatctttggaactgattggtctgttacgcttcatgcgtgccatagactatgtccctcatggacgttattctatttggagtattagcagctgaaatatgacatttagctttggtcagcaaatgcgtctggcaataatttataaattaattatcacttgaacttcaagttcatattttcttgtacgaggatctatatgtattcataataattcatttcacatatcactttctcagctatccattttctccccctaattttgggatcaccaacatatttcccaaccttctttgggaacccatctttgtgcattgtggtggcataattaaatcatatagcacattcatatttctatatagaaattatttggttcctgaccctgaatcgattgtgaaagagagaaattttcataacatggctagatgcgtacaagttctggtgtatattacataatacatctcatatcaaatttcatttttgggagttttgttctcataaccaataatttagctataattggaggcattccgctaaaccaacatggatttaaaccagtattatcaagataaatcatcataatttacattctggagctgtgctctaataatttgagcaagcaatcttgcaaaagccaaactgcaagttgataacaaatgcacatgtcaccatagaatagatgcacctattaaaatcatataatagaaaacgatccacatggcaggtgactgggcccatatatttatcaccttttattcgttctagaaatcaagggattcaatcccaacttttaactggtatatcatgagaataagcagcgtaagggaattcttgaagaatcttctattacttcaatatatgccaatgtaattttcaattaattttccgcatcataattgaaccgggatggtcaactggtcatgccaactaatatttgttttagtaaacctctagcttgtggcatatgattccagcatcatgcttatatttgtgtagtacaaatagaaagaaaatcgagtaacctttcatatttacctggtataattatagaaatatgaagatattcaatcttcctttcatttatagtctcaatatgccaactactttgacttatacatttgaaactcaaaaagtttcttttgagactttacaatatcaatgtcatgaataattttattcatctagatagtaaaaaattactttccggagctcttaacaatttttgtactacaagatcttttgccacaccattcatatgataaatgattccttcatgaacaaaattatatcataataaattgtcattgtcaaaatcatcataagcaacgtcattttttgctttaattttgctcttaataacttttataaggaataccaaaatattttggggtatcacatgtacgagaccaatgacatattcatgtaaccacacaatactatttattctctttatttctctcaaacctccctcaaaggtgagttgtgtggtactcatccaatcatgtcttgcatgtctttattcattacttttatcatatattactacattcacctttaggaatgggtctacattctcaatgtttatcactagtcacattctcttcaaggaatggatcataatcagtgacgtgcttcataccaatttgatggtaaacattgccttcacattttgaaggattattttgagaacccttgttgttctccttttataatcattgcgatgattattattatttggaacactcgcgttcattgttcaaccacttgtcttcatttagacttattatgcactgctaccacattcacttcaagaatggagctattcaagtgggacaatcttcatgccttttcatgaaaaatattttttttctttagtcatcattatatcatcaatatggtacattgggactcaaacccaatgtcttaccaatataaagacatgttacgccataataaattgggactcaaatccaactcttatcattatggagcatcaggacttgatcccgatgtcttaccctcaatcaatggcataataggctaaacaatattgagattcattcccaatccttaatttcaatcacatgccaagaaagttgtacagagttaatttgcaacttagcaaatcaaatttgctttcttaaataagtgtacaaatctcaaatcagtgtaaaagctttatcaattatttgtagcatctatatgaaatacaaccgtttgtaatcagaatatttcttctatattgtattagagtttaaatggatcataaaataattatcataatatttattaagtctctctcaaaaatattgttgttttcgggatatatcctacctattggatttggtttaacgccatgactttccttcactcaattcaaccaagcaattagtgaataaatttatcaaaagtacaacatatatgtaacaacagatatatagtactaatacataaattcaatatttatattacctgaaaagtgacattataggtaacaacttaccagttgtagcttatggatcattcatataaaatacttgaaaatggtaagtcagtagcaagcatcaagtagatcatgaatactcgaaaatatctctgctagtagtcatactaatcattgtttgctttcaaatgatacgaccataaattatgaagtatactttctcaatagctggtttgttttccaaatttcaaagaagtaattaatcaacctagataaagatgtgaagtatttcttgttttcttcaagatgatttatgcttctaatcagtatgaccaattttattttatttttaattttttttattcctttttttggtaccatatgcaagtgtaaaaagtttggtactatatgcaagtggaaaaaggatatagcatagatattctgatgcacaggataatcaagatgtggttcctttattactttttacctttccccataaattagctgaactaaatccaaagaaggataattgcatagatattgtatatatttttgaattctcgtttgctaaatgcttgaaatgatttttggccacgatcttctctccatgttgtatgatttgcgtgccaaatttttgtgtcgtctgtactgatggttttttgcactggtattgctttgaagtttgaagatactttaaattaatttcccacacctgcaataaaaaaaggaggaaataaatcatgggatttagtcaagaggggaggatgtgacgacccggccggtcgttttaagaatttaggcttgaaatgccgaaagttgaatttttgaagtttccggttcgataatgagattttgatccgagggtcggaatgaaattccaaaagttggagtagctccgtagtgtttaatgtgacgtgtgtgcaaaatttcaggtcattcggacgaggtttgatagaccttttgatcgaaagcgtatttttagagtttttggaatttttaggcttgaatccgatgaaaaataggtgttttgatgttgttttgaccgttctgaaggttggaacaagttttaatgatgttttaggattggttggcatgtttggttgaggtcccgggggcctcgggtgtctttcggatgctcaacgggtcatttttgaacttagagaattgcagaaaaatgttgcagcagtcagttctggtttccttcttcgcgtttgcaagtggggtctcacattcgtgaagaggagctggggatgttgaggaattaacgcttcgcattcgcgaaggagcttacgcgttcgcgaggctgagggactttgtgcctatgcattcgcgaaggcagtctcgcattcgcgtaggggaagagaaatgatcatcgggttcgcggctcaggcatcgcgtttgcgaagagggagactggtgtgtggaactttagtgcatttcactctcgaccgtagcctcgcgttcgcgaagaagaacgcgcctgggcagaatgtttaagttcaaaatcgagggtttagccatttttatcaaaacttaagcttgggagctcggatttgagcgaaattttgagggattttcagagatatcgattgggtaacgattcttaactccttttttcttgtaactcattaatacaaacgtgaattcatcatttaatttcggattggagatgaaaattaggaaaaagttagaagaaagttcttagacctagaattcgacttttgattgggaatttgaccttagatttggataattttggtatgcatgaactcgggagagtgtgaggattttgaaaatataaattttacccgatttcgagacgtgggcccaaggggtgttttagttattttacctaatttcgcgtattagcttagaatttctttgtagaatcagttacttgaagtgttatttacgttatgaaattgaattgaatagatttgggtcatttggagtcgagtactcgtggcaagagcgtggtttcagattgattattgagccagttcgaggtaaatggcatgtctaaccttgtgggggggaccttccccttaggattggtatatttggtaattgaaatgtcttgtacgtgaggtgacgagtgcgtacttgtgctaattattggaaatccggttttcattaagtaatcactagtatgttcctttcctgtttttattacttgcattattatgcctgttgttagcttaggaaagcatgtctaagtgacttaattgttttatttgctcaacctaccttacttgaattatgtgcagcatactaggctagaatcatttgttgccttaatatgaaattttgtcatttctgtatattttgctgttgctgctgcatatttatttgggactacggatgtgggattccggtagctcccccttgtatgtttattttgggactacggatgtgggattctaatagttcccccttgtctttttattttgggactaccgatgtgggatgccggtatatccccctgcacaattatatggaactacaggaatgcacccggtagattccccccgtattgggtatttacatttgggactacggaacaggattccggtagatccccgcgcactatgagttggactatcctggaagatccatcggatatgtatatatggggctacaggatggtatcctggtagatccctggttgttattttggtgctaagtcgcatttctttccgtgttttgccttgtgtctgtaatagttgttgttgtccctttttatatcctgtgttacttttactgttgtatttatttatattgttctgttctacactgtcaaaatttatactttatttaacctcagtagggccctgaccttcctcgttactacccgatcgaggttaggcttggcacctactgagtaccgctgtggtgtactcatgttgcttctacgcatgtttttcatgtgcagatccaaatactgcaactcagtcctaccacctgtaaggcgaggtgactgctctagagacttcggggtacatctgccacgtccatagaccgaggagtccctttctatactagcttttaacatttgcccttctgtattttttttccttgttagatattctggagttagacattgtagatatccaaaggcttgtggttccgtgagttttcggttcttgggatagtgtacttgattctgagaatgttgtgttgtatatgccgagcggcattttaactattgttttcattcagttattttggcttttgattatttcttccgcaagtttcgtttatgttcagcatttgttaggcttagctagtcgtagaggactaggtgctgtctcgatggttcacggagggtgaaccggggtcatgacaagttgttatcagagctataggttcataggagtcatggatcacaagccggtctattaaagtttcgctgatcggtacgaaaacatctgtaattatctacgagaggctatgtaactgttaggaaaattccactttatttgatttccttgtcgtgcgatattttgacatcacaattctaaacttctgtcttttattctctcatagatggtgaggacacatgctacccgagattatcaggcacccgtgccccctattgcaaccgtcagagaccggggctggggtagaggccgaggacgcgcacgtggtgcagccagagcacttatgcgagctgccgccgaggtaccaccaacagttccagccggagtccaggcacctgacacgcctactgctacaactactccagctcttcaggagactctagcacaattcataagcatgtacaccactatggctcaggcagggttgcttccccttgctgcagctacatctcaggccgggggaggagcacagactcccgccgctcgtacccctgagcagtgagtgcatgttgagcaggtccctgagattattcttgtaccgcttgcagtgccagttcagcccgagggcagggcagcggcttccgaggaggagcaactaaggcttgagaggttcaagaggtacaagcctcttatattcaacggtctagcatcggaggatgctctaggatttctagatgagagttaccgcattctctgtaccatgggtatatccggatcgagcgaggttttcttcactatcttccagcttcaaggagccacttatgagtggtggcgcatttatgagttacacagtctggatgaggctgcttcactgacttagactcagttttcagatctgttcttgagagtgtatgttcctcagagcctcagggacgcatggcgcgcagagtttgagcatttacgccagggtactatgactatctcatattatgcagtctgttacactagtttggctagtcatgcaccagccttggtttctactgttcgcgagagggtttaccggtttattgagggctttattcccatcatcaggttagcatggctcgtgagttggagatggatatttcttatcagcaggtgcgggcattgctaggaggattgagggtatgcatgccagggagagagagagagagaggagagggaggccaagaggtctcgaaagtcgggccatttctctagtgcccgtgccccagctccaggtcgtcattgtaggggttatatgagtcgccctgttctttcagctcttccagtagccagtagtattccagctcctcctagacctcaagagccttattatgcaccatcggtatctagcacgccttctgtgcggggtgctttccggggttagtccaagacctggcccgagctagtcacagccaccacgtcctcccagagcttgttttgagtgtggtgacacacgtcatatggtgagggatttccccagacttgggaggggtgcacctccacagacttcttagccacagtgtgccccacagagttctcaggatatggttacagctccagttaccccacctgctcagccagctagaagtggaggtcggggaggtagaggtcgccctaggggggaggccaggccagatactattcccttcctaccagtaccgaggttgttgcctctgattctgtcatcacaagtattatactggtttgtcatagagatgcatcggttctattcaatctagtctctacttactcttatgtgtcttcttatttgatccgcatttgggtgtatctcgggattctttgagttctcctgtttatgtttctactcctatgggagattctcttattgtggaccacgtttatcggtcgtgtttggtttcttttagtagttttgagaccaaagcctatttattgttactcagcatggttgactttgatattttcttgggcatggactggttgtcgccccattatgctattcttgattgtcacgccaaaaccgtgatgctagctatgccaggcgtaccgcgtgttgagtggaggggtactttagatcacactcccagtagagttatttcttttcttaaagcacagcgtatggttgagaagggtgtgacgcatatttagcttatgtgagagatatcagtattgatacccctttagttgattcagttccagtagaactggattttcccgatgtgtttccagctgacctttcgggcatgctgcctgatagagatattgattttggcattgatctattgccaagcactcagaccatttctattcctccatattgtatggctccttctaagttgaaggagttgaaggatcagttacaggaatttcttgataagggttttattcggcccagtgtatcaccttggggtgctcctatcttgtttgtgaagaaaaaggatggttctatgcgtatgtgtattgattatcgccagctaaataaggttacagtgaagaactgttatcctttgcctcgtattgatgatctatttgaccagcttcagggctctaagattgatttgcgctcaggttaccatcagttgaagattcgggagccatatatcccgaagactgctttcaggactcggtatggtcattatgagttccttgttatgtcatttgggctgaccaattccccaacagcctttatgcatttgatgcacagtgtgttccggccgtatcttgacttattcatcattgtctttattgatgatattctggtatattcccggagtcgggaagatcatgagcagcacctgagggttgtgcttcagactctaagagagaagaagttatatgctaagttctagaaatgtgagttttggttggattcagttgcattcttaggccatgtggtatcgagtgagggtattcaaatggatccgaagaagatagaggccgtgcagagttgcccagaccatccttagctaccgagatcttcagtttccttggcctggcgggttactaacgttgttttgtggaggcattttcatcaattgcagccctatgaccaggttgacccagaagggtgctccgttccagtggacagaggagtgtgaggcgagctttcaaaagctcaagacagctttgactacagccccattttttatattgcctacaggttcagggtcttatacagtctattgtgatgccttgaggattggcctcagagcggtgttgatataggacggtagggtgattgcctacacgtccagacagttgaagatacatgagaagaactaccctgttcacgaccttgagttagcggccattgttcacaccctgaagatctggcgccattctttatacggtgtgccttgtgagatttatactgatcatcagagcttgcagcacttgttcgagcaaaaggatctaaattcgcaccaaatgaggtggttagagttgctgaaagactatgacatcactattttgtatcacccgggcaaggacaatgtggtggccgatgcttttagtcaccgggcagagagtttggggagtttggcttatttaccagcatcggagaggcctatggcgatggatgttcaagtcttagccagccagtttgtgagattggatctttcggatcccagtcaggttctagcttgcgtagtttctcggtcttccttatttgatcgtatcagggagcagcagtatgatgaccctcatttgcttgtcctcaaggataaggtccagaacagtgatgccagagatatgactattggtgattatagggtattgaggatgcagggtcggatttgtgtacccaatgttgatgggcttcgagagttgcttctagaggaggcccatagctcgcagtatttcattcatccgactgccacgaagatgtatcaggatttgaggcagcattactggtggagatggatgaagaaagatatagttggatttgtagctcggtgcctcaactgttagtaggtgaagtgtgatctccaaagacctggtgggttacttcagcagatagagatttcggagtggaagtgagagcggatcaccatggactttgtagttgggctcccacggactttgagaaagttcgatgctatttgggtgatttatggatcggctgatcaagtccgctcactttattcctatgtgtactacttattcctcagagcggttggcagagatctatattcgggagattgttcgtctacatggtattctagtgttcatcattttagatagaggtactcagttcacattacggttctggagggccgttcagcatgagttgggtactcgggtagagttgattacaacatttcaacctcagacggatggacagtccgagcacactattcagattcttgcggatatgctctgtgcgtgtgtgattgagtttggagggtcttgggattaattcttgccattggcggagttttcttacaacaacagctattagtccagcatttcagatagcactgtatgatgttttatatggtagacggtgtagatccccggtgggttggcttgagccaggtgaggccaaattattgggcacagacttggttcaggatgctttggagaagttcaaggtgattcaagatagactacgtacagcctagtctagacagaagagttacacggacgaaaggttcgtgatgtttcttatatggttagagagcgagttctgcttcgagtttcgcctatgaagggcattatgagatttgggaagaaaggaaagttgagtccaaggtttattggcccttttgagatattgaggcatgttggggaggttgcttatgagcttgctatacctcccagctttgcaggaattcatctggtatttcatgtttcgatactctagaggtatcacggtaatctgtcgcatgtgttgaattttagttcagtccagttggacaaggatctatcctatgttgaggagccaatggcaatattggataggaaggttagaaaggtgaggtcaaagaatattgcatccgtgaacgttcagtggcggggtcagccggtcgaggaggcgacctgggagaccaggcaggatatgcgcagccgttaccctcaccttttcactacttcaaatatgtctctatgctcgttcgaggacgaacgaatgttttagtgtagaaggatgtgacaacccggtcggtcgttttaagaatttatgccccgatgccccgatcccccatagaacagctgaaacctgcaatttttccaagtctaattctactctatggcctatccaaatctcacccgagtcctcgggactccaatccaaacatgtccaccaacctaaaaacatcatacggacttgctagtgcattcaaattactcaaataacaacaacaactatgaatttagcatcaaaatcatgaaatttcttaagaacaacaaattttccaatttcctcaaataaggtccgattcatatcatttcaagtctgtttcttaccaaattttacagactcgacttaaaccacatataagacatgtaccgggctccagaaccataacacgggcccgatagcatcaaattttaaacacatttcatttccaaaacctataaataatttcagaaaacaattttctttaaaaattcatttcttaggcttgggacctcggaattcgattccaggcatacacccaagtaaatatttttctacggaccctctggaaccgtcaaatcacgggccagggtccgttcacccaaaatgttgaccgaagtcaacttaaattcattttaaagtcaaaattcattatttttcacatattttaacatattggctttctcgccacgcgtccgaactgcgcacgcaaattgaggtgatgcagaaagatgtttttaaggccttggaatacaaaatttacttttaaaacaagtgatgatcttttgggtcatcacatagcataatagtagctacacacgaactctcgtcacctagtgcgtatgtagcccccgcatttagtggcaaattatttgataatatcacctatggggacaattccctcttacaaggttagataggagactcgcctcgctccaagcgtacttccaatatcaagaacgagctcaaactctcaatttggagccgaacgatccaaaactagataaacgaggtaggaactagtcaatacaagcttacaagatcgcattctaacgatttaagcaatttcacaaccttaaacacaagtttcctaaaatctgaccccgggtccacgtgcccggattccgaaatttttcgaagaaagttgttctttataacctaaggaccaataatatatgatttctaatgcatttcataacaaacttcatggttaaatctaacttttatcaaaatcctaggttttgctctaactccatgattttaccttaatctttgtgtgttaatctacccaagactcaagtattaagctagaaataagtagggtaaacttacctcaagatgctaggtgaaggtcctctctcaagagctccaaaatcgcccaatgggtgagtgaaaaatggccaaaatgacttagagcccgtaataaatgaagctcactacttcagtgatttctgcatctgcggtcctgctactatgagaggatcgccggatctgtggaattggccaagtgggctaggaccgctcctatggacttgaagccaattctacgcagctgcttctgcaattttgggcctggcctgccttggccgcatctgtgagagaatgaccgcttctgcggtctcgcacctgcggctgaccaatcgcaggtgcggttatgacagcaacctgaagcttcaactcttcttaaattttccaacttcactcgagcctcgtccgattgacgctcggggatcccgggccctgcccaaacataccgacaaatttgaaatcatgaaacggacccgctcgaatctccggaacgcccgtaacaacgctaaatctaagaatcaccccttaaaaccaattggatcaaacttatgaacttcaagttcttcaattcacttctaacgtgccgaaacgtacttatactactcggattgacaccaaattttgcgggcaagtcttaaatgttatattggacctatactaggctctggaaccaacatacgagcctgataccaatgtgatcaatcattatttagtttttttaaatccttagaattttagtttaataatttctaataaaaattcattactcgggctagggaccttagaatttgattccgagcatacgcccatgtcccatattttcctatggaccgtccaggaccgccaaaatacgaatctgggtccgtttactaaaaatgttgaccaaggtcaaacttagccttttaagaaaatattaaggaatcaaatgagcatattccaacccaaactcttccaagtcccgaaccaaccatccccacaagtcgtaaattagttaaagcaagtacgagaagtttcatttaggggaacggggttctaaaaagcaaaacgaccagttgggtcgttacattctccacctcttaaacaaacgttcgtcctcgaacggacatagaaaagtacctgaggtgctgaataaatgtggatatctgctctacacgtccttctcggactcccaggttgcctcctcgactgttggcccttccactggaccttcaccgctgaaatcctcttggatcttaactggctatcctgcctatcagtaatggcaactggctcctcctcataactcatactctcatctagctgaatagtactgaagtctaacacatgggacaagtcggcatgatacctccgaagcatagacaagtgaaaaactgaatgaactcccaataagctgggggtaaagcaagctcgtaagcaacctccccaactcacatcaacacctcaaatgggccaataaaccttgggctcagcttgaccttcttcccgaacctcataacacccttcattggcgatactttcaagaggaccttctcacaaaccatgaatgatacatcacgcgccttctgatccacgtaactcttctgtttggactgagctgtgcgaagcctctcctgaatcaactttaccttgtccaaggcatcttgcaccaaatctttaccgtatatttagcctcaccaggctcaaaccacccaataggagaacgacaccgccgaccatataaagcctcaaatagagccatctcgatgctggactggtggctgttgttgtaagcaaactctgccaaaggcaagaactgatcccactatcctccaaagtcaatcacacatgctctaagcatgtactccaaaatttgaactgttcgctccgattgatcgtcggtctgaggatggaatgttgtgctaagctctatatgggtccccaactcactctgaatggctctccaaaaatgggaagtgaactgagggccaatatctaatacgatggaaacaggcactccgtgcaacctgactatctcccgaatgtaaatctgaggcaatctctctgaagtgtaagtagtcataaccggaataaagtgcaccgatttggtcaacctgtcaacaatgacccatactacatcaaacttccgcaaagtctggggcaacccaactacgaagtccatagtaatgtgctcccacttccattgtggtataggcatctgctgaagtaggccacccggcctctagtgctcatacttaacctgctggcaattcaaacacttagccacatactccattgtgtccttcttcatcctccgccaccaataatgttgtctcaagtcatgatacatcttcgtctcactcggatgaatggaataccatgaactgtgtgcctcctctagtatcctctccatcagaccatcaacattaggaacacataagtgaccctggagtcgcaaaacaccatcctcaccaatagaaaactctttggcactaccctgaagcattgtctctctgagaaccgccaaatgaggatcatcgaactgtcgggccttgatctgccccaataatgaagactgaccaacaacacacgcaagaactcggttgggctctgaaatatccaacctcacaagtctattagccaaggactgaatgtccaaagctagtggcctctcctctgctggaatgaatgccaagctacccatactctctactttcctacttaaggcaaacgcgaccacattttccttgcccggatgataaagaatggtgatgtcataatccttcagtaactcaagccatctatgctgcctcaaattgagatccctctgctagaataaatgctgtaagccgcgatgatcagtataaacctcatatgacaccccatatagataatgcctctatatcttaagagcatgaacaatcgcggccaacttcaaatcgtgcacaagataattcttctcatggatctttagcttacgtgaagatatgcaataacttgcccttcctgcatcaatacacatcccaatccaacacctgaagagtcgcaatatgccgtatacatccctgaaccggaaggcaacacaagaactggtgtcgtagtcaaagctgtcttgagctcctgaaagctcgcctcataatcatcataccaacggaaaggagcaccctcctgggtcaatctagtcagaggtgatggaatagatgaaaagccatgcacaaatcatctgtaatatcctgttaaccataggaaactcctgatctcggtcactgaagtaggatgtggccaactctaaactgcctcaatatttttgggatccaccttaataccctctcctgacacaacatgcccaaagaatgccactgactctagccaaaaactcacacttggagaacttagcatatagcttttgctctcgcaaggtctggagcactactctcaaatgttactcgtgctcctccaagctacgtgagtatatcaagatgtcgtcaatgaagacgatgacaaaggaatcaatataaggtttgaacaccctgttcatcaagtccataaatgttgttggggcattagtcaagccaaaggacatcaccagaaactcataatagttatatctagtccgaaatgcagtcttcagaatatccgagtcccagatcttcaactgatggtacctgacctcaagtcgatcttagagaacacctaagcaccctgaaactgttcaaacaaatcgtcgatacgaggcaatggatatttgttcttgatagtgactttgttcaactggcggtaatcaatgcgcatccgcatagtctcatccttcatcttcacaaataacactggtgcacccaaggtgatacactaggtcaaacaaaccccttaactaacgactcctcaagcttctctttcaactccttcggaaccatacggtatggtgggatggatataggttgggtgcctggagccaaatcaatacaaaaatcaatatcacgatctggtggcatgccaggaagattagaaggaaacacatcggcaatatcccgaactactgggactaaatcaatcgttggagactctgcggtggtatcccgaacataatccaaataagccaaacaccccttctcgaccatatgacaagccttcaggaaagagataacccgactagacatatcaactgtggaacccttccactccaaccttggcaaccctagcattgataatgtaacagttttggcatggcaatctaggacggcgtgatatggagataaccaatccatgcccaggatgatcgatcatataaagcaacaggagatccgctctagtctcaaaaccacagaatgtgactacacaagaccgatagatccgattcacaaccatagaactacccacaggagtggacacatgaacgggagtgctcaaaggcgcaggaggaataactaggaaatgagcaaacagagatgatacatatgaataggtggaccctggatcaaataataccgaagcatctctaccgcagacgaaaataatacctgtgttgacagtatctgaggctaatacatctggcctagccggaagggcatagaatctggctggagcgccgactggctagcctccacctgactgagcagtagctggctgacctcactctgcctggcccccacctctaggatggcctctacccgtctgtcccccgcctctgggaggctgagcaaccggtgctgaaattataggctgctgaccctactgtactaccttgccccaaagtttggggcaggtcctcttcatgtgactcggatctccacactcgtagtaacccctcggcaccatagcctgttgccttgaagtctgagcctactgagccgaatatccactagaagaactctgaatggctggtgggcgatatgaactctctggcatggcattgaagtaagcactggaagaaccctgatgactagaatacccggtggaggaaccctgaatagctggtggacggtaaggactctccggtatcgcactaaaataaggtctcactagagaacctcggggaggtggtggtggtgctgaatacgggggtatgctgggctgacccctcccggagtgccccctacccctagctggggaacctctaaactctctagaaaatcggtccctcttctcctactgaaactgctctctacccctctggcgataaccctcaatcctacgagcaatctctaccactagctgatactcagtacccatctccacctctcgggccatgctagctcgaataccgaggtgcaaccccgcaacaaacctccgcactctctctgaatctgtgggaagtatcatgagagcatggcgagacaactcagaatatctcgcctcatagtcggtcacggacatctgactctgttcaagatgctcaaactgataccgcagctcttccctctcaaagggtgaaatatccctatccaaaaataactgtgtgaactgaccctaagtgaggggaggagaacctgctggcctgccaagaacataagactgccaccatctgcgggccctgccctccagctgaaaagtagtgaagtctaccccatacgactccaatatcctcatgttgtgcagtttgtccctacacctatcaatgaaatcctaggaaacctcatgacgctcacccccgaagacaggatggtgaagtctagtccatctatccaataacttctgcgggtcaccatccgcagctagtctgggctcgggcactactacagcaactggctgagcctcatccgcaggtagtgcacccgaagtctgatacattgcagctgtgtggctaggagcctgagtagtagggcatgttctccccctcctgcctatgatataggtggatctactggaaataaactagcctgagtcatggtgtccatgaacagcagcatacggccaatgatctcttggaaacccggtgctatcataaagtccaccggggtaggctctgctgcgggcacctcgccctgctcctcaatgataggatctcctgtaggatctgctagtggtgctaccgagacagctttggtacgccctcgtcccctaccttgagccggtgctctcccccggcctctgccttgacctctagcaacggagggagcagctcctcccgggtctaaaaaattagtcgtacgtgtcctcaccatctgtgagagaatagaagagggaaatttagtataccaaccactgcacgataggaaataggtaaagagtagttttcctaacaccctatagactctcgaagatgaatacatacgtctttgtaccgatccgcaagactctattaggttttcccatgacttgtgagacctacatgaacctagtgctctgataccatgttgtcacgacccaattctactatagttcatgatggctcccaacacccttgtcaggcaagccaacgcggaagtgttaacaagtcctcattttctctttactaaaacaagtacagaagttttctaaatttgcagttaaaaagcatgtgataattaacaatgtacaataatagttatacaattcccaaaagaatagtctactaatgtgtgtgccaaaacctggtgtcacaagtttacgggcaactagtagaatatacaaaagaataaatctatcctactgtctgaaatagaatagacaaccaaaataaagggagactccatcatgctgctgaatggcacaggaagggagcagctcactatgaaaatctcggacacggatcaagaatgcgcaccggactggtaaccagatgtacctacctcagatcctgtacaattaagtacaaaagtgtagtatgagtacataaacaatatgaacccagtaagtatcctgtctaatatcgaagaagtagagacgagaggtcgacttgacacttactaaggtcaaataatatgagaaatgaattatactgagcatggatataataaataattagcagtttatagcaagaaataacaggtcctctcctagataatatcaaagttgtccactttcattccagggcaaataataaagctcaattcatagaaaaatactgagtaaagcatgcgcaagtagtgtcgaggacgtacggcccgatccaacgtaaaagtaaattgtgcactgccgagggtcgaatggcgcaaaccatagatgtatctattaccccgctcgcgaatcaaacatgcgacgcggtcaaatgtaattaaaaacaacaacaagcagataggaatatataaccgaggagcaattactcatagaaatatcaacttctctttaaaaaggccaagaaagataatgttcctcttactagtctcatttaccataatcaccatgatttaaacaatccaaattaaacataaagtttcaagaataacacataaagcatatttttgggtcctagattactcagacttagcataatagtagctacacacggactttcgtcacctagtgcgtacgtagcccccgcatttaatggcaaattatttgattatatcacctacggggacaattccctcttacaaggttagataggagactcaactcgctccaagcgtacttccaatatcaagaacgagctcaaaccctcaatttggagccgaacgatccaaaactagataaatgaggtaggaactagtcaatacaagctcaaaagattgcattctaactatttaagcaattttccaaccttaaacacaagtttcctaaaattcaaccccgggcccacgttcccggatttcaaaatttttcgaagaaagttgttctttataacctaacgattaataatatatgatttcaaacgcatttcataacaaaattcgttgttaaatctaatttttatcaaaaccctaggttttgctctaaccccataattttaccttaatctttgtgtgttaatctacctaagactcaagtattaaactagaaataagtagtgtaaacttacctgaagatgctaggtgaaggtcctctctcaagagctcaaaaatagcccaatgggtgagtaaaaatggccaaaatgacttagagcccgtaataaatgaagctcactgcttcagtgattttcacatctgcggtcccgcttctgcgagaggaaggccgcatctacggaattggccaagtgggctgggaccgctcctgcggtcttgaagccgcttctgcgattttgggcctggcctgccttggtcgcatttgcgagagaacgaccgcttctgcggtctcgcacctgcggctaaccaaccgcaggtacggttatgacagcaacatgaagctttagctcttctcaaattttccaacttcactcgagcctcgtccgattgacgctcggggctcccgggccctgcccgaacataccgacaagtttgaaatcatgaaacagacccgcgtgaacctccttaacacccgaaaaaacactaaatctaagaatcaccccttaaaaccaattggatcaaacttatgaacttcaagttcttcaattcacttctaacgtgccgaaacgtacttatactattcggattgacaccaaattttgcaggcaagtcttaaatgtattggacttgtactgggctctggaaccaatatacgatcccgataccaatgtgatcaatcattatttagtttctttaaatccttagaatttcagtttaacaatttctaataaaaattcattactcaggctagggacatcgaaattcgattccgggcatacgcccaggtcccatattttcctccggaccctccggggccgccaaaacacgtattcgggttcgtttgctaaaaatgttgatcaaggtcaaacttagccttttaagaaaatcttaaggaatcaaatgagcctattccaacccaaactcttctaaatcacgaaccaaccattcccacaggtcgtaaattagttaaagcaagcgcaagaagtttcatttaggggaacgtgattttaaaaagcaaaacaactagtcgggtcgttataattacatgatcattggcatgacacattggtatctttttgaactcccgtaagttttactattctatcatctgtgtatgagttttaaaaatacgtaagttggttaaagttgcatttaactaggggcgtcactgctctatcgaaaacaaggggtgtcactgttgtttcgagaagatgctgactttttggtttatatattgcatataactaatattagatttttcctgaaccatcccaattttcttggttttatggcattatctgttagattcagttaacttgaagtacttaagttttaaaaaagacgcataagaatatttactaagatgcctcattgtcatgtaaaataaaaaaaaattaacttaacaagaaaaattataaaactctcactacattttgcattgccgattaaaaaaaagtcttctctattaaaccaagaaaactagtactaagtgattacttattaaaaaataaaaaagaactagtaagtgatattgctcaaaagtttgaaatgattctattcttataagtattaaggttgcctatatttctaattcccaatatgtcctactaccatattatttatatatgagtctcacataaaggtgtctaacgggccggatcagcccgattccggaccgtctcagaccggtgaaaaccggaaccggcccggaccggtagaagggggccgggtgaggctgggttataggagtaaggcagtttgtaccgttcacttttgaaccaccggttaaccggaccggtcaaacccggtcaatgaacaatactgttcatctggttaaccggcccggcccagaccgacccagaccgatttaacggtaacaatttcttttttaagcttgggcctcagattctgaccgttggcaatggtccatttcacaatatggtcgttgcccaatggctaaaattgacatttagcccaatttttgggtttttttaaaaaaaaattaaccccctttgaaaaactataaatacaccccatcttcctcatttctttactcatctctcaattctcaatctcaagttaaatcatgcctcgtacttctagagtgcgctcatatgttttgaaacactttgaggtggtagaagaaaatgaagaagttcagaaagtaaagtgcaagaattgtggtcaagtcttaaatcttcgttcaaaatctggcacagacagtttaaggaggcatataaagaattgtcttgagcgtcctccgaaaattcgtatttaagttgatttgagacaatttgtgttattttaaaattattagacgtatttatgcttaatgttttagtttgttagattaatttgatgtattattatgcatgaaaatttagttttactattttttttgttaatttacttgttaaatgcaaacttcaattttgtaattttgaaataaatgtagcacttgcaatttataagtgcaattttttcccatcttcattatattctttatatttttactttatattaatatagcttacaataattatacaaaaattcaaaatacaaaaaaaaagtaaaaataacaataacccggtccggcccggccccatgaacctgtaacccttacggttcaatttttacctggatgaaccccaacccattaaatccggtatgccccaacccataaccgatctgaaccataacccgtacgggtactaaattcccctacccagcccggcccggcccacccattaaacacctatagtctcataacattacaagagatcgtattgacttacttcactatgcatgtgcatttacccatgactcatatgacgttatatatgcaccaccacctgatcagctggtatacgttgatgattctgcccacaatggcactagatggcgttatatacgtatatatatatcatatcatcttggccactgtgggcaaatcatcaacgtataccaactgatatatatatataggatatgggaaaaggttatgacgttatatacgcaccaccacctgatcagctggtatacgttgatgatttgcccatagtgaccgagatgatatgatgggatgccctcagaggcttgatgattttatgtacgtacagacctatgcattatatgacatttatatgcatgccattataaatattttatgatttacaaagctatccagacttacaagtatagataatcggtttggcgagccctcatagtagacgagattggcattcagcgaaggattggtaagacttcacctcattcagagtgcaggcgagtctataagtcatcgtgtcagagtttttgtacagacttatgggtaggtcggtaccctgtcccattttatgtcaaataatcttagaggctttgtagacagaggttcagttggtacagtatgtcagaggccttgacgggcccatatgtattcatgttttaataaatatgattcagtgatacagtgttgcccacttatagttatgcattacgagttgtagctatgttggcccatgatagttataaaaggaatgaaaaagttacagagtgattcgctcgggccaatgcgacaccaggtgccagccacgcctcccaaggttggggcgtgacaatttctttcattaattaaattttgttgttccttcatataaataaatgtttaaaccatcacatataattattaacgtgcaacgcagttcatagatactagtaataaataaatgtagatagtcgtttatgtttttttttgttgctcaacctcgatatatttgatatattcattttttctgcttgggactaattcatcgatatggagtatcatataaaacacaaaacttcaagactaatgtggaatcaaaagagctcacatgcactaagcgaaataataatataattatagacttgcatggtcgatattgtcaaccagcttaattaagacagagatgcaattattgcttttattttatggtgatttttggaactccaagaatcaaaagaagacttattaaagaatgacagtctctcttttgtgctaaaattttacattgtttgcaacaacaaaaaaaaaaggaaaaaaagaagatggctgatgtagcagtgaattttctggtagagaatttgatgcagttgttgagggacaatacagagctaatatttggagtgaaaggtgaggcagagaatctgcttcaagatttgagtgagttcaatgcgtttctgaagcaagcagacaagtcccgcagcgataacgaagttctaaaagaattggtgaagagtatcagaaaagtgacgaatgattctgaagacgctattgataagtttgtaattgaggcaaagcttcacaaggacaaaggggtaggcaggtttgtggacattgcgcattataaaagagtgaaagatgtagcccttgagattaaaggtatcagagatagggtgaaagaaatccgtctgaacaatgcacatggccttcaagctcttcaagatgatgatccatccaacagaggcgtggaagacagaaaggtacctatattatatatgccttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaatcgaatctcgctcattttcaggtaagatttacttagctcgctccttgctcgcgaagcggcataccaataaaaagaaaagcgttatcggatttccatcgtcgttgtccgtcgataggaaggagatactgagaatgagagacacaaagataagacttaagagaagcgaactaacaagtgaggcttgctcagttgataaaagcacctctacccacgaccgttaggtcctgggttcgagtcatgctggaggagaagggtggaaacactatagatcctcctaaattgggagggatattaaaaaaaaaaaaaaaaaaaagagaagcgaatagagcaatttgaagagaagttagagagagacttcgatataaactaagaaaaaataagtctaaagagagtggatgggttcggattctcggatatccgatccaaatgcacagccctaaacccagcattgcatttatatatatatatatatatatatatatatatatatatatatttaacaggtttagactccttaataagaatgaaggtgagtaagattagatgacaatatgctgcttaaatataaccaattcagatgtctccattgagcctccagcagaatataatggtacaatcaacggaactgtattgcacttaaatatactttgcacaggaagatactcctgcgcaaagttcatagaatgattatcaattttatatgagaagccgacataatcaacaaaatgagtatcgtaaaaatgtgaaagtaagaaggatgtgtggcatttcttggacaatatctatattgttgtaatgttagtgttctatatatgtcttgggaaaatccacctttgcttctatttactactgagtatcaatttttccaatacaaaacaaagctaatcacctatcttttaattaagctgcacaaatgcgtacgtaatacaatatgttttggttgaatataatgtttcttttcttgccaatgaacgttaacttcatatatatgtctaatcttcatctttgatattaatttaaaagcctcccgtggttgaggaagatgatgtggtgggctttgatgaggaggcacagaaggtaatcgaccgtcttcttgacagatcagatgaattagaggttattccagttgtaggaatgcctggtcttggcaaaaccacactagcaactaagattttcaagcatcggaaggttgaatacgagttctttactcgagtttgggtttatgtctcgcaatcatacaagacaagagaattatatctcaacatcattagcaaattcaccggaaaaacaaaacaataccaatatatgtgtgggaacgtatcaagattgctttcccgaacaacaaaaagtgcaatagagtattgttgaccactcgagatcacaaggtggctcatcattgcaacaatactccacatgatttaaaatttcttagcgatgaggaaagttggatgttgctagagaagaaagtttttcacaaggctaaatgtcctccggaattggaaagacctggacagagcatagccaggaagtgtaagggacttccccttgcaattgtggtgattgcaggagctctaatagggaaacgcaagacaacaagggagtgggagcaagtggatcagagtgttggtgaacacctcattaatagaaaccagccaaagaattgtaataaaattggtgcaaatgagttatgatcgtttgccttacgacttgaaagcatgctttttgtattgtggtgcatttcccagaggctttgagatccctgcttggaatttgatccgtttatggatcgccgaaggcttcatccaatacaaagggcccttatcccttgaacgtaaagcagaggattacttgaatgatctcgtcaacagaaacttagtgatgataattcaaaggacgtctgatggacaaatcaaaacatgtcgtgttcatgacatgttgcatgagttttgctggcaagaggccacaacagaagaaaatcttttccaagaggtaaaattaggtgttgggcaatttgctcgtgagatacagcaactatccacctaccgccgcttgtgcattcattcctcagttctggaattcatttctatgaagccctctggtgagcatgttaggtcattcctatgtttttcttcagaaaaaattgacatgcccccggttgacatcccaaacataccaaaagactttccattgctaagggtgttggatgctgaatccatcaaattcagttgcttttgcagggagtttttccaattgtattttctgaggtatattgctttctcatctgactttatcaagatccttcctaaacatattggggaactatggaacgtacaaaccctcattgttaacacacaacagagcaatcttgatattcaagcagacatatggaacatgccacggctgaggcatctgcacactaacacgtccgctaaattgcctacgcctgttgccccaaaaagtagcaaggttacctcggtaaatcaatgcctacaaactctctccacaattgcaccagaaagctgcacagaagaagttttttcaagggctccaaacttgaaaaaactgggcattcgtggtaaaatctttatgcttctggaaccaaataagtccgaattgttcaacaatgttaagaagctacaatgtcttgagaacttgaagctgataaatgttggtcaaagtgggaaacaattacgccttcctccaacatatatatttccgacaaatttgaggaagctaacattattagatacctggttggagtgggatgatatgtctgtattgggccagttagagtaccttgaagtcttgaagctgaaagacaatgcatttaagggagaatactgggaaccaaaagttggaggttttcgttccctactagtgttatggatcgaaaggtcagatttagcttcttggaatgcttcaagtgatcactttccaagacttaagcgtcttgttctcgtatcatgtgataaacttgaggaggtccccattggcttggctgatatacgcggcctccaagttatggagttgcgaaattcaaccaagcaaacagcaaaatctgcccgggatatacaggccaaaaaagacaagcaaactcaagaaggggctaaaacccaaaggttcaagctttctatattccctccttatctctgatcaacgcggcgtacagcttctttgaaaggttagttaaatcttccctcactactgtttgatttgtgtttcataatccaaaggaaatgtttaacttgggtgcaattctctgctatctccccttttccaaggaggggtataacttgctaaaatactcgccagtaacatgcagataagaatatttagtaactatgaatttaaacaattcaatcagccagtttctttatctcaaaatcctgtccgttatcatttaacaaacattgaccagaaatatagatgctacaaagttatctccttgcattttgtgctggaaacctaacttctgcaatccttttctgttttcttttttatttcaatggttctctgacttccatatactaataggagtgacagatcacaattttgaacatcatttggaatagtaatcgactaatcgtcagtgtcaaatagttggatgcagtttaattacactctaagtcatgtggcaataatcttatgcatattttctctattggctactcgttttcccttgggatttttggttgcatttagtgattaaccttatgctttgataaaaattcagtaggtaacattctccttggtagggttttattttttttccattctggcctacaatagcaatataggtttttattaaaggaaaaaactaaccagtgagcgttgctattggtacaggtctgaaataattgcatgatgttggctgctggctttttcttccttcagctttatttggctcactgctctcacagtgaagcctattgcattgtcataagtggaacgactgaaccacagttttatgattcttgggtttctttctgtatttcatttgtttgatgtgttttctgttttattttggggttgaaactgtatgttgttcttttcattgtggtgttaacccataaggatagtgtactttaaactacaataagagttgattgattgttggagtcgttggcttcaaagcacaaaatatggatgtacctcaactgcttcatattccagatatatatagtcaggtaaagttataattaactgcatcacactttaatttatcatgcttaaaaataaaggtttgcagattaattacacaaatatgcaagtgattcagtgagataattgcttctacgaatctaaaggtatctcaagaaagctgaatctgatgttaagcgatggcggtacttgaaaataggcctaggaatggaaaccaatactcttaattctgcagtttttccagctgctccaagaggttgcttgaaaatgtacaaggagccggaggacaaagaagaagtattcaaaaatcacaaaaaatccatctgtttatatatattattctttaaagttacaatagatgatatgacatctcttagactagaaaataatatatttgtttttttctcattgcagcccaaaatttctaaataaatgactaataatattactctctctctcatctgtttagttaatttaaacagatgagaatgtgagaggtttttatacactctttttctctatccaaaagtctctaattacaattactaatgacaattaggagtaattactatttataacggagtaggtcaaaccgaaaaaaaaaagttacaaggtggtagtcatttttatttttgttttcatgctttgcgtaaaactgaaaagacagagagaacttatactgttatgttgccgttgaccactctgtcctcggaggtacagatcattaggagctcgattaatattcctaatcacattcaaaaacttttcttttccagcttcactcacgctcaaatcgcgcaacagatcatgcataccgcatcttttgactgaccattgagcttcctccttgtgaccattactaaatttcgacaagccagatcttccaaacaatcctctgctacttcttccaggcttcttaacttattactctttagaatcccctctgcaacccacaattggatcaatctcatgatcctcggggaatgttcctaaatggaggaaacaaggtttcaagtgaataggcaggtgatagtaactcatagcaagtaccgcaaccatatggaactgggtaagtgttctatatcccaaagtaattatacttcatgattctatggttatattcatcatttatttcggatttaaatggacgaaatcaagatttttgcaaaacttttcaagaacgaaaatttaagatttggaggtccacaatacttgaacaaaatggtgtggtggaatgtaaaaataaaaatgttgttgaaattgcattagctcttcttgatacatcaaatgttccaaaaatattaggcaatcatcttccgtcattaaacaaaattgcccctattttaatttattcctttttaaaaattgcccgaactactctcatcttaaagtatttggttgtatatattttgttcttcttcaagatcatgaacgtcataaattatcctctaaagctggtaagtgtatttttgtggggtacaatgacattcaaaaaggatatttgtgttatgatccaatacgccattcattgagaatttctcgacacgttatcttctttgaaaattcttttacttatgctagtaaagactcacaatcttctactaagtcctttttgcaaaaaaaattcactcatgattttgttggccataacaacctagccactggtccattgtagaacttgctcgctactacaactggtactactgatgactctgatccttttttgataatgattctaccttggtaaacgctaatcctttacctcaataacatgagacacatattattccgttaaatcttaataaccaaccttctcctcctcgtcaaaatgccattagacacttacttcgtcacgttctccctccagatcgatatgaatactcaccaggtgaatatggcagaccatacgccttgctaactatattaaattctatggttgtgccaagttcttatatgcaggcaagtggtcagaaatgctgggaggatgcaatgcatgaagaattggttgtccttgagaaaaatgatacacggggatatggtggagagaccgaaaaatgcaataattattgtaagtagatgggtgtactcaatcaagatgaaagctgatggatccctatatcgatacaaggcaagattggtggctcaagggtacaaatagaaatatggaattggctatgataaaatatttgctccggtagctaagatgacgacaatatgtatattgcttgctttcgcgtcaataaaaagttgaaagttacatcaactggacgtcaagaatgttttcatgcacggagacttgcaagaagtggtctatatgaatccactaccaggttataaacattctagcgcaaattaggtgtgtcgtcttaaaaaaatctttgtatggattaaagcagactcctcgctcttggtttgaaaaatttcggacaaaaatcctaggtgctggttttactcagagcatctcagattattcattattcctacgtcggtccagctcagatattactattctccttatttacatagatgatgtgattatcacagaaaatgatgaagttggaatctctcatctgaaaaaactattagactccttgttcaagatgaaggacctaggaaagctaaagttaactattagaagtcatacgattgagtccgcaaaagtatgcagaagatcttcagttaactaatctcacagatgataagaaggttcatactccaatggaagtgaatacgaaatacaaaaaagaggaaggagaacattttggagatcaaactttgtatagacgtttggttgggtcacttatatatcttaccatgagtcgtcatgatatctcttatgcagtacacgtgttaagttaattcatcactaagacttttaagatccactactcagctttgctcagggttattagatacataaggggtattgtgaatcgaagtctcttatttccatcatattcatcgctggacatggtgggatatgctgatgcagattgggctggatgccctgattcaagatgatctactacatgctggtacatgatgcttgtctcgtgcatgatctcatggaagtgtaagaaacaatcctgaacatcgaagtcatccacagaggcagaatatagaagtatgtttgttgcatgctttgaaatcatttggctacgaaggctattatcagaacttgacatcaagatcgaaggatcaaccatattgtatgtagacaataccaatgcaattcgaatagcaaccaacctcgttcatcatgaaaatacaaagcacatagacgtagacggcaactacatcagagaactggttgaagatcggagcattaacctaaggtatatatcatctaattaaagatcaactagcagatttgttcacaaaggctatgccaagaagtcgacacaattatcttctatccaaactcatgctttgtgatacatagcattagtttgcgggagggtgttgactataccttatttaagagcccaatctcagggatctcccattatgcctaacagtcaaattgtagagcaaattagctgcccaatttcagggatatttgtctagcaattagtaggctagtaatcaggagataattgagactcctttgcttgtataaatagcttttaaatcctacaattctgaacattgaaatatattagtattctttcattttctgtatctctctctttttcaataaaggcttcaacgacctattttaaattgaaagtgaatttcttctcatccttttttcttcttttagactagtaatttcccttaaaacggaagaaagtttgtagttcccaatctaaatgatatttaaaaattgggtttccaatgtgaaagatataaaagagagttccaaatatttcatttctcccaaattctgtaatgaccagaagatcacattaccaccaaatatatgtgatgatgacagacgagtaaaaaaacaacttcgacatagttgtgaatgagaataagagggggttacgttgtcaatactttaaattcggaagaaattcaaaaatagctagatttacaagtggtcatttaaaaatagtcacagtttcaaaagtaattaaaatttagccatttttcatgtaaagataaatctaaatgaaaacattgttcaaaatccggaaaaatactgcagcataatatactggagttccagtatattatactggtccagcataatatactggagtttggagcaccggtgctccagtctccagtatattatactggagccaacaaagtataccggtccagcataatatgctagaagttcatatacaggtgcaccgaactccagtatattatgctgaatcgatctctgttgcagcaaaatagtggctattttttaatgacttgacaaacgctgactatttttgaatgaccagtccgaaaactggctagaccttactattttaactgaatacttttcaaaatcattgttaagaaataatttgaatatttttagtaaaactaataaatgttagaaaagggtaaaaagttaccatattattataggaaatattttaattttaccattcattatactttgggactattcatacggttattttagaaaatcgtctcatttttacccttgacctagtggagttcaaacctaaagcataatggtatatatttttaaaatcataatcaaaagtaaaatgtataaagaccctctttttaacaatgttttgatatgtggaatatacccgtcaatattggggctctattaaaatcaaaagctgatacgaaatgaactgataaatctacctcaatttaaaattcatttaatgtataaataaataatcttagaaatttgttagaatataaaatttacctcaatttttaataattattttttgtattacctgtattaagtttatctttacaaagtttttactttcttatattctcaattgtgtaaatagattttgagtatttattgttattaattaaataactgatatgtgcaattttttaattttaaagttcttattctgctcatttatttcattatcaaacgtcattattccatatgcttaattattacttctcactttttttgttctaaaataatatctatttttcaataggtaaaaagtatatcatgttattaaagaagaaaaaaaattaataatttagagggtaaaatggggaatcaattgagatatgagcagaaaaatgcctattgatcaaagctagagacgtctaataatacgtaagtcagcaatcctaaaatacggtttataattttgcatcttaaaatcgatttataaatcgcatttgacacagctccctaatctccctgctcttttggctgatcaacctttcatctttctcgttgaatgattgtgcctttttttctaaatttgtttgttcttcaaaagagtacattagcaaatgattattgccgactttaatttgttccaaatgagtaactgactattaattttgtatgcaaaagcaggtgacttggataccgcacacattattatatttgacaagttgcaattcaaatgcctgatataatagaatgctatgattgtaggatacgatgcacaagggtattggagaaaataggcctgagtaccatagattgaacagagagttgtacatccagatcagtatacatttgcatagatcagtctttagatagcagtcctggagcagggtaaagaaagcacgtgctctattgattaatagccaaagtaatggaaatattataatagtatccttatggacggacatgcatgtatttcaagagtagatgatggctatctcgtgtttagtaagtccttggaaaggaatagggtgacagatgaaataatatttcgaggccccaaaaagtgttaatagtgaaatacataataatatttcgcttagataatatgaagttggtaggaaattaaaataaaacatctttataagaaagaaagaaatactagttaaactttctattagtggataaagttttttacgacaagatccaatgtagtatatttacaaacacattattaaggaaaaggcataagtatcctccttgaaccaaggccggatttttaattacacgtcttatctttgcggggtcttattatatatatatccctgaactattaaagcatcatgctttcatacaggatctgggaaggggtcgcaccccaactagatgtgatcgatataggtaatctattctgatataagcatcagtgacaaataattatgtattatatatacgaaaataataaaatgcatacatatgataaggcatactcattttgaaaatgagaggacaaaacttctaaaaatcactccatgagcttagatttatataagaaggtttttgtcacgatccggatttctcatcctcgggagtcgtgatggtgcctactaatatgagatagacaagctagtcctttaaactaattacttcactatccatttatttctttttacaaacataaagcgataacagaaaaacagcaaaaatttaaattaagcggaagaaaacaataaaatatctgaaatttgtatccattacactgcttaagccttaatcacccaaaacatggtgtcatagtaccacagacggtctaaaatttactatatacaaagtctgaataacatgagcgatacactgtttctgaagcaaaagatgaaacaggaaaataaagataaaggggacgccagggcctgcggacgcttgcaggtctaccttggatctccgcgtggactgaaggtagcctctaactacggtccaagagatgcttcgggatctgcacatagtgcagagtgtagtatcagcacaatcgaccccatgtgctggtaagtgtctagcctaacttcggcgaagtagtgactaggctaggaccagactaccaaataaacctgtgcaattcaaatacatatacatcgaaaaagaaatacagaaataaccagtcaagtatgggagagggagcatgctatggggaagatgttaattccgaacagaaagacaactgtaaatggaagaagcaataaatctcagatatcaataaaaaaaaaagcaataaatgcacggcatcacccttcatgcttttactcttatcctcaccaaagcagccatataatgaaaacatgcacggctgtcacacctcctttttgcgcgccctgccccgaggggttaggtgcgcgggtggagttttttccaatttaagtgacaatattcgaaatgggattattcatttaattcagagtcgccacttgggaaaggtttggcttttggtgtcctaagtcaccggtttatcttgaatcccaaatcgaggaaattttcgacttttccaaatgaagtctacgaaccagaaattctaagtaaggaattctgttgacccgagggaaggtgttaggcaccctcgaatcccgtggttctagcacggtcgcttaaattgttataatggctaaatatctgatttaaatacatatcatgacttaacgcctttattaagtttaaaccgcttttgttattatcatttattttatagaattgcaacgtcgtgaaaatgcatctcgaaccacgtcacaatcaatgcacccgcagttgttaacacatttcgactccattgagatttgaatttgggtcgcataaatgcgcacccgaatttaagaatgtaatctaattaagccgcgcctaaagggtctaacgcgttatgatttctgagaaggccatgagattcactaaacggcctagcccgaattctaaatattatgattagttgaaggccccgcaattcgcatttttttttctttttacttggcgaggctcgtctcattaaaataaaacctacaatgactacatttcttattgttttcatttccagaaatggaagaaggaaagatgcatgttaattgaaataaaaaaaacggattactatcaattcctaatcacttataaaaatgaaaggacgccataccttacgaaatattttggttgaacaaggaagctatatggaggtggatgaaatgcaatacttaattcggacatttcctcgaatcgagcttaactagacttatttaagctaggttaaggaaatcgaatgctaggcattgttactaatggtgattcgaacatgtacctatatgttgcctaacggtcttgataaatggaaggaagataacacagaacattattgtgtaggtggaaatattctatcttatgcatgtcattatctgatgggaaaccagtcgaaaattctgtgccaattatccacaccttctatatattatactattacatcttgtacttagcaaacaactagaaactaagatgcaaaaaagcaaacttgattgagtattgtctaactaatctttcactactggattacactaatcaatttatacgacagagatcagtgtatcacaaacagcacaaaacagacatctgaatcttcttcaagaactcctttcatttcatgcttttgaactgttacagttaacaccaaagtgggatttgaaatgtgtacctggaacaacactgaatactgaaatgcaaagaagaagtgaagcagaaaatcagcaacagcaggaaaccaaatagcagcagcaacagcaggtaaccagatagaaagcagaatcccagtacaagatgcagctggagccaatgaaagatgacagggtgtggcaagttcccagtaatatgaatcaaaatttaggcaaaaatagatctggggatgcactgatgctacacacaactaaaaatctcaaacagaacttaggagaaaagatatggaacagggaaatccggccagatgagagttaagacaaagggggaaagatgcagttcctctttcctgtgttatcctccctatatctattcctgtctgtgtgtatttatctgtatgtatttccactctctcttccaaaactcctcccagtgtctgtattttttaacagccctcaaggtccagtctgtatatgcctatctcctccagatggtatctccctttcaaaactcctcacagtatctgtatttttctttctcttcctctaattctgtctatttctatctcctaattctgtccctctctatatccctgtgtgtgtgtcctcccagaacttctattccccccttttataagcctcaaaactcaaacctttatcagcctgtttggattaatcaaataccccctcccatgtgctccctttttcagttccactttagctatttaagtattaatcccatgacattcccttggcaggctttaacttttcattttattatctaaaagcaagtatgggcattaaaatatatctgacagcatatactgtcagattgtttaaacttaaaagcttcttaatgcagaaaaacaggctgtgcacaaggcacatgaggtgcaccaatgcacatgctgtgcaccagtgcacatgccttccaattcaggatttaaacataaacaatcccttttttacattgactgatccaaatcaaacagctataagtaaacaaaactggttctgaattgatttcaacaaatgttcaacagaagcaaatcgatttactatgctcagacagttgaaattaattgacgacacatgtcgactcgactatattagtatgaacatacacaatcgtagccaaaaatcagacatttaaacaatattgatacatggttcgtattatactgactaagcaggaatacactcgaggagtcaaactagtcagtccaaactcgaaaatcagctacttgcacaaacaaatacataatgccttatcagaataggaggggggaatttagacaaacaaacagaggttcaggcgaagtagttgaagcacagttgatagaggtcaaagacataaacagaaaacgaacagacccttacaacaaacaaacaaaccaaaaacaactaagaaaagaaagaaaactcaccttaaaccgcaaaaagatcaaaaccttaactcagacttggtcaagcctttcttaaggctgaacggactttaaacgaagtgtttctcagacgagaaacacttggattaaagtccattagaccttaacctctttggttcgaacggatatggaccagtgacgaagaacccacaaattccaaaactcagatctgggattcatgcttccctgatcagattcggaccaaaccaagtatggtttggtcacgaggggggtctggggagtatctggtacaaaactgggattggttgggtcagatcgagttttgactcgaatcttcgaatgaagattcgaggacctggggggtgattcgaaacatggggttggtagatttgggttcaggatggcctgggggtcctatggtgttcaagggaaggtcaccggcgtccatgccgccggctttcatggcggaagtatgcagaggcggctagggtttagggctgttcgtttggggagacgaagcagctggggtattggatagggggggtagggtagtgttatgtacttatatagttagtgggcaagtggatcctggccgttggatgagacgagatgaagggccaggatccttcggctaacagggaacgacgtcgttccaagggtgaagggttagggtcggtccgggtgagacgggtcgggtttattggtgggttatggggattgatcttggaccgttggatcggcttggtttaaacggttgtgatgggttggcattgaaacgacgtagctttggtgttaaactacgtcgtttcatggcctgggggtgggctgtttggactggtggcttgggctgtccgcttgggctgagttcgttgggccaattttaacaaattggcccaagtccggaagggccttttctttctctttttttttttttattttttttttatttttatttcttttcttatttattttaaaacaaaactaagccaaagaatcaaattaaaattaaatacacattcaaatacaattatttgcacacatactaaaacatttcaaaatcggtaaagtcaaaccaaacaaaatcacggacgaaaaatgcctattcacgatcttctatttaacgaccgaattacggtttgaattacgcaggacacatatatattttttgaattttattttaataaagtaaataaataagaatgggccaaaagcacaaataaatccacaaggtgccgcacaaaaatccgaaattgtaccgcggggccaattatatattttttatttctttttggagcgattgtcgtgtgaagcaaaaatcacgtgctcacagctgcccctctttgttcggaaacacgaagggttttcgtgcaaagatcaagtgagcgtgtatgagcgattttgcctatagaccactccgtatgaagcattttttgaaagatctgaccgaatcttgcttcaaagatttcctacatatcctgggctaaacaggaatcaggtcaatgtagttcgagaagttttggtagctggggctaccatgggactgcaatgcttgccgctactgctgctgctgttgtcactgctacgtcactggctgccttattacaaccaagcgaaaattggaaactgaactaactacttttatgtatgtcaactgctagttacaagattcctatctatgattcttttacgacttgatcttgggtcttagctgattctgcttgtagactctgatctgaatcttgatgcttgcgagttgcggcgacttgttttttaatccccaggataccgaataaaatgtgaccggcagaggtcaggactttagtcaaatgttggggtcgatctgctttccctttactctaatatctcgggatatctctttttgtctttttcttctttgattccgaactgggatttatctcgtgggtcatttcgatccatgtggctcgaggtcggacctgcgggaggaaagaaacaaacaaacgaaattttctgccccagtttcactaggaaaatttcgttacttattcaccaggaagttcataaagttgatgaaagaggatatgcgtgctcagttcagggttggagccctaatatcgactagctggggaaaagttcagtgtagggttttaaaacccttatgccaaacaaaggaagaattcagtttagggtttaaaaccctaatgccgcctaaaaggaaaaaagttcagtttagggttaaaaaccctaatgctgactaaaaggaaaattcagtttagggtttaaaaccctaatgctgattgcattggaaaagctcagtttagagtttaaaactctaatgctggctaaaaggaaaaaagttcagtttagggtttaaaaaccctgatgctgactaaaagagaattcagtttagggtttaaaaccctaatgctgattgcatggaaaagctcagtttagagtttaaaactctaatgctggctaaaaggaaaaagttcagtttagggtttaaaaccctaatgctgactaaaaggaaaattcagtttagggtttaaaaccctaatgctgattgcattggaaaagctcagtttagagtttaaaactctaatgctggctaaaaggaaaaaagttcagtttagggtttaaaaccctgatgctgactaaaagagaattcagtttagggtttaaaaccctaatgctgattgcatggaaaagctcagtttagagtttaaaactctaatgctggctaaaaggaaaaagttcagtttagggtttaaaaccctaatgctgactaaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaaggaaaattcagtttagggtttaaaaccctaatgctgattgccttggaaaaactcagtttagagtttaaaactctaatgctggctaaaaggaaaaagttcagtttagggtttaaaaccctaatgctgactaaaggaaaattcagtttagggtttaaaaccctaatgctgattgcattggaaaaactcagtttagagtttaaaactctaatgctggctaaaaggaaaaagttcagtttagggtttaaaaccctaatgctgactaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaaggaaaattcagtttagggtttaaaaccctaatgctgattgccttggaaaaactcagtttagagtttaaaactctaatgctggctaaaaggaaaaagttctgtttagggtttaaaaccctaatgctgactaaaggaaaattcagtttagggtttaaaaccctaatgctgattgcattggaaaaactcagtttagagtttaaaactctaatgctggctaaaaggaaaaagttcagtttagggtttaaaaccctaatgctgactaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaaggaaaattcagtttagggtttaaaaccctaatgctgattgccttggaaaaactcagtttagagtttaaaactctaatgctggctaaaaggaaaaagttcagtttagggtttaaaaccctaatgctgactaaaggaaaattcagtttagggtttaaaaccctaatgctgattgcattggaaaaactcagtttagagtttaaaactctaatgctggctaaaaggaaaaagttcagtttagggtttaaaaccctaatgctgactaaaggaaaattcagtttagggtttaaaaccctaatgctgattgcattggaaaagctcagtttagagtttaaaactctaatgctggctaaaaggaaaaagttcagtttagggtttaaaaccctaatgctgactaaaggaaaattcagtttagggtttaaaaccctaatgctgattggctaggggcaaagttcgagaatactaagcgacctctctctcttttttttttatttcttgttttagtagaaaatacaagggagtttcgtggaaacttacctttcgagtgaattccttattgccaaaatatttcttgcacccacgtaccttcttctttgggcgacacctgctccttgcacggttgtcttggattacacctgtttcaacttttcagacaaaggacaattgttagttcggaaatgacggtcggtttggtgaccttgatcgttcccggttgctttgttgcgtcttcatttctgttgtgaagtcccgccattgatttgattcatatgccgaaaccctttagaccgctcaggcttgtatttccagattctgtgatgatttgcctcgtaaggctctttttttttttttttttttttttttttgcatattgaggagattctgtgggagattgtacaagactctgttgggatttgtacaggggggagactctgtggggatttgtccgaaggtggacttgctggggaagatttcaagatttctctctttttcctttactccggcacaccatcaaacgtcatgatccatcatgtttgggtaattatatcaacgagatgaggtgctttccttcatgagacgggattccgtgcagacaaaccatgccacctactctttccggtgcatcctgaactctgggttaaaatgcaaaaagggattcgaaaagaaacaaagcaggggaaaacaaatcaaaaaaggaatacccttttcgggacgagaaagacttatctgaggaagataacgctggctttaaatgacatgacatgccttttggactggacgtctgaccttctaagagcttgcgttttcctgaaccagaacggacctgtgattccaaactggtgggactctgccgagactttcttggggtggcgtcattcttttcggccaacagcgccctttgcgggttttcgctggctgacctttctcatttctcttcctgtcgtcgcttgatagcactctttgcgagtttttactaaacaagctctctcattttggtttctcttctcccgtcgcctcgtggtgcccgaaggttttcaccgccgagactctctcattttatttctctcaactcagggtgtgctggtttccttttgtgatgcttattggtttcccaccatctttggtaattgatttgaaggcttgtacctggtaaagagaggtagctgatactaaacttcttaagtgtctgacatgccccggttttcaatttcagggtgaatgggattttgttgttggtgtgactgaacctcagggagaggctgcctacgtatcctttcggaatcaagtcaaacgtagttcaggcctcaatcaattttttttttttttttttttttttagaatataacggctcaaaaggtggtagcgagaattgggcagtgtttggggagtagtggggaataaacacctttgcccttttcaatgtgtgaggaccacttggagtatgatctagacgtagtacctcttgactgcatctgcattcaccgctgtgtcagggtcatttccttcgatatcacctaaatacaatgctcctcttggcaatattttccttacgatgtatgggcccttccaatttggggcaaactttccttttgcttcttcatgatgcggcaggatacgcctcagtaccaattgtcctactacgaaattccgaggtcggactttcttgttgtaagcacgggccatccttcgttggtataactgtccgtgacaaactgcagccatccgcttttcatcgatcaacgtcaattgctccagtcgagtcttaacccactcgctgtcctcgatttctgcttcgacaatgattcgaagtgaaggaatctctacctctgccggtattacggcctcggttccataaaccagaagataaggagtcgctcccaccgatgtgcgtaccgtagtgcgataccccaacaacgcaaaaggtaactgctcatgccactgtcgggaactttgtattgttttcctcaaaatcttcttgatgtttttatttgcagcttctacagcaccattggcttttggccgataaggagtggaattcctgtgtgttatcttgaattgctcgcacacatctcccatcaagtgactgttcaagtttgctgcattatctgtaatgatagtcgcaggaataccgaaacgacagataagatttgagtgtacaaaatccactacagctttcttggtgaccgacttgagagtgacagcctctacccactttgtgaagtaatcgatggcaaccagtataaacctatgtccattcgaagcctttggttcaattggtccaatgacgtccatgccccaagcgacaaatggccaaggtgcggtcatgggatgcagttccgtgggaggtgcatgaatcaaattaccgtgcacttgacactgatgacacttccggacaaagctaaagcaatccttttccatggtcatccagtaataacctgctctaaggatcttcttcgctaagacatacccgttcatgtgaggtccacacacacctgcgtgtacttcatgcatgatctttctcgcttcctcgatatcgacacatcttaagagattgaggtccggagtcctcttatataacaattcactgctcaaaaagaaaccgctcgcatgtcgcctaatggtcctcttttgatctccagttgcatgctcggggtattcttgtgtcttcaagaatttcttgatgtcatggtaccaaggctgcgtatttgatcccgcctcgattacactgcagtaaccgtgtttttccttgatttggatttccaaaggatcgacgtgggcgtcgcccgggtagggtagcatagaagctaaagtagcaagtgcatctgccagttcattgtgacacctcgggatatacctgaattctattgaggtaaagcgcttgctgaggtcctccacatgttgtcggtatgggataagtttgacatcccgagtttcccattcgccttgaacttgccggatgatcaggtcagaatctcccataatcaataagtctttgacatcctgatcgattgccatatgtatgcccataatgcaggcttcatattcagctgtattatttgtgcagaagaaacgaagtttagctgtggcgggataatgctgaccggtaggtgagatcaaaattgccccaatccctatacccttggcattcacggctccgtcaaagaacatcttccaaacatgagcttcctctgagatcacttctacggtgtttacctcttcatctggaaaataggtatccaatggctggtattcctcatcgaccgggttttcggccaaatgatctgctaacgcctgggctttcattgccgtgcgagtgacataaactatgtcgaattccgtaagcaagatttgccatttagccagtctcccagtaggcattggtttctgaaatatatatttcaagggatccaacctgcttatgaggaatgtagtgtgggcttggagataatgcctcagcttttgagcaacccatgtgagagcgcaacatgtcttctccaacagagtgtatttggcctcgtagctggtgaatttcttgctcaggtagtagatcgcctgttcccttttcccggtcacatcgtgttgccccaggacgcagccaaaagagttctccaagactgtcagatacaagaaaagtggcctccctggttcgggagggaccaagactgggggattcgaaaggtactctttgactttatcaaaggcttcttgacactccgttgtccacttaatcgccgcatcttttcttaacaacttgaatatgggctcacacgtgcttgtcagctgggcaataaaccgactgatgtagttcagcctgcccaaaagactcatcacgtctttcttcgttcttgggggaggtagatctttgatagattttatcttagtcggatctagctcgatacctctcctgcttacgatgaaacccaaaagtttacctgacggaactccgaaagcgcatttggctggatttagcttcaagtcatacttccttagcctctcgaagaatttcctcaagtcttggatgtggttatcctgcgtcctggacttgactatgacatcgtccacgtacacctctatttcctgatgcatcatgtcatggaaaatggcggtcatggccctcatataagtagccccagcattctttaaaccaaacggcatgacccgataacagtaggtgccccaaggcgtggtgaaggcagttttctcggcatcctcttcatccatcaatacctgatgatacccagcgtaacaatctacgaaagactgtatctcgtgcttggcgcaattgtcaacgaggatgtggatgttgggcagcgggaaattatctttaggacttgctctgttcagatcttggtaatctacacatactcgagttttcccgtcctttttcggtactggaaccacattcgccaaccatgttgtatattggactacccggatcactcctgttttcagttgcttggtgatctcctctttaattttgtcactgacctcgattttgaactttcgttgcttttgtttaaccggaggacaatcaggatgaatcggcaatttgtgaaccactagatcgacacctagtcccggcatgtcatcatatgaccaagcaaacatgtctttaaattcaagaagaagttgaattatcgcctctcgcgttttcttgtccgtgtgaatgcttatcttggtctcccggatttcttccggggttcctaaatttaccggttcagtgtcattcagatttggcttaggtttattctcgaaatattccaactctcggtttatctccctaaaagcctcttccgcatcatattctggttctggatccattaattcgcagttaaatagctcattgtgatccgggcgtgaagtccgcaagcatgtcatatttaaagccgcattattaggactgaaaaggaagataagaggaaaagtaataaaatcagaacgaaagaaagaaaggaaagcaatgaagattttttttttttcattttctttggaaaattggaagacaacaacgtttacaactaggaattcagaacaaaaaatgaaaagaagaaaacgttcaagttatgtcccggagataacttgtgatacaagaaaggtggcaggacaggtctacccggacttccgtctagttgggaatggcgtgatctcccagttttggagcttggcgtttggccccatgtatatcatctcagcagtgctcgtaccttcgcctggttgaaccatatggacctcgtagagcatttccctcattgccccacatatttcctcgatttcctcaactgtgaagacctcatcttcttcttcttcagtgtaccctggcctgacaaaagtcgcatgtaaatccggcagtggttgaggcaacttccagccctcatttctccttttctttgcccatttttcgtctgctggagtaggtttgaaacctagtccaaaaggtttcttgatgactggtaaagtaatgggttccgtcattccctgaagggttcgtccaagccccttccctggcctaaatccgtgtcggatcatctctttggccaccataaccgaagcgttagacaagaaaggctgggggcaaggtactccctcttcgtgctgctctgccaataccacctcgaaagcttgatagaccgtatgctcactcccttctcttggttcaagatacgggatagatgggtcccgataaatggcatgttcatcttctccatggaccacgatctcttggtcttcatactcgaacttcaccatctggtgaagagtagaaggcacggctcctgccgcatggatccaaggcctgccaaggaggaaattgtaagatgtgtccatgtcgatcacttggaaagtgactcgagatttgactggtcctatgaccatcaacaggtctatttctcccatggtgtctctcttgataccatcgaaagctctcacgcagacgttgttgggtcgaattcttccggtctcaatttccattctttgcagcgtggagagcgggcagatgtcaacacctgatcccccatccagcatcacccgcttgacatagtagtcctcacatttgactgttaaatgcaatgccttgttgtgtgctgctccttccgggggtagatcgttcttgctgaaggagatttggttgacggcgaagaatctttctgtcatccgctctagttgctccaccgaggtttcgaccggtacgtatgcttcattcagggttttcagcaggatcttttgatgctcagttgacttcattaatagtgacagcatggacacttgctcagggtgcttgcgcagctggtctatcacttcataatccggcatcttcatctgcttgaagaacacttccgcttcttcaacactcacaggctcctttggagggaagcgcctttgtgtggcgttgttcagttcttgggtatttgagtaccctccaacgaaagtattttctggaagttcttccatgacctccttacctttgtatgttaccaaagtcttttgataattccacggtactgtggacgggttggtcattggcttttgtggcacgcgtccgataaccactggctcattcagccgaggtggttgaatcgtcccccggaccacataggccccttttggcacatacataggttttgtctttttgatcccgaagttctgcgtcttcttggcttgacctcgcggtatgtaaagaactccaccctttgccggtaccactttcttctccaccttcttttcgggcttgctttctgcagccttggcctcctcccccctttctgatttctggtctgtttcgggcctcttcgctgtgtcgacaatggcaattatggatttcaaagcagggtcgaactctttgtcttcacaaatcatgccgatcagcggcccattattgtgagcgggcaatggattgttagttacattcgggatctcttcgtcccttagcactattttcccctgctctatcaaattttcgaccactcttttcaatgaccagcagtcatttgtatcatgcccctcggcccctgaatgataggcgcatctgactccggctttgtaagaaggagatgtcgggttctgccttgtttgagggatgggttgcaggaaacccaactgaaccaactttgggaacaaagttgagtatggctcaccgatgggcgtgaaagtccgccgtcgaggtggctcttgggggcggtagttattttgcgggggttgtgggttatagtggttgcggtaaggaggctgatttctgggaggtggagctgggcctcggttggcttgttgtgatgaatggttataaggttgggcattcatgaccatataaggttgatgagcatatgccacatttgagtgggggtagtagtgttgtggggccctttccggaaaatggggcctgggatgacgatactcccttgcttcagaggctgccatagccgtttcttccttcttcttcccccttgtcgttcctcccgacccgctttggacggcctgggaggttgcccttatggctgcttgactcagaatccgacccgttttcagcccattctctaccatctctcctatcttgattgcttccgcgaatggcttacccatggccgacatcatgttttggaaatagtcagactcttgagcctggagaaaggtagtgaccatttccacttcatccatgggaggcttcactctcgacgcctgttcacgccacttaatagcatactctctaaaactttccgaaggcttcttcttcaaattcgacagagagtttcggtctggcgcaatgtcgatgttatactggaattgctttacaaaatctctggcgagatcatcccatatatgccatcgggacatttcctgatccatataccactccgaagctatccctactaagctttccccaaaatacgccattagcagttcttcctttccgccggctccccgcaattggttgcagtattttttaagatgtgcaatggggtcaccgtgcccatcgtatttctcgaatttgggggtcttgaaccccgtcggcaggtgcacgtgagggaacatgcacaggtcggcgtaagagacgctcttttgtccgctcaacccttgcatattcttcaaactttgttcaaggcttctcattctcttagcaatctcattttgttctgcaatcctggggttctgatcctgtcctggtgcgagttcgcactgaggcggtagaggattattgttggtagcgaacctggttggttccattgagaacgatggtgcttggaatgtaaaagaggatgagtcaaaggttggcttgtatgtggcaggctgtgccgtagctgggcaaggcgatgcagtaaagatgttcatgcttgcatcagtggccgacattcggggatgaggctcagaaggtgatcctgcggagagagcggagttggctgggtacccgaatggggtagcagggtaatttatggggacattagaagtcccacttgacctggagaataattcagggaatccggggacgacacttggcggctctttcccattgttccagtcatccagcatttccaacatgcggagccgcaggattctattttcttctgcagttgcggattcaggcgtgaggacggctgagattgagctctcctcagagacggggactgtttgcaatggaatttccgaagacatttccacacttccttttgacctggtgaagtaggtgtgagtactgtttctggtcctaaaaataggtagttgaacacctctccttgacctcgtgaagtatgagtgcgaggccagactttcaccaaaccaaccgtcttttcaaaaaccctggaaacatgctcaatgacaagcgcacggttaatttgcatgcaaataacagatagttagtctcacgttgggcatgatgcacctatacagttaagtggattactatatgtctgctacgagagcatgcgtcattccggtattttcccccttttttctttttttttttttttttaattttattttcatttatttttcttttatatattttttttttttttgtagcgaaataaaatgcgatcggatccgattaggattgcctacgtatcacgatactcacgtgaatcagatcattacgtagttcgaaaacacaaatgagcatgaaagaagccaattctttattattgaagcagtctattacaaactacattttgcaaaaggaaaagcaaactttgaaaataaacctagactcaaaaaataaactaaaaatcaccctgatgaaaaaaaaaaaacaggcagaagatgctaagatacagatttgacctatgaatgcattatggttttaaaaattggtttccgcggggcgtcgttcggcctcgccgcggtcctaggcgtgagatccctctcaagttgctctagctcgtgcatagtctgcttgacataaaccattactgccgagaggaaggtaacactagacatgttctcacatcgtagacatcgtctggtgatggcgtgggcaacggctttgatcctatctctggtttgcttcttctctacaagcaggtgctttatctgatcgctgcatatcttgaagacttgaacatcttgcatgtgttgatgcttcaatcgtcgtacttccaatttcatatgggctattgtgtcataccagtatctgctttccatttggaaatccttggcctgactagctgctttgatttcaagtgctgccatctctctctttattttagcaatagtcttctcgtggtcgccttccaattgattcaggtgtctgcgatgcttatctgctcttgtatcccactgtgccttgagctctgctatgatgttttcagatttctccaaaccatctcgccattccctgatttcaccttttagcccttttatcagctgctcgtccgatcgacgccttggttgtctatctgcatcccaccttatctgtttgatctgggctctgagcatttcattttcttgaatcaatctgttccgttctcccagatcggtagcaacttgcacgttgtgttcatatttcaatttttccacttgttgctttaacccgctgatttcggtgcaatagcctctttcttttgctaaccaatcccactgcttttgtgatgattcggtaaaattccggatgtggggtctcttagctggcctttcgtgctcgagttcccttctgtaccatgcaaggtaacctggcgccgtttctcctttggcttgatcccgcacgcaagtatctgatttcaaatattgaccctcattccagatttggcgaatctttgcttctgggaactgtccgttaggacttatctcgattgcttgagtgcttagatcttcctcacgaggtactgtctggcattttccgaactgtcttaaaactcggccgggtgcgtaaggttgaatgctcttaagccccattagcaagaaatgagttttagtcgctgacatatataagacctcatcaacgggcaaccatcccaacttccattgtatttggctggcagtaagagcttgaaagaacgaggtccaagccaggactccttcgggcaaactgatctctttggctcttgcgtaagattcttctatgcgggtcttatccggggaaccacggctcaaaatctcggaatgatggcaaaggtgctcggtcatccatatctgcaggagcaagttacaaccttcgaagaaatttcccccagctttacaagctgtgagagctcgaaagatgtcggataccaccataggcgcgagagtactgtcactttgcgtgagtaaagtgctgacgacccccgatatcttcaaatcaatgtttccatctttcctgggaaataccagaagtcccagaaacgttatcatgaacgccacccgtctgtgctcgtcccacttctgacgaactcctttgctgcacagtttgttgattggattattgaatcccccctcgtgaccgtatctatcatatatgaagcatggagtacagaacccggctgctagatccgggttgtggactgttctaggtattttcaatgaatccaggaaccgatgtactgtgacgactcttggggcgaccaagtatttttccctcagcggaagttcagtattcccgatgtatccggccatttcttctaaagttggggtgagctcaaaatcagagaaatggaaaacattgtgcgccgggtcccaataggtaaccaaagctcttatgatatctccccgaggctggatttccaacagacccacaagacctttcagatttttcttaacctcattttgcccttcaacacctagatcattccaccatagccgtaacttgatagggattttggtcattattgaaaaatgttcattttgcatcgtgctcatcctgcacatttattaaggtgattttaacaaaaatgactgactcaaaatattttacagaggggaccaagctttgaacacggcctttaagcacttcggggaagaagattttaaggttgtgtgggtctaaaaatgctaatgaaaacccaaaagtggctatttatgcaaagtcaaccttccggcgtccctttcgagaacattcggctattcatgtcaaaacagcatcacctgacttatttatgactctttaaaaaatttgaaacatatttttttttgattttggctattttagcaaaatgggggttgaacccgacgagggttgcctacgtatctcacatccggtgagaatcaaaccggcgtagttcggggataccgcgaatagagaaaattaaataaacctaaaaatcagaaataagtatttttttttattattcttgaagaaagataaagactaaagaaaaaataatttttttttggcaatatttggactaatcagtctgaatttataaaaagggtattacaagagaaaattttttgaattatgagttttccatttttttttacttttaaaaataaataccatttcttttttttctattttgaaagcgaaagaattttttttttttattattatatataccccccttttttaataatttaaactaagaagacaaattttgtttttattctttctttttcttttttttttagaacaattccggtgaggttttgacaatacttgaacattggttttatttttccaaaataagtaattatccttccacgttgctattttcctcttttttttttagaaaccggtcagcatgcggaaccgaagcaaataaatgcacaaaacaaataggatgcagcagggtggtcttttcaattcaggttgcctgtcctagacggacccaacccctgtgttgagccccctaagtcaagtgcatcatgatgcaaataaacgttcctactagggatccggcatgaagtttcgttatactaggtttaaaccttggtatttgttctagactgtgtacccgagcggaccaactcgagtcgaggaggggctacgtaccggggacccgcgagatcgtccggctttgtaacttgtccgtcctctttcttattttaggtattgacattaacagaatagggagtctcgaccagcgagcttctccccggaggtaagaagagaagggtttcgacacagtttatatacagttcagataatatcaaagcggtaaagacagcattatgcaaaaacatgtaataaagatcagataataaagccaaatataacaattattctaagctcgaattcttgaaccctgaaccagtggttctgggtccactttgtccccagcggagtcgccagagctgtcacacctcctttttgcgcgccctgccccgaggggttaggtgcgcgggtggagttttttccaatttaagtgacaatattcgaaatgggattattcatttaattcagagtcgccacttgggaaaggtttggcttttggtgtcccaagtcaccggtttatcttgaatcccaaatcgaggaaatttttgacttttccaaatgaagtctacgaaccagaaattctaagtaaggaattctgttgacccgagggaaggtgttaggcaccctcgaatcccgtggttctagcacggtcgcttaaattgttataatggctaaatatctgatttaaatacatatcatgacttaacgcctttattaagtttaaaccacttttgttattatcatttattttatagaattgcaacgtcgtgaaaatgcatctcgaaccacgtcacaatcaatgcacccgcagttgttaacacatttcgactccattgagatttgaatttgggtcgcataaatgcgcacccgaatttaagaatgtaatctaattaagccgcgcctaaagggtctaacgcgttatgatttctgagaaggccatgagattcactaaatggcctagcccgaattctaaatattatgattagttgaaggccccgcaattcgcatttttttttctttttacttggcgaggctcgtctcattaaaataaaacctacaatgactacatttcttattgttttcatttccagaaatggaagaaggaaagatgcatgttaattgaaataaaaaaaacggattactatcaattcctaatcacttataaaaatgaaaggacgccataccttacgaaatattttggttgaacaaggaagctatatggaggtggatgaaatgcaatacttaattcggacatttcctcgaatcgagcttaactagacttatttaagctaggttaaggaaatcgaatgctaggcattgttactaatggtgattcgaacatgtacctatatgttgcctaacggtcttgataaatggaaggaagataacacagaacattattgtgtaggtggaaatattctatcttatgcatgtcattatctgatgggaaaccagtcgaaaattctgtgccaattatccacaccttctatatattatactattacatcttgtacttagcaaacaactagaaactaagatgcaaaaaagcaaacttgattgagtattgtctaactaatctttcactactggattacactaatcaatttatacgacagagatcagtgtatcacaaacagcacaaaacagacatctgaatcttcttcaagaactcctttcatttcatgcttttgaactgttacagttaacaccaaagtgggatttgaaatgtgtacctggaacaacactgaatactgaaatgcaaagaagaagtgaagcagaaaatcagcaacagcaggaaaccaaatagcagcagcaacagcaggtaaccagatagaaagcagaatcccagtacaagatgcagctggagccaatgaaagatgacagggtgtggcaagttcccagtaatatgaatcaaaatttaggcaaaaatagatctggggatgcactgatgctacacacaactaaaaatctcaaacagaacttaggagaaaagatatggaacagggaaatccggccagatgagagttaagacaaagggggaaagatgcagttcctctttcctgtgttatcctccctatatctattcctgtctgtgtgtatttatctgtatgtatttccactctctcttccaaaactcctcccagtgtctgtattttttaacagccctcaaggtccagtctgtatatgcctatctcctccagatggtatctccctttcaaaactcctcacagtatctgtatttttctttctcttcctctaattctgtctatttctatctcctaattctgtccctctctatatccctgtgtgtgtgtcctcccagaacttctattccccccttttataagcctcaaaactcaaacctttatcagcctgtttggattaatcaaataccccctcccatgtgctccctttttcagttccactttagctatttaagtattaatcccatgacattcccttggcaggctttaacttttcattttattatctaaaagcaagtatgggcattaaaatatatctgacagcatatactgtcagattgtttaaacttaaaagcttcttaatgcagaaaaacaggctgtgcacaaggcacatgaggtgcaccaatgcacatgctgtgcaccagtgcacatgccttccaattcaggatttaaacataaacaatcccttttttacattgactgatccaaatcaaacagctataagtaaacaaaactggttctgaattgatttcaacaaatgttcaacagaagcaaatcgatttactatgctcagacagttgaaattaattgacgacacatgtcgactcgactatattagtatgaacatacacaatcgtagccaaaaatcagacatttaaacaatattgatacatggttcgtattatactgactaagcaggaatacactcgaggagtcaaactagtcagtccaaactcgaaaatcagctacttgcacaaacaaatacataatgccttatcagaataggaggggggaatttagacaaacaaacagaggttcaggcgaagtagttgaagcacagttgatagaggtcaaagacataaacagaaaacgaacagacccttacaacaaacaaacaaaccaaaaacaactaagaaaagaaagaaaactcaccttaaaccgcaaaaagatcaaaaccttaactcagacttggtcaagcctttcttaaggctgaacggactttaaacgaagtgtttctcagacgagaaacacttggattaaagtccattagaccttaacctctttggttcgaacggatatggaccagtgacgaagaacccacaaattccaaaactcagatctgggattcatgcttccctgatcagattcggaccaaaccaagtatggtttggtcacgaggggggtctggggagtatctggtacaaaactgggattggttgggtcagatcgagttttgactcgaatcttcgaatgaagattcgaggacctggggggtgattcgaaacatggggttggtagatttgggttcaggatggcctgggggtcctatggtgttcaagggaaggtcaccggcgtccatgccgccggctttcatggcggaagtatgcagaggcggctagggtttagggctgttcgtttggggagacgaagcagctggggtattggatagggggggtagggtagtgttatgtacttatatagttagtgggcaagtggatcctggccgttggatgagacgagatgaagggccaggatccttcggctaacagggaacgacgtcgttccaagggtgaagggttagggtcggtccgggtgagacgggtcgggtttattggtgggttatggggattgatcttggaccgttggatcggcttggtttaaacggttgtgatgggttggcattgaaacgacgtagctttggtgttaaactacgtcgtttcatggcctgggggtgggctgtttggactggtggcttgggctgtccgcttgggctgagttcgttgggccaattttaacaaattggcccaagtccggaagggccttttctttctctttttttttttttttattttttttttatttttatttcttttcttatttattttaaaacaaaactaagccaaagaatcaaattaaaattaaatacacattcaaatacaattatttgcacacatactaaaacatttcaaaatcggtaaagtcaaaccaaacaaaatcacggacgaaaaatgcctattcacgatcttctatttaacgaccgaattacggtttgaattacgcaggacacatatatattttttgaattttattttaataaagtaaataaataagaatgggccaaaagcacaaataaatccacaaggtgccgcacaaaaatccgaaattgtaccgcggggccaattatatattttttatttctttttggagcgattgtcgtgtgaagcaaaaatcacgtgctcacaacggcaacactcttcgcgcttttactctctttcctcaccatataatcaatataatcggcacggaatggtacatcgtgcggcacgacatcacccttcgtgctttacactctttcctcacaaattatacacgacatcacccttcctgccttatactctttcctcacaaaaacaatgcacgacatcacccttcgtgctttaactctcttcctcacccaaacaacaatcataaacaatcgggcaagggaataaatgaaatcataataagaatcccggcaagggaacaacatttcaacaatttagtcccggtaagggaacaacatcaataatatcaacatcccggcaagggagataacaaataaagcaacaataacccgacaagggtggcgacataatgatatcttctctttctcacttttatttcacaattcacttcacaactcgagccaatactctagaggttcaattatcatttatactttcacaattcacttcacaactcgggccaatgttcataggccacaattacttccacaaactttacacaacaaatagaaatcttcaccaaggtatgaaaatacaacgaactcatgaaaatcacaatataagactcacgagcatgctagacaccagcgtatagatactcgtcaccatgcctatacgtcgtactccacaattaccacatagcaaataggactcgactcctaatccctcaagctaaggttagaccaaaaacttacctcgatgccacgaacacaattcacgtttcaattatagctttaccccttgattccaccaccaatacgctcgtatctagtcacaagttacttaattacatcaataaacgctaaatgaatcaattcgaatgcatgaaaatgaatttcccaaagttttacccaaaaagtcaaaattcgcccctaggtccacatggtcaaaacctgaggttcgaaccaaaacccgattacccattcccctacgaacacaaatatataatttattttgaaatcggacttcaaatcgaggtccaatccccaatttttgaaaaaaactctaggttctacctaattttctccatgaaaatcattgattttgagttgaaatcatattaaaagatgttaatgattgaaggaaatgagttaaaattaacttacaatcgatttggaagaagagttgttcttgaaaaatcgccctagggaatttgtgttttgaaaagatgtgagaatgggtttaaaattcgtctaagcataaaagttgcaggttgcagatatgggaaatgtgaacagggattcgcatttgcgaacatgggttcgcatttgcaaacaagggttcgtatttgcgaaccccgacctctactgggttgggaaatgcgaagggaggctcgcatttgcgagctgggaattgcaaaccaggcatcgcatttgcgatcactggccaaattgggaaacttcgcatttgcgaagatcgtctcgcatttgcgagagggagctggtctgggcttctttcgcaattgcgacaagccgctcgcatttgcgatatctcatttgcgagccaggcttcgaaacctttgtatatgcatcccgtggcctatccaaaactcacccgaactctcggagctccaaaccaaatatacacacaacctcaaaaatatcctacggacttatttgtataatcaaatcaccaaaataacatcataaacatcaaattaaacctcaaaatcaatgaaatttctcaaaacttctttaaatatcaaatttgcatttaaggtccgaatcacatcaaatggattccgtttcttaccaaactttaccgacaatacatataaatcatagtgaacctgtaccgggtgccggaaccaaaatacgggcccgatactatcaaattccacataacatttcactttcaaaaacctttatattttttcagaaaacaatttctttcaaaaaattcattcctcgggcttgggacctcggaattcgattccgggcgtacgcccaagtcccatattttcctacggaccctccgggaccgtcaaatcatgggtccgggttcgtttacccaaaacgttgaccgaagtcaaactaatttattttatagtcaaaatttatcatttttcatagatttccccttatagcttttcggctacgcgcctggactgcgcacgcaaatcgagatgatgctaaaatagggttttaaagcctcagaatgccgaatttcattttaaaataagtaatgaccttttcacagttttgcgaaagtttaaactatatactaagtgcaacatcaaccgaaaaatctttccctttttgttgattttgtgtgcacaaggaattaataaaatcccaattattttcttatttgttccaactctttcaagaagatgatatcactattatgatgtacatgtggtctttctttttcttcatgtaacttgaccatgttctgcgaaaatcaaacagcctttagtagtctttattatctactgcacaacgtggtgtgatacgtttatttccggaagctatcattgtcaagttgtatatgtatcagttgaacatatgaacctttctaaccaaagccatcttgctaatctagaggtctgcagagctttagttttgtccatgtgaattattgctggtgtgttattctctattttgttatttctcacttagtcagttcgtgaaataaatgcacatttcatccaaattactgtcgtctctaacataataacccttcagtttatctttatccatagtgcttgaaaattaattgcttgaatttttgttctttaatttcattgtttggccaaacttattgaaaatatattgacttctatgttgggcccgggcgttgcaccggaaatgcctatctagtacatatgataagacattccgtgagcttagatgtatagaagaaggatttgctaaattgtaaactatatgttaagctcaacatcaatcgaaaaatcttccttcctttttgttgattgtacgtgcataaggaattaataaaatcccaattattttctttttcattccaattctatcaagaagatgatatttgcaactgtgtacatttgatctttctttttcttcttctaacttgaccatgttctgaagatatttgctgaaaattctcttttagtaatcaaaacgttacaattcaaatcgcatgtgttctcaaatcaagaagaccattatcgcctattta

SEQ ID NO: 86 - DNA, 4250 bp, Artificial Sequence
  Description of Artificial Sequence: Synthetic polynucleotide
atggctgatgtagcagtgaattttctggtagagaatttgatgcagttgttgagggacaatacagagctaatatttggagtgaaaggtgaggcagagaatctgcttcaagatttgagtgagttcaatgcgtttctgaagcaagcagacaagtcccgcagcgataacgaagttctaaaagaattggtgaagagtatcagaaaagtgacgaatgattctgaagacgctattgataagtttgtaattgaggcaaagcttcacaaggacaaaggggtaggcaggtttgtggacattgcgcattataaaagagtgaaagatgtagcccttgagattaaaggtatcagagatagggtgaaagaaatccgtctgaacaatgcacatggccttcaagctcttcaagatgatgatccatccaacagaggcgtggaagacagaaaggtacctatattatatatgccttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaatcgaatctcgctcattttcaggtaagatttacttagctcgctccttgctcgcgaagcggcataccaataaaaagaaaagcgttatcggatttccatcgtcgttgtccgtcgataggaaggagatactgagaatgagagacacaaagataagacttaagagaagcgaactaacaagtgaggcttgctcagttgataaaagcacctctacccacgaccgttaggtcctgggttcgagtcatgctggaggagaagggtggaaacactatagatcctcctaaattgggagggatattaaaaaaaaaaaaaaaaaaaagagaagcgaatagagcaatttgaagagaagttagagagagacttcgatataaactaagaaaaaataagtctaaagagagtggatgggttcggattctcggatatccgatccaaatgcacagccctaaacccagcattgcatttatatatatatatatatatatatatatatatatatatatatttaacaggtttagactccttaataagaatgaaggtgagtaagattagatgacaatatgctgcttaaatataaccaattcagatgtctccattgagcctccagcagaatataatggtacaatcaacggaactgtattgcacttaaatatactttgcacaggaagatactcctgcgcaaagttcatagaatgattatcaattttatatgagaagccgacataatcaacaaaatgagtatcgtaaaaatgtgaaagtaagaaggatgtgtggcatttcttggacaatatctatattgttgtaatgttagtgttctatatatgtcttgggaaaatccacctttgcttctatttactactgagtatcaatttttccaatacaaaacaaagctaatcacctatcttttaattaagctgcacaaatgcgtacgtaatacaatatgttttggttgaatataatgtttcttttcttgccaatgaacgttaacttcatatatatgtctaatcttcatctttgatattaatttaaaagcctcccgtggttgaggaagatgatgtggtgggctttgatgaggaggcacagaaggtaatcgaccgtcttcttgacagatcagatgaattagaggttattccagttgtaggaatgcctggtcttggcaaaaccacactagcaactaagattttcaagcatcggaaggttgaatacgagttctttactcgagtttgggtttatgtctcgcaatcatacaagacaagagaattatatctcaacatcattagcaaattcaccggaaaaacaaaacaataccaatatatgtgtgggaacgtatcaagattgctttcccgaacaacaaaaagtgcaatagagtattgttgaccactcgagatcacaaggtggctcatcattgcaacaatactccacatgatttaaaatttcttagcgatgaggaaagttggatgttgctagagaagaaagtttttcacaaggctaaatgtcctccggaattggaaagacctggacagagcatagccaggaagtgtaagggacttccccttgcaattgtggtgattgcaggagctctaatagggaaacgcaagacaacaagggagtgggagcaagtggatcagagtgttggtgaacacctcattaatagaaaccagccaaagaattgtaataaaattggtgcaaatgagttatgatcgtttgccttacgacttgaaagcatgctttttgtattgtggtgcatttcccagaggctttgagatccctgcttggaatttgatccgtttatggatcgccgaaggcttcatccaatacaaagggcccttatcccttgaacgtaaagcagaggattacttgaatgatctcgtcaacagaaacttagtgatgataattcaaaggacgtctgatggacaaatcaaaacatgtcgtgttcatgacatgttgcatgagttttgctggcaagaggccacaacagaagaaaatcttttccaagaggtaaaattaggtgttgggcaatttgctcgtgagatacagcaactatccacctaccgccgcttgtgcattcattcctcagttctggaattcatttctatgaagccctctggtgagcatgttaggtcattcctatgtttttcttcagaaaaaattgacatgcccccggttgacatcccaaacataccaaaagactttccattgctaagggtgttggatgctgaatccatcaaattcagttgcttttgcagggagtttttccaattgtattttctgaggtatattgctttctcatctgactttatcaagatccttcctaaacatattggggaactatggaacgtacaaaccctcattgttaacacacaacagagcaatcttgatattcaagcagacatatggaacatgccacggctgaggcatctgcacactaacacgtccgctaaattgcctacgcctgttgccccaaaaagtagcaaggttacctcggtaaatcaatgcctacaaactctctccacaattgcaccagaaagctgcacagaagaagttttttcaagggctccaaacttgaaaaaactgggcattcgtggtaaaatctttatgcttctggaaccaaataagtccgaattgttcaacaatgttaagaagctacaatgtcttgagaacttgaagctgataaatgttggtcaaagtgggaaacaattacgccttcctccaacatatatatttccgacaaatttgaggaagctaacattattagatacctggttggagtgggatgatatgtctgtattgggccagttagagtaccttgaagtcttgaagctgaaagacaatgcatttaagggagaatactgggaaccaaaagttggaggttttcgttccctactagtgttatggatcgaaaggtcagatttagcttcttggaatgcttcaagtgatcactttccaagacttaagcgtcttgttctcgtatcatgtgataaacttgaggaggtccccattggcttggctgatatacgcggcctccaagttatggagttgcgaaattcaaccaagcaaacagcaaaatctgcccgggatatacaggccaaaaaagacaagcaaactcaagaaggggctaaaacccaaaggttcaagctttctatattccctccttatctctga

SEQ ID NO: 87 - DNA, 2639 bp, Artificial Sequence; identical to SEQ ID NO: 13
  Description of Artificial Sequence: Synthetic polynucleotide

SEQ ID NO: 88 - DNA, 522 bp, Artificial Sequence
  Description of Artificial Sequence: Synthetic polynucleotide
atgatcggtaggtgaacttaactatctcaccaatactcggccagatatttgttttcttttctttgccttagtcaatttatgcaaaggccttctctttcacatttttctactggtctcagagtgttctgatatctttgatcagacccaggccaaggtatccttctctcttctgctccctcttttgatcttgtcgctttttgtgatgctgactgggctgcttgtaaagattctcgtcactccgtcagtggtttttttattactcttggaggtgcccctatttcttggaaatcgaagaagcaaatctccatctccttgtcatccgctgaatttgagtatcgatccatgagatgggtgactgctaagatcacttggcttgttcgactccttgctgatttatctactcctccaactttgccggttcctttacactctgacagtctggcggcgattcatatcgcccgcaatcccatcttccacgaacgaactaaacatgtagagttggattgccatttcgttcgatag

SEQ ID NO: 89 - DNA, 462 bp, Artificial Sequence
  Description of Artificial Sequence: Synthetic polynucleotide
atgggactaaatgatgtctattcccaggcaagaggaaacatccttatgatgaatccattgtctagaatagatttttcttattcacttcttctacaagataaaaatcaaagggagatatatgcaagatcacagttcaatgctgatgcttcctcattcatggtaggagttcaaggtaaggctccacagaaaaacaacaatcagtcacaacaaaagtcatggactaattcacaaaaggttaataacacacagcagaaacctaagggaaggaaagcaaaatttaatcctaatatgaactatacatattgcatgagaattgggcatgtcagggtagattgttataggctaaatgggtttccagatgatttccaattcaccatatcaacacaggtcaaggctaatgctatagttaaaggacaagacaatgacaatggaagcactcaaagcaatgatggaacaccttaa

SEQ ID NO: 90 - DNA, 1593 bp, Artificial Sequence
  Description of Artificial Sequence: Synthetic polynucleotide
atggaaatcgacttgaacattcaagagttgctagtgatcgatgattcagatttgcttatgcaccaggtacaaggagagtgggccaccaagaattccaagatattgccatatctgcaccatgtgcaggaattaagaaagaggttcatgaagatagaatttcgacatgtgcccagaattcagaatgagtttgtcgatgcagtagccaccttgtcatctatgatacaacatccatataaaaattatattgatcccatcccagtgaagatccataatcagtcggcatattgcgctcatgttgaagaagaaatagatggaaagccttggttccatgacatcaagaagtatttgtcaaagggagaatatcttgagcacgcaaaccacactcagaaatgcacactccagagattttacaatcacttcttccacggcggaggaaatttgtacaggagaactcctgatttgggtttcctaagatgtgtcgatgcaaaggaagcttctaagctacttgaggatgtacatgccgggacttgtggcctgcacatgaatggtttcgtcttggctaagaagatacttagggtcggttacttttggatgaccatggaaacggattgcatccagtatgtccgcaaatgctttcaataccaggtgcatgccgatatgataaaagtgccgccaaacgagctcaatgtaacaagctctcattagccattcgccgcttggggaatggatgttattggtccgatttagcccactgcttcacacgaacacaggtttattctagtagccattgattacttcacaaaatgggtagaggttgcatcttacaaagctgtaaccaaaagagtcatcgtagattttgtcaaggatcgaattgtttgtcgattaggagttcccgagtccattcttactaataatgccgccaacctcaatagtgatctgataaaagccatgggtgaaactttcaaaatcaagcacaagaattccacaacctacaaacctcagatgaatagagccgtagaagcggccaacaaaaacatcaagaagatactaaggaagatggtagagaatcacaaatagtggcacgaaaagctaccatttgctttattgggatatcgcactatggttcgcacattaaccagggcaacttcctacatgctagtttacggtaccgaagttgtcatcccagccgaagtagagattgcttctttgagagtcatataggaagctgaactcagcgatgcagaatagataagaagtcgctatgaacaattggccttcatcgatggaaagaggatgaatgcagtgtgccaaggccaaatttatcagaacataatgtccagagctttcaactaaagggtcaaactaaggcaatttacaccaggtcagttggtgctgcagaagatcttcccacattaagatgaatcaaaagggaaattctccctcaactggcaaggttcgtatatggttcacagggtgctgacaggaggagcacccatacttgcaaaaattgatggagcaatttggccaaaaccaattaattcagacgcaatcaagagatacgatgcttggattatttacatttttctcatctaa

SEQ ID NO: 91 - DNA, 2919 bp, Artificial Sequence; identical to SEQ ID NO: 76
  Description of Artificial Sequence: Synthetic polynucleotide

SEQ ID NO: 92 - DNA, 3518 bp, Artificial Sequence
  Description of Artificial Sequence: Synthetic polynucleotide
atggcgaggacacgcgcttccttatcgaccgagcagcagcccgagcccccagcagcagctcctattaggggcagagggcgaggccatgctagaggccgaggtaggggcagagctcagccccgagcagcagttccagaggtggagcctcatgttgattatgatgaggaggttccagctccagtaactttggtgggcctaactcaggtcccagagggttttattgccaccctagttcttcaggacgccctggttcaattggtgggccttatggagagagtcacccgaatatgttttcttcctgtagcaccagccacttctctggctggaggaggggctcagactccttctacacgcactccggagtaggtagctccccagattcagattccagcggtttagctagttagggtagttcagccgggtgccatagctcagaccggcgatggagcggctatgttcgtcgatgctttgtggagactggataggttcaccaagctcttcacttctacttttgccggtgcatttactgaggatccccaggattatctagaaagcttccacgaggttctgagaaacatgggtattattgagaccaatggggttgattttgctacatttcgcttgtctggatccgccaagacttggtggagggattattgcttagcgagaccagccggatctccatctttgacttgggagcagtttacagtgttgtttctagagaagtttctccccgttacttagagagaggcctatcggaggcactttgagcgcctccagtagggttctatgactgttacccagtatgagaccaggttcaacgatttagctcgccatgctctcatcatacttcccaccgagagagagagggtgagaaggtttattgatggtcttattctgccaattcgtcttcagatggccaaggagggcgggagcgagatcacatttcaggaggcggtcaatgtggcccgcatagttgagatggttatgtcatatggaggtggtcataggtcggataagaggccccgtcattcaggaagattctgtggtattgcgtctggaggtagagattcgtatggtagaggccatcctcctaggctcgttcagtcagctcaccaggtatcacatggtatctcaggtggtcgtggttctcagatgcattatttggatcagtagtctttcagtgcaccaccatctcccatcagtgcaccgccacttcagaatttctgaggtggtcattcagggcaatagggtcagcagtctcagcagccgagggcttgttacacttgtggtgatatgggtcacatttctaagttttacccttgagcttcgggtagttctcaacaacagggtcctcgccttatgattcaggcaccagttgctccatagcctgcccagccagctagaggcgggggtagaggacatagaggtggaggtagaggtcatagaggtggagctcagaccgccagaggtaggggtcagccaacagccgatcgtcccagggttgtgatttagggaggtagggcccaaccccgatgttatgctttgctagccaggccagaggctaagtcatccgatgctgttattacaggtactattttggtctgtgatagagatgcttcagtgctatttgaccctggatctacgtattcacatgtgtcgtcctattttgcaccctacttggttatacgtagtgaggccttgagtattcctgtgtatgtatctacactagtaggtgattctatagtggttgattgggttcatcgttcctgtgttgtggtgtttaggggacttgagacccgtgttgatttgttgctcttagatatggtggattttgacattatattagggatggattggttgtccccgtatcatgcgatcttggattgtcatgccaagattgtgactttagccttatcggattttccccatttagagtggagagggactcctggtcattctacccgtagtgttatttcgtatgtgaaggctcggtgtatggtcgagaaggggtgtttggcctactcagcttatgttcgtgattccagtgctgagattccctctattgattctgtgaccttggttcgtgaatttcctgtggttttcccatcagacttgccaaggatgccacccgatagggatattgatttttgcatcgatttggctccgggcactcagcccatttctattccaccatatcacatgtccctgctagagttgaaagagttgaaagagcagttgcaagacttgcttgagaagggtttcattagacccagcatatcgccttggggtgcgccgactttgtttgtaaagaaaaaggatggctcgatgagaatgtgcattgattaccggcaattgaacaaggttacaattaagaataagtatccactaccgaggattgataatttgttcgatcagcttcagggtgccaaggtattttcaaagattgacttgagatgtggctaccatcagttgaggactagggcatccgatgtccctaagacagcattccgcactcggtacgggcattataagttcttggttatgtcatttgggttgaccaatgcccctgcagcctttatggatttgatgaaccgagtgttcaggacttatttggactcgttcgtgatagtcttcattgatgatattttgatatattcccgcagtcgggaggagcacgagcaacatcttagattggttcttcagaccttgaggtatagtcagttatatgctaagttctcgaagtgtgagttctggttgagctcggttgcatttctgggtcacgttgtatcagcagagggtattcaggtgggcccgaagaagatagaggtagtcaagaattagcctcgaccagctttaactacagagattcagagtttcttggggttagaaggttactaccgtcggtttgtggaggggttttcatccattgcagccccgatgaccaggttgacccagaagggagcccagttcagatggccggacgagtgtgaggcgaactttcagaagctcaagaccgctctgactacgacaccggtattggttttgcccgcaggctcagggccttatacagtctattatgatgcatctcgtattggacttgatgcagtgttgatgtaggatggcaaggtcattgcctatgcttcgaggcagttgaaggttcatgagaagaactatcctgtgcatgatttggagttggcagccattgttcacgcattgaagatttggaggcactatctgtatggcgtggcgtgtgaggtgttcacggatcataagagtctttagtatttgttcaagcaaaaggagttgaatttgaggcagaggaggtggttgaagttgttgaaagattatgacatcactatcctatatcacccgggaaagtccaatgtggtggccgataccttgagtaggaagtcagccagtatggtcagtcttgcttatattccggtcggcgagagacctcttgctttggacgttcaggatttggccaatcagttaatgaggttggatatttctga

SEQ ID NO: 93 - DNA, 2586 bp, Artificial Sequence; identical to SEQ ID NO: 17
  Description of Artificial Sequence: Synthetic polynucleotide

SEQ ID NO: 94 - DNA, 2397 bp, Artificial Sequence
  Description of Artificial Sequence: Synthetic polynucleotide
atgcaatattctgatcagcagtcctacagtgcaccaccagctcctatcagtgcactgctgctccagagttttcggggtggttattcaggtcgccagggtcagtctcagtttcctcagccacaacacttaggtggatgttttgagtgtggtgagtatggttatattaggaggacttgtccgaggttagtgggtactcagtcgcagcagcagggtttccgcgctatggttggggcaccaggttttccacagaccacccagccagctagaggttctagatgtggaggtagaggatttagaggtggagctcagaccgctagaggtggaggccagccagctacaggccgtcccagaaatgtagtccagggtggtggggcccatccctgatgttatgctcttccagccaagcccgaggctgaggctttagatgtagttattacaggtacggttcttgtttgtgatagagatgctttagtgttatttgatccagggtctacgtactcgtatgtgtcatcttattttgcaccgtatctggacatgcctagtgattcattgagtgttcctgtatatgtgtctacaccggtgggtgattctattatggtagatcgagtccatcgctcttttatagttgtgattgagggtcttgagactcgtgtagatctgttgcttctggacatggtcgatttctatgttatattggggatggactggttatcaccttaccacgctatcttagactatcatgccaagactgtgaccttagccttatcgggtttacctcgtttagagtggagaggtactcctagtcattctacccgtaggtttatctcttatgtgaaggcttggcgtatggtcgagaaggggtatttgtcctatttggcatatgttcgtgattctagtgccgaggttccctctattgattctgtacccgttgttcatgagtttcctgaggttttcacttcagacctgccaggtatgacacccgatagggatattgacatttgcattgatttggatctgggcactcagcccgtttctattccgccgtatcgtatggctccgtctgagttgaaagagttgaaggataagttgcaacacctacttgagaagggtttcattagacccttgtttcaccttggggtgcgccggtgttgtttgttaagaagaaggacggattaatgagaatgtatattgattaccggcagttgaacaaggttacaatcaagaataagtatccattgccgaggatcgatgatttgttttatcagcttcagggtgccaaggtgttctcaaagattgatttgagatctggctatcatcagttcaggattagggcatccgatgtccctaagacagctttccacactcggtatgggcattatgagttcttggtcatgtcatttgggttgatcaatgccccaacagcttttatggatttgatgaaccgcgtgtttaggccttatttggactcgtttgtgatagtcttcattgatgatattttgatatattcttgtagctgggaggaccacgagtagcatcttagagtggttcatcagaccttgagggataaccggttatatgctaagttctcgaagtgtgagttctggttgagtttagttgcatttctggcctagaccagcatcagctacacagattcagagtttcttgggattggtaggctaatatcgtcggttcgtggaggggttttcatctatcgcagccccaatgactagattaacctagaagggtgcccaattcagatggttggacgagtgtgaggcgagctttcagaagcccaagacagctctgaatacgacaccagtgttaattttgcccacagattcagggccttatacagtctattgtgatgcatatcgtattgaacttggtgcagtgttgatgcaggatggcaaggtcattgcttatgctttgcggcagttgaagattcatgagaagaactacccggtccatgatttggagttggcagccattgtttacgcattgaaaatttggagacattatctgtatggcgtggcatgtgaggtgttcacggatcacaagagtcttcagtatttgttcaagcaacaggagttgaatttgagacagaggaggtggttagagttgttgaaagattatgatatcactatywtatatcatccgggaaaggccaatgtggtggccgatgcattgagtaggaagtcatccagtatgggcaatcttgcttatattccgggcggtgagagaccgcttgctttggatgttcgggatttggccaatcaattcatgaggttggatgtctctgagcccagccatgtgctagcttgcacagccgcttgttcttctttattggagcgtatccgtaatcggcagtatgatgatccccatttgtgtgttccttag

SEQ ID NO: 95 - DNA, 918 bp, Artificial Sequence; identical to SEQ ID NO: 26
  Description of Artificial Sequence: Synthetic polynucleotide

SEQ ID NO: 96 - DNA, 1507 bp, Artificial Sequence
  Description of Artificial Sequence: Synthetic polynucleotide
atggtgaaacaacaagggaaaggctctaaacaaccaggccgaggagaatcctccctgggagggaaacagaaaatggtcaaactcactccccaagctaggcaaaacatcaagaacataaggaaggccataaaagtggctgacaaagacattgacatttcggggagtgagtacgagccatctcgggatatctctttggactcaatcccagaatacatctcgtatccgtagagggccagacatagagacactcttcccctttccccgcagcccaagcatcagtgaacatttcttctaggtcgtctgagggctcaccagcgggtagtagggatgaatactctaccactcccacagcttcattatctgaagagggtgttgtaggagatgaggaagaagtaggtggtgacgatgaagtagaagaaggaggtgaaccacaagtgtggggggggggggattgtgagaactagaaagccgaggtttggcaagataggtttgttagtgaagtggcataccataaattctaggagtggtggccggtgagaaagttgatcccggagcggagtttcattgatagtgacttgctacctcacaaccccaacatgaggagacagtttaggatgagagttggctgggaccatttccttgataagtgtgaggattccaacgaacacttggtcaaagaattttacagcaatgtagcccacatcaaaaagggctccaaagtgaccaaggttcaaaattggaaggtgttgtttgatgggaagtatataaatgaatacctgagcttcaatgagaggacgagaccttatacatggcaaatttggaaatgggagaggaggtttgtccatggctagcacagtacttggcaatcccacgtaccgtccctgactggttggctgctggaatcaaaatattgagaaagagcctgaactttgaagcgaggggatgagagacttttgtttgcagccggttggaccctaccactcatgacaacgcctttcctctccatcgggctgtattggtcacttctattatggtggggtaccccatcaatatggggaatgtgatgtcgaggattattactattgtgggtgccgagcatgatagaaacaatccattccccagcttcctgactgagtacttccgggacctgaaagtggatgagaggccctatgacatcaaggtcaaggagatagccccattttcctggtatagcatgaagggggataacaaccccaagagcaagaactacaaagctcatgcttctgccccaattgtccagtctaaagatccagttatggtagaggtccctgctgagcctacctctactcctgctgacatctctcccggaccttccacatccacagctattcctgctggtctatccacatcagcgggcccggagatcccatcttactgggcccatcatattactacccaccgtctaagccaggcacttctaaatttcaacaactggatgaagactgcctcatctaagttgtccatctag

SEQ ID NO: 97 - DNA, 6603 bp, Artificial Sequence
  Description of Artificial Sequence: Synthetic polynucleotide
atgggtagaattgaaatgatgttcgaacagatgatgaagaaaaatgcagattctgatgcacagttggctttccacaatacctcaatcagaaatttggaggttcagataggccaaatctctcagtccttgaatacacgccctaagggtgctctaccaagtgatatagtagtaaacccaaagggtgagaacaatcatgttatggcagtaactacaaggagtggacgaggcggtgatgtgaatgcctctaaacaaaagcaagttttgagtgatgatattgagttgcaagaagatgaagttcctttggttgtagaaaatgtgatagatgacaatatgaatgaagaagtgatgattgatattcaagatgccgaggtggaaactcaaaatgacgtgaacccgtctagggaacacgtaatagatatgtcggagctggtggtgcctaaagccaaggtaccttttccaagatcacctccgccttatcctcaaagtcttgataagtagaaaattgagaatcagtttaaaaagttcattgacatgatgaagagcttatccattaatgtgcctttggtggaggctcttgagcaaatgccgggctatgcaaaattcatgaaggacttggtgacaaagaagtggtctatggattgtgaaactataaaaatgactaaccaagttagtacaatagtgcaatcaatggtcccgaatcttgaagatcccggtgctttcaccattccttgcaccattgggagtgcggattttgccaaggctctatgtgacttgggggctagtatcaatttgattcctactcggttttcaaaattttgtgtattgggcaacctaggccgacttccatgagattacaaatggcggatagaacgatgaagagatcattggatattatcgatgatgtccttatccgggtggacaaatttatcttgccagctgattttgtgatcttggactgtgaggtggattatgaagttcctatcatattggggagatctttccttgctaccgggaaggccttagttcatgtggaagtaggggacctcacctttcgggtgggtgatgaaaaagtggtctttcatgtttacaagtcaatgaaacagcccaacagtaccaaagtgtgctcttttatggacctcgtcacaatagtgataattgatgacaccagtgtaatgatcaatgtggaggactcattggaggccgtattgttgaatcttgatgtcaatgatgatgagggccgagtggagtgcgtgaatgctttacatgggatgggctcttactcttatgaacctaggaaactatctctggatctcgagaataggaagactccaccaacaaagccttcaattgaggagcctccggtgttggatttgaaaccacttccttcacaccttaggtatgagttcttaggctcaaactctactttgccagttattctttcctcttgtcttactaacatgcatgttgatgccaattagcggtgcttcaaaagtggaaaaaggcaattggatggactttagctgatattcgggggataagccccacattttgtatgcacaagattattctggaagatgatgtaaagccctccttggagcatcaaaggaagttgaaccaggcaatgcaagaagttgtgaaaaaggaggtgatcaggggttatgtaccccacctctgatagctcttggacttcaccggtgcaatgtataccgaagaagggtggcatgaccctggttgcaaattaacaaaatgagttaattcctaccataaccatcactggttggagggtatgcatggactaccacaagttgaataaagtgacccgcaaggatcactttcctttgacttttcttgaccagatgttagaccgacctgctgggcatgccttctactgtttcttgaatggatattctaggtacaaccaaatcttgattgctccagaagatcaagagaagaccacattcacttgtccatatagcacatttttttttctaggatgcctttcggattgtgtaatgcaccggctacattttaacggtgtatgatggccattttcaccgatatggtggaaggcattttggaggtgttcatggactactttagtgttgtgggtgattcatttgatgaatgcttgaagaatcttgatagagttttggcccgttgtgaagaaaccaatcttgttctcaattgggagaaataccactttatggtggaagagggtatagttcttgggcataaaatttcaaagcatggtattgaggtagacaaagcaaaaattgatatgatttcaggtctccctccccctacatctatcaatggagttagaagttttcttggatatgaggggttctaccggagatttatcaaagactttttgaaggtagtgaatcgtttgtgcaagttgttagaaaaagatgccaagttcgtgtttgatgaaaaatgtatgcaagcctttgaacttctcaagcataagttgaccaccactcctatcattaccgcacctaattagagcttgccctttgagctcatgtgtgatgcgagcgacgttgtggttggagcggttttgggtcaacgagtgaacaaaatgtttcatccggtgtactatacgagcaagacaatgcatgatgctcaagtgaactacacggtgactaagcaagagcttttgtctattgtgttcgcaatggaaaaatttcggccgtatctcatgggtgctaaggttattattcataccgatcatgccgcactccgatacttgatgacgaagaaggattccaaagctagactgatgcgatgggtcttgttacttcaagctttgaggaggaggggaggcctcgtgatggcctagaaagcaattattcatttcccgacgaacaactcctttcggtgtcgatgaatggaatgctatagtttgcagatgttgctaatttccttgtgactggtataatcccgtgtgagctctcttctaaccaaaagaagaagctcaagcgagatagtttggatttctattggtatgagacatacttgttcaagatttgcacggatggtgtgatccgaaggtgtgtcccagaggaagagaaattgagtatcttggaggtttgtcattcctctccctatggtggccataatggcggggcgaggacgacttccacagttcttagttgtggattttattggccaactttgtacaaagatgcaagtgaactcgtaaagaggtgtgacgaatgtcaaagagggggcggaatttcgaagaaagatgagatgcctctcaataccatccttgaggtggatatttttgatgtatgaggcattgattttatgggtccgtttgttagctcatgtgggaacacatacatttttgtggcggtggactatgtttcaaagtgggttgaagccgtggcttttcccaactatgaggcgcagagtgttgttgcatttctcaagaagagcagttttacaaggtttggtactcttcgtgcaatcataagtgatggggggtctcatttttgcaatagagcttttgacatttttcttgcaaagtatggtgtcaatcacaaagtttctactccctatcatcctcaagcaagtggtcaagttgaagtctacaacatggaaatcaaaaagatattgtcaacgacggtcaatgcttataggatcgattggtcaaagaagttggatgatgctctatgggcttataagattcttacaagactccgattggtatgtttccatatcggttggtgtttgggaaagcttgccatctaccggttgagttagagcacaaggccatgtgggccttatggaagctaaatcttgaatgggatattgcagccaatctctgtgtggagcagcttaatgaactcgatgaatttcgattccatgcctactccagttcttccttgtacaaggacaagatgaagtaccttcatgataaatatgctcgtagtaaggatttcaaagtgggtgatttggttctcttgttcaactcttggttacgtctgtttccggaaaagcttaagtcgaaatggagtggaccttttgaagtggtatgtgtgatcccgtttggtgcacttgatttaaagaacaaaaatggggaagttttcagagtgaatgggcatagggtcaagcactacttcggcaaaactgatgatagccacatggtggcacttcttcatctcaaatgatttgatggtaacttgcgtcgtgctgcgacgttaaatcagacgctttttgggaggcaacccatgtgtttttcttcttgtttttctttgattttcattgtaatataggatttatttttaggttgaccggttgtgagatgttacatgtttgtgtttatgcagtgcggcatatggtggaaaaattattcaagtctctgaagttttcaatgcggaccacactacattgtgtgcggccgcaaataactcagtgtggggggcacaaaatcagtgcagaccgcattgataaaggatgaaaatactagctctctgaagtttgccaccgcggccgccttgtattttgtgcggtccacggtgcctcaatgcggaccacattaccattttgtgcggtccgtggtgcaattgttcagagagtgggtagtctgaacaccacctctatgcagacagtattagcatttttgtgcggtccgcattggcctctatgcgaccgctttatattttgtgcggtccgcactgtgcaacatctgctactgtctgcatctttttattttctacaattgtgaacttaatttcttctactgatactaacaagtctaatggatgttgtttgcagacaatggtgaaacaagaggcaagggttctaaacaaccaggcaggggagagtcctcccggggagggaaacagaagatgctaagattgactccccaagcccgacaaaacattaaaaacacaaggaagctcactaaagctgctgataggtccattgaccagtctgggagtgaatacgagccctcccgagatatatcttcagactcaatcccagagtacatccctgactggccggagagaaacagactaagagacactcttccacctttccccactgtccaagcgtcagtaaatgtatcttctggttcgtctgagggctcagctgaaggtagtggggatgaatactccacctctcccacaacttcattatccgaagagggtgtagtaggggaagaagaggtagtaggagaagggggtcagccccaggttggtagggtagaacgaactagaaatccggaggtgtggcaagaccactttgtgagtgaggtggcctaccataaattcaaagaatggtggcctgtgaggaaattaatttcggagagaatttttgtagatagaaaccttttgcctcacaaccccaatgtgagaaggcaatttagagatagagtgggctgggagtatttcttaaacaattgtgaggatgcaaacgagcacctagtcaaggaattctacaccaatgttgcccacatcaagaagggcaccaaagtgaccaaggtgtgcaatttgaaagtgttgtttgataggaaaacaataaatgactacttggacttcgatgagaaggatgagtcgctgtatttggaaaagatggaattaggtgaggaggtctgtccttggttggcacagtatctggcaaacccaggtatcacccccgattggttgaatgcgggagtgaaaattttgataagaagtttgaatttcgaggccaaggggtgggaaacatttgtgtgtagcagattggaccccactactcatgaaaactcactccctcttcaccgggcagtattggtagcatcaatcatggtagggtacccaattaacgtcgggaaggtgatgtctcgggtgattacacaggtagttagtgaaggtgatagaactaacccttccctagcttcttgaccatgtactttagggaccgcaaagttgaaaagcggccatttgatatcaaggtaaaagcaaaggccccgttctcatggtataacatacagggtgatgacaacccgaaaggcaagaactacaagggaacatccactgatccaactggcaagtctgaagagccagttgtggtagtggctcctactcatcttgcctccacctcaatggacatccaccctggtccatccattttagcagctctagagataccctctacctcggctcatccagtgactgcacaatgtctaagccagacccttcttagcatcaacagttggatgcagacagcttcctctaagttgtttgccctcactactgcagtagcatctcagtcgacacctccacctctacaggtcctacagtctatgaggatgccctcaaggatattctggacaactagaaaaaaattcttgacactcaaaaatttcttacggacgctgtggagtcatatggaaaagctctcaaagagcttgctagggaggccaagaagatgagaaagacgcgggcttccaaggagtccgtgaaggagttgagggttaaggttgataggatgaaggcagaaagacgctttggatttattgctacaagaccctgtgccaacatctcaccctcagctagagcagtcccagaggcctcccaagaggaagaggatgattccccgagcagatga

SEQ ID NO: 98 - DNA, 1207 bp, Artificial Sequence; identical to SEQ ID NO: 14
  Description of Artificial Sequence: Synthetic polynucleotide

SEQ ID NO: 99 - DNA, 4787 bp, Artificial Sequence; identical to SEQ ID NO: 79
  Description of Artificial Sequence: Synthetic polynucleotide

SEQ ID NO: 100 - DNA, 895 bp, Artificial Sequence; identical to SEQ ID NO: 24
  Description of Artificial Sequence: Synthetic polynucleotide

SEQ ID NO: 101 - DNA, 2421 bp, Artificial Sequence; identical to SEQ ID NO: 48
  Description of Artificial Sequence: Synthetic polynucleotide

SEQ ID NO: 102 - DNA, 2121 bp, Artificial Sequence
  Description of Artificial Sequence: Synthetic polynucleotide
atggcttatcctgcagtgaactctttaattcaaactttggagctattccaaaagacttatccagcattgatccatggtcaaactgcagagatgattgactctctccatgccagtgctgaatattttcaaaatattcttgagaacgctagccaccagaaacaggaatatgatacattcaaatattttgaggcagagataagatcagcgatgcaccaagctgaagatgtgcttgaatcaaatgtgaggcggattaactccttctccactgaaacctatgctcgttgccttggcccccctgatgatgaggatcatttcttcaaaaagggacattctctggtagctggttcttcttcaaaccttgctcctacttcccttctaggtgatgatgatgatgatgatgatacagtcggtttggcgaattccttgagaaaactcactgatgcactacttggattagcttctgagcagaacgtcattcctattttgggaatgggtggatgtggcaataccacacttgctaaaaaggctcaagatgatcaatcaattagatcacattttgacatccaaacgtgggttactatatctcaagaatatcacttaaacgaagtgttgccaagccttgcacgtagccttacaggatacgagtttcagggaatgagtgatgaccagttaatggaccagtcatataaagcacttaagggtcggaagtatcttatcgtagttgatgatatttggagtacaaagatttgggatttgattgcgagaacccttcctgatgacaataatggaagtcgaatcattctgactacgaggctaaaagatgtggctgagtatgctaaccctgatatccctcctcttgaagtgctgccgttaggggtagatgagagttggaagttacttcagaataagttgttggggaaaagccacattaattgtcattctgaattagaagatatcgggaagaaaatagtacaaaaatgccagggactgcctctagcaattttggtggttgctgggcatctctctaggatttccccaaaaagggaaaactgggtaactgtatctgaaaatgtgaatgaagttgttacaagttatccgaatgaatgcatagcagtgcttgcgatcagttaccatcacctgcctattcacctcaaaccttgtttcctccatatgggagcattccctgaggattctgagattgatgcttggcggttaattcgtctgtgggttgcagagggttttctgaagagggataagctgagaagcctggaaaaagtggcagaggattgtttggaagatctggctagcagaaatttaataatggtcaaaagggggaaactcaatggccggatcaaaaatttgcctttgcatacacgcatttcaggggaaaactttaccaagtcagcaaaatttttgcgttgcttgtatcttttcaaggaacctcataaaacaataggaaaaccattggaattcaaagctttgagggtgttggctgccattcctagttttgttcatcacaatctggagtggcgtggaattttaactttacctaaccatatctggaatatgaagcagctgaggcatctccgtctacatggtagcacttatttgcccaacccatatgtggtagacgagttgggtctgcaacatctgcaggagctttccagtctctgtcttgctagctgtacaaaagagagattgaccctatctggaagttggcttccctgggaagacatggcaaatcttgccaagttaccaaatctccaactactcaaacttagatgtcatgcattcagaggtgaggtatggaaattaaaggaggaagatgagttcaagcagctaaagttccttctacttgatgacacagagacacaactctgggaggctaccaatgttaactttccaaatcttcaacgcctcgtattggagaaaatcaagattcttaggcgaattcctatagcctttgcagatacatacaccttggagtcaattgagttgtataaatgcggtctaattgtggattcagccagagaaattcaggaggaagtagctgccatggcgggaagtgattgtcttgctcttcgcatatatatatatgaaggtaacgactttcagaattaa

SEQ ID NO: 103 - DNA, 387 bp, Artificial Sequence
  Description of Artificial Sequence: Synthetic polynucleotide
atgatcgacccaggccaaggtatccttctctcttctgctccctcttttgatcttgtcgctttttgtgatgctgactgggctgcttgtaaagattctcgtcactccgtcagtggtttttttattactcttggaggtgcccctatttcttggaaatcgaagaagcaaatctccatctccttgtcatccgctgaatttgagtatcgatccatgagatgggtgactgctaagatcacttggcttgttcgactccttgctgatttatctactcctccaactttgccggttcctttacactctgacagtctggcggcgattcatatcgcccgcaatcccatcttccacgaacgaactaaacatgtagagttggattgccatttcgttcgatag

SEQ ID NO: 104 - DNA, 462 bp, Artificial Sequence; identical to SEQ ID NO: 89
  Description of Artificial Sequence: Synthetic polynucleotide

SEQ ID NO: 105 - DNA, 816 bp, Artificial Sequence; identical to SEQ ID NO: 40
  Description of Artificial Sequence: Synthetic polynucleotide

SEQ ID NO: 106 - DNA, 1533 bp, Artificial Sequence; identical to SEQ ID NO: 42
  Description of Artificial Sequence: Synthetic polynucleotide

SEQ ID NO: 107 - DNA, 1485 bp, Artificial Sequence; identical to SEQ ID NO: 31
  Description of Artificial Sequence: Synthetic polynucleotide

SEQ ID NO: 108 - DNA, 1239 bp, Artificial Sequence; identical to SEQ ID NO: 37
  Description of Artificial Sequence: Synthetic polynucleotide

SEQ ID NO: 109 - DNA, 930 bp, Artificial Sequence; identical to SEQ ID NO: 43
  Description of Artificial Sequence: Synthetic polynucleotide

SEQ ID NO: 110 - DNA, 918 bp, Artificial Sequence; identical to SEQ ID NO: 26
  Description of Artificial Sequence: Synthetic polynucleotide

SEQ ID NO: 111 - DNA, 1188 bp, Artificial Sequence; identical to SEQ ID NO: 41
  Description of Artificial Sequence: Synthetic polynucleotide

SEQ ID NO: 112 - DNA, 2718 bp, Artificial Sequence; identical to SEQ ID NO: 47
  Description of Artificial Sequence: Synthetic polynucleotide

SEQ ID NO: 113 - DNA, 930 bp, Artificial Sequence; identical to SEQ ID NO: 34
  Description of Artificial Sequence: Synthetic polynucleotide

SEQ ID NO: 114 - DNA, 1470 bp, Artificial Sequence; identical to SEQ ID NO: 45
  Description of Artificial Sequence: Synthetic polynucleotide

SEQ ID NO: 115 - DNA, 654 bp, Artificial Sequence; identical to SEQ ID NO: 44
  Description of Artificial Sequence: Synthetic polynucleotide

SEQ ID NO: 116 - protein, 806 aa, Artificial Sequence; identical to SEQ ID NO: 68
  Description of Artificial Sequence: Synthetic polypeptide

SEQ ID NO: 117 - protein, 706 aa, Artificial Sequence
  Description of Artificial Sequence: Synthetic polypeptide
MAYPAVNSLIQTLELFQKTYPALIHGQTAEMIDSLHASAEYFQNILENASHQKQEYDTFKYFEAEIRSAMHQAEDVLESNVRRINSFSTETYARCLGPPDDEDHFFKKGHSLVAGSSSNLAPTSLLGDDDDDDDTVGLANSLRKLTDALLGLASEQNVIPILGMGGCGNTTLAKKAQDDQSIRSHFDIQTWVTISQEYHLNEVLPSLARSLTGYEFQGMSDDQLMDQSYKALKGRKYLIVVDDIWSTKIWDLIARTLPDDNNGSRIILTTRLKDVAEYANPDIPPLEVLPLGVDESWKLLQNKLLGKSHINCHSELEDIGKKIVQKCQGLPLAILVVAGHLSRISPKRENWVTVSENVNEVVTSYPNECIAVLAISYHHLPIHLKPCFLHMGAFPEDSEIDAWRLIRLWVAEGFLKRDKLRSLEKVAEDCLEDLASRNLIMVKRGKLNGRIKNLPLHTRISGENFTKSAKFLRCLYLFKEPHKTIGKPLEFKALRVLAAIPSFVHHNLEWRGILTLPNHIWNMKQLRHLRLHGSTYLPNPYVVDELGLQHLQELSSLCLASCTKERLTLSGSWLPWEDMANLAKLPNLQLLKLRCHAFRGEVWKLKEEDEFKQLKFLLLDDTETQLWEATNVNFPNLQRLVLEKIKILRRIPIAFADTYTLESIELYKCGLIVDSAREIQEEVAAMAGSDCLALRIYIYEGNDFQN

SEQ ID NO: 118 - protein, 128 aa, Artificial Sequence
  Description of Artificial Sequence: Synthetic polypeptide
MIDPGQGILLSSAPSFDLVAFCDADWAACKDSRHSVSGFFITLGGAPISWKSKKQISISLSSAEFEYRSMRWVTAKITWLVRLLADLSTPPTLPVPLHSDSLAAIHIARNPIFHERTKHVELDCHFVR

SEQ ID NO: 119 - protein, 153 aa, Artificial Sequence
  Description of Artificial Sequence: Synthetic polypeptide
MGLNDVYSQARGNILMMNPLSRIDFSYSLLLQDKNQREIYARSQFNADASSFMVGVQGKAPQKNNNQSQQKSWTNSQKVNNTQQKPKGRKAKFNPNMNYTYCMRIGHVRVDCYRLNGFPDDFQFTISTQVKANAIVKGQDNDNGSTQSNDGTP

SEQ ID NO: 120 - protein, 271 aa, Artificial Sequence; identical to SEQ ID NO: 60
  Description of Artificial Sequence: Synthetic polypeptide

SEQ ID NO: 121 - protein, 510 aa, Artificial Sequence; identical to SEQ ID NO: 62
  Description of Artificial Sequence: Synthetic polypeptide

SEQ ID NO: 122 - protein, 494 aa, Artificial Sequence; identical to SEQ ID NO: 51
  Description of Artificial Sequence: Synthetic polypeptide

SEQ ID NO: 123 - protein, 412 aa, Artificial Sequence; identical to SEQ ID NO: 57
  Description of Artificial Sequence: Synthetic polypeptide

SEQ ID NO: 124 - protein, 309 aa, Artificial Sequence; identical to SEQ ID NO: 63
  Description of Artificial Sequence: Synthetic polypeptide

SEQ ID NO: 125 - protein, 305 aa, Artificial Sequence; identical to SEQ ID NO: 66
  Description of Artificial Sequence: Synthetic polypeptide

SEQ ID NO: 126 - protein, 395 aa, Artificial Sequence; identical to SEQ ID NO: 61
  Description of Artificial Sequence: Synthetic polypeptide

SEQ ID NO: 127 - protein, 905 aa, Artificial Sequence; identical to SEQ ID NO: 67
  Description of Artificial Sequence: Synthetic polypeptide

SEQ ID NO: 128 - protein, 309 aa, Artificial Sequence; identical to SEQ ID NO: 54
  Description of Artificial Sequence: Synthetic polypeptide

SEQ ID NO: 129 - protein, 489 aa, Artificial Sequence; identical to SEQ ID NO: 65
  Description of Artificial Sequence: Synthetic polypeptide

SEQ ID NO: 130 - protein, 217 aa, Artificial Sequence; identical to SEQ ID NO: 64
  Description of Artificial Sequence: Synthetic polypeptide

SEQ ID NO: 131 - DNA, 121 bp, Artificial Sequence
  Description of Artificial Sequence: Synthetic polynucleotide
atcatgtctaattgatttaattgctgtatttgctcaaactgccttatttggactatgtgamacatgctaggttagaaatatatgttttaacttggtgtgaaatttaatttaattgagtatt

SEQ ID NO: 132 - DNA, 121 bp, Artificial Sequence
  Description of Artificial Sequence: Synthetic polynucleotide
gcggctgtataccattttgtacggaccgcagtgggctcaccgtggcctcaatcgagtttgygcggttcataaagatgggggttcagagagttgggagtttagagattaagaccaatacggt

SEQ ID NO: 133 - DNA, 121 bp, Artificial Sequence
  Description of Artificial Sequence: Synthetic polynucleotide
ggaagcactcaagcatccactcttggaggtggtgggggagggtctggaatattatcattgkcctggtggcttctcctttgtctttgaggtacaataggaacctcatcatcaatattgtcat

SEQ ID NO: 134 - DNA, 121 bp, Artificial Sequence
  Description of Artificial Sequence: Synthetic polynucleotide
acgaaggataaagtgtttgggtagcagaacaaaatgccttcgtcattccagtctttaacayatgccaagtgcaaacaatacaatttaaatttgtagtctcttctgatggtgttggacttac

SEQ ID NO: 135 - DNA, 121 bp, Artificial Sequence
  Description of Artificial Sequence: Synthetic polynucleotide
acaccttcttccgggttaacagaattccatactcggatttctggttcgcagactgtaatayggagtcaatcttttcctcgatttgggatttgaaccggtgatttgggaaatcataattatc

SEQ ID NO: 136 - DNA, 121 bp, Artificial Sequence
  Description of Artificial Sequence: Synthetic polynucleotide
tagctaacaaggaattggatcaattgagagattgattaacccaattaaagagtttaacctrgagatagtaacaacatgacttgagctcttatcaacagttttggttgataccttttggtct

SEQ ID NO: 137 - DNA, 121 bp, Artificial Sequence
  Description of Artificial Sequence: Synthetic polynucleotide
ttacataaatataaaggtttaattgaaagttatactttttggtcaaacacaaataccgtaycaaaatagttcgatacggttaggtattttcttgtttggttcggtacggcttcgatattat

SEQ ID NO: 138 - DNA, 121 bp, Artificial Sequence
  Description of Artificial Sequence: Synthetic polynucleotide
gaaaataccgaccgaaaacggtcgaaaataacatattttttaattattccaaccgacttcrgtcggtttgttaagatttaaaaagaaatgcaaaattatcacataattatatttccgaccg

SEQ ID NO: 139 - DNA, 121 bp, Artificial Sequence
  Description of Artificial Sequence: Synthetic polynucleotide
gtctgcacttttcttattgcttattgtttacccgaaaaatggatagagttgaatttatacrtagttttaagggtatgtggtataatttaatacaaatcgtaagaataagtagaaatatcaa

SEQ ID NO: 140 - DNA, 120 bp, Artificial Sequence
  Description of Artificial Sequence: Synthetic polynucleotide
taggattttgaccgtggttgggaactatgtgaagacaactccggaatagagttatgtcgrttctgttagctccattagatgattttggacttaggggcgtgtccggattatgttttggag

SEQ ID NO: 141 - DNA, 121 bp, Artificial Sequence
  Description of Artificial Sequence: Synthetic polynucleotide
gtcccttacgaatttgtcttcaaattgatacttctccttgctaaaacaccacgatccttarccacaactcaccccacgaaccctagcatagaaccacaacaccctacggcccttaagaaac

SEQ ID NO: 142 - DNA, 121 bp, Artificial Sequence
  Description of Artificial Sequence: Synthetic polynucleotide
gcctcccagcttagcaagagttcatccggcatttcatttttcgatgctacaaaggtatcayggcaatccgtctcatgtgttggatttcagctcagtccagttggacaaggatctatcttat

SEQ ID NO: 143 - DNA, 121 bp, Artificial Sequence
  Description of Artificial Sequence: Synthetic polynucleotide
ccaaattatttttgactgtttgaccaaaatagcgaccaacgttggtcgccatttttgatcrtttgaccaaaatggcgaccaactttggtcgctatatttgaaaataaataaataaaataat

SEQ ID NO: 144 - DNA, 122 bp, Artificial Sequence
  Description of Artificial Sequence: Synthetic polynucleotide
  misc_feature (62)..(62): May or may not be present
ttgtttctcaagaaaatcagcatcgatctttttctttattataaaggtaatatagatgcttggggtattaaaagaggacaaaatattctggcatcatttgagatttgctgagtgcaataaca

SEQ ID NO: 145 - DNA, 840 bp, Artificial Sequence
  Description of Artificial Sequence: Synthetic polynucleotide
atggaagatcatcatcttcatcttgaattctccatttatagttcttcttcttcttcttcttcttctataacttcctcctcatttgcaaattcttctaatggcttaaattctccttcaaccaccacttcttctacttcatcatcttctttccatgagaacattaatgcaaaaaccccatcaaatggctatacttgcaaatccaagaaaagctcaaaaatagttcaagatttcaccaaaaatgggaatggtcatgggaatggggagaacaagaaaaaaagaaagaatcaaggtgatgaaaagcatccaacttttagaggagttcgtaagaggaattggggtaaatgggtgtccgaaattagacaaccaaggaaaaaatcaagaatatggctagggacttatccaacggctgaaatggcggctcgagctcatgatgtcgcagctttagccattaaaggtaactcggcttatcttaatttccctcatttagccgatcaactcccacgaccagcctccacttcccctaaggacatccaagcagcagccgctaatgcggccactagtacgtttctcgagaaaaattccgtcagagatgaagttgagtcccaaattaaactgcacagttcacattcatcgatgaatttagccttagagaacacacaagaattgctaaattctccatcgatagaccacgatgacacattttttgatctacctgatcttaccatcgatcaagtggaccaaaatgaccgttatcaatacccaatctcaacgtggcagctggctggagccgatagcggaatatttcggctcgaggagccatttttgtgggagtgctattag

SEQ ID NO: 146 - DNA, 840 bp, Artificial Sequence; identical to SEQ ID NO: 145
  Description of Artificial Sequence: Synthetic polynucleotide

SEQ ID NO: 147 - protein, 279 aa, Artificial Sequence
  Description of Artificial Sequence: Synthetic polypeptide
MEDHHLHLEFSIYSSSSSSSSSITSSSFANSSNGLNSPSTTTSSTSSSSFHENINAKTPSNGYTCKSKKSSKIVQDFTKNGNGHGNGENKKKRKNQGDEKHPTFRGVRKRNWGKWVSEIRQPRKKSRIWLGTYPTAEMAARAHDVAALAIKGNSAYLNFPHLADQLPRPASTSPKDIQAAAANAATSTFLEKNSVRDEVESQIKLHSSHSSMNLALENTQELLNSPSIDHDDTFFDLPDLTIDQVDQNDRYQYPISTWQLAGADSGIFRLEEPFLWECY

SEQ ID NO: 148 - DNA, 2828 bp, Artificial Sequence
  Description of Artificial Sequence: Synthetic polynucleotide
  LARi1_c2, target gene is NDG1
  misc_feature (1)..(100): Gateway cloning site sequence
  misc_feature (2729)..(2828): Gateway cloning site sequence
caaataatgattttattttgactgatagtgacctgttcgttgcaacacattgatgagcaatgcttttttataatgccaactttgtacaaaaaagcaggctttgataagtttgtaattgaggcaaagcttcacaaggacaaaggggtaggcaggtttgtggacattgcgcattataaaagagtgaaagatgtagcccttgagattaaaggtatcagagatagggtgaaagaaatccgtctgaacaatgcacatggccttcaagctcttcaagatgatgatccatccaacagaggcgtggaagacagaaaggcctcccgtggttgaggaagatgatgtggtgggctttgatgaggaggcacagaaggtaatcgaccgtcttcttgacagatcagatgaattagaggttattccagttgtaggaatgcctggtcttggcaaaaccacactagcaactaagattttcaagcatcggaaggttgaatacgagttctttactcgagtttgggtttatgtctcgcaatcatacaagacaagagaattatatctcaacatcattagcaaattcaccggaaaaacaaaacaataccaatatatgtgtgggaacgtatcaagattgctttcccgaacaacaaaaagtgcaatagagtattgttgaccactcgagatcacaaggtggctcatcattgcaacaatactccacatgatttaaaatttcttagcgatgaggaaagttggatgttgctagagaagaaagtttttcacaaggctaaatgtcctccggaattggaaagacctggacagagcatagccaggaagtgtaagggacttccccttgcaattgtggtgattgcaggagctctaatagggaaacgcaagacaacaagggagtgggagcaagtggatcagagtgttggtgaacacctcattaatagaaaccagccaaagaattgtaataaaattggtgcaaatgagttatgatcgtttgccttacgacttgaaagcatgctttttgtattgtggtgcatttcccagaggctttgagatccctgcttggaatttgatccgtttatggatcgccgaaggcttcatccaattcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaattggatgaagccttcggcgatccataaacggatcaaattccaagcagggatctcaaagcctctgggaaatgcaccacaatacaaaaagcatgctttcaagtcgtaaggcaaacgatcataactcatttgcaccaattttattacaattctttggctggtttctattaatgaggtgttcaccaacactctgatccacttgctcccactcccttgttgtcttgcgtttccctattagagctcctgcaatcaccacaattgcaaggggaagtcccttacacttcctggctatgctctgtccaggtctttccaattccggaggacatttagccttgtgaaaaactttcttctctagcaacatccaactttcctcatcgctaagaaattttaaatcatgtggagtattgttgcaatgatgagccaccttgtgatctcgagtggtcaacaatactctattgcactttttgttgttcgggaaagcaatcttgatacgttcccacacatatattggtattgttttgtttttccggtgaatttgctaatgatgttgagatataattctcttgtcttgtatgattgcgagacataaacccaaactcgagtaaagaactcgtattcaaccttccgatgcttgaaaatcttagttgctagtgtggttttgccaagaccaggcattcctacaactggaataacctctaattcatctgatctgtcaagaagacggtcgattaccttctgtgcctcctcatcaaagcccaccacatcatcttcctcaaccacgggaggcctttctgtcttccacgcctctgttggatggatcatcatcttgaagagcttgaaggccatgtgcattgttcagacggatttctttcaccctatctctgatacctttaatctcaagggctacatctttcactcttttataatgcgcaatgtccacaaacctgcctacccctttgtccttgtgaagctttgcctcaattacaaacttatcaaacccagctttcttgtacaaagttggcattataagaaagcattgcttatcaatttgttgcaacgaacaggtcactatcagtcaaaataaaatcattatttg

SEQ ID NO: 149 - DNA, 2804 bp, Artificial Sequence
  Description of Artificial Sequence: Synthetic polynucleotide
  LARi1_c3, target gene is NDG1
  misc_feature (1)..(100): Gateway cloning site sequence
  misc_feature (2705)..(2804): Gateway cloning site sequence
caaataatgattttattttgactgatagtgacctgttcgttgcaacacattgatgagcaatgcttttttataatgccaactttgtacaaaaaagcaggctaacacctcattaatagaaaccagccaaagaattgtaataaaattggtgcaaatgagttatgatcgtttgccttacgacttgaaagcatgctttttgtattgtggtgcatttcccagaggctttgagatccctgcttggaatttgatccgtttatggatcgccgaaggcttcatccaatacaaagggcccttatcccttgaacgtaaagcagaggattacttgaatgatctcgtcaacagaaacttagtgatgataattcaaaggacgtctgatggacaaatcaaaacatgtcgtgttcatgacatgttgcatgagttttgctggcaagaggccacaacagaagaaaatcttttccaagaggtaaaattaggtgttgggcaatttgctcgtgagatacagcaactatccacctaccgccgcttgtgcattcattcctcagttctggaattcatttctatgaagccctctggtgagcatgttaggtcattcctatgtttttcttcagaaaaaattgacatgcccccggttgacatcccaaacataccaaaagactttccattgctaagggtgttggatgctgaatccatcaaattcagttgcttttgcagggagtttttccaattgtattttctgaggtatattgctttctcatctgactttatcaagatccttcctaaacatattggggaactatggaacgtacaaaccctcattgttaacacacaacagagcaatcttgatattcaagcagacatatggaacatgccacggctgaggcatctgcacactaacacgtccgctaaattgcctacgcctgttgccccaaaaagtagcaaggttacctcggtaaatcaatgcctacaaactctctccacaattgcaccagaaagctgcacagaagaagttttttcaagggctccaaacttgaaaaaactgggcattcgtggtaaaatctttatgcttctggaaccaaataagtccttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaaggacttatttggttccagaagcataaagattttaccacgaatgcccagttttttcaagtttggagcccttgaaaaaacttcttctgtgcagctttctggtgcaattgtggagagagtttgtaggcattgatttaccgaggtaaccttgctactttttggggcaacaggcgtaggcaatttagcggacgtgttagtgtgcagatgcctcagccgtggcatgttccatatgtctgcttgaatatcaagattgctctgttgtgtgttaacaatgagggtttgtacgttccatagttccccaatatgtttaggaaggatcttgataaagtcagatgagaaagcaatatacctcagaaaatacaattggaaaaactccctgcaaaagcaactgaatttgatggattcagcatccaacacccttagcaatggaaagtcttttggtatgtttgggatgtcaaccgggggcatgtcaattttttctgaagaaaaacataggaatgacctaacatgctcaccagagggcttcatagaaatgaattccagaactgaggaatgaatgcacaagcggcggtaggtggatagttgctgtatctcacgagcaaattgcccaacacctaattttacctcttggaaaagattttcttctgttgtggcctcttgccagcaaaactcatgcaacatgtcatgaacacgacatgttttgatttgtccatcagacgtcctttgaattatcatcactaagtttctgttgacgagatcattcaagtaatcctctgctttacgttcaagggataagggccctttgtattggatgaagccttcggcgatccataaacggatcaaattccaagcagggatctcaaagcctctgggaaatgcaccacaatacaaaaagcatgctttcaagtcgtaaggcaaacgatcataactcatttgcaccaattttattacaattctttggctggtttctattaatgaggtgttacccagctttcttgtacaaagttggcattataagaaagcattgcttatcaatttgttgcaacgaacaggtcactatcagtcaaaataaaatcattatttg

SEQ ID NO: 150 - DNA, 2828 bp, Artificial Sequence
  Description of Artificial Sequence: Synthetic polynucleotide
  LARi2_c2, target gene is NDG2
  misc_feature (1)..(100): Gateway cloning site sequence
  misc_feature (2729)..(2828): Gateway cloning site sequence
caaataatgattttattttgactgatagtgacctgttcgttgcaacacattgatgagcaatgcttttttataatgccaactttgtacaaaaaagcaggctggtgaggcggattaactccttctccactgaaacctatgctcgttgccttggcccccctgatgatgaggatcatttcttcaaaaagggacattctctggtagctggttcttcttcaaaccttgctcctacttcccttctaggtgatgatgatgatgatgatgatacagtcggtttggcgaattccttgagaaaactcactgatgcactacttggattagcttctgagcagaacgtcattcctattttgggaatgggtggatgtggcaataccacacttgctaaaaaggctcaagatgatcaatcaattagatcacattttgacatccaaacgtgggttactatatctcaagaatatcacttaaacgaagtgttgccaagccttgcacgtagccttacaggatacgagtttcagggaatgagtgatgaccagttaatggaccagtcatataaagcacttaagggtcggaagtatcttatcgtagttgatgatatttggagtacaaagatttgggatttgattgcgagaacccttcctgatgacaataatggaagtcgaatcattctgactacgaggctaaaagatgtggctgagtatgctaaccctgatatccctcctcttgaagtgctgccgttaggggtagatgagagttggaagttacttcagaataagttgttggggaaaagccacattaattgtcattctgaattagaagatatcgggaagaaaatagtacaaaaatgccagggactgcctctagcaattttggtggttgctgggcatctctctaggatttccccaaaaagggaaaactgggtaactgtatctgaaaatgtgaatgaagttgttacaagttatccgaatgaatgcatagcagtgcttgcgatcagttaccatcacctgcctattcacctcaaaccttgtttcctccatatgggagcattccctgaggattctgagattgatgcttggcggttaattcgtctgtgggttgcttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaagcaacccacagacgaattaaccgccaagcatcaatctcagaatcctcagggaatgctcccatatggaggaaacaaggtttgaggtgaataggcaggtgatggtaactgatcgcaagcactgctatgcattcattcggataacttgtaacaacttcattcacattttcagatacagttacccagttttccctttttggggaaatcctagagagatgcccagcaaccaccaaaattgctagaggcagtccctggcatttttgtactattttcttcccgatatcttctaattcagaatgacaattaatgtggcttttccccaacaacttattctgaagtaacttccaactctcatctacccctaacggcagcacttcaagaggagggatatcagggttagcatactcagccacatcttttagcctcgtagtcagaatgattcgacttccattattgtcatcaggaagggttctcgcaatcaaatcccaaatctttgtactccaaatatcatcaactacgataagatacttccgacccttaagtgctttatatgactggtccattaactggtcatcactcattccctgaaactcgtatcctgtaaggctacgtgcaaggcttggcaacacttcgtttaagtgatattcttgagatatagtaacccacgtttggatgtcaaaatgtgatctaattgattgatcatcttgagcctttttagcaagtgtggtattgccacatccacccattcccaaaataggaatgacgttctgctcagaagctaatccaagtagtgcatcagtgagttttctcaaggaattcgccaaaccgactgtatcatcatcatcatcatcatcacctagaagggaagtaggagcaaggtttgaagaagaaccagctaccagagaatgtccctttttgaagaaatgatcctcatcatcaggggggccaaggcaacgagcataggtttcagtggagaaggagttaatccgcctcaccacccagctttcttgtacaaagttggcattataagaaagcattgcttatcaatttgttgcaacgaacaggtcactatcagtcaaaataaaatcattatttg

SEQ ID NO: 151 - DNA, 2828 bp, Artificial Sequence
  Description of Artificial Sequence: Synthetic polynucleotide
  LARi2_c3, target gene is NDG2
  misc_feature (1)..(100): Gateway cloning site sequence
  misc_feature (2729)..(2828): Gateway cloning site sequence
caaataatgattttattttgactgatagtgacctgttcgttgcaacacattgatgagcaatgcttttttataatgccaactttgtacaaaaaagcaggcttttgcatacacgcatttcaggggaaaactttaccaagtcagcaaaatttttgcgttgcttgtatcttttcaaggaacctcataaaacaataggaaaaccattggaattcaaagctttgagggtgttggctgccattcctaggtatcatttcatcttcaggcgtcgcatgaccttagattcagctatcttgagattcacatagacaatcattttactgaatcacttgaatatatgcataacctgcaaacctttagttttgttcatcacaatctggagtggcgtggaattttaactttacctaaccatatctggaatatgaagcagctgaggcatctccgtctacatggtagcacttatttgcccaacccatatgtggtagacgagttgggtctgcaacatctgcaggagctttccagtctctgtcttgctagctgtacaaaagaggtatttcttggccttcctcatctaaagaaattacgtatctatgatatcggggaaaaatacaaagcattagaggaaacatgttggagcctgctctacttgaataaactccgagtattagagtgttcctttgatgaagggaactctctctggctaaatgttgtttcccaatatcgctaaagagattgaccctatctggaagttggcttccctgggaagacatggcaaatcttgccaagttaccaaatctccaactactcaaacttagatgtcatgcattcagaggtgaggtatggaaattaaaggaggaagatgagttcaagcagctaaagttccttctacttgatgacacagagacacaactctgggaggctaccaatgttaactttccaaatcttcaacgcctcgtattggagaaaatcaagattcttaggcgaattcctatagcctttgcagatacatacaccttggagtcaattgagttgtataaatgcggtctaattgtggattcagccagagaaattcaggaggaagtagctgccatggcgggaattcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaattcccgccatggcagctacttcctcctgaatttctctggctgaatccacaattagaccgcatttatacaactcaattgactccaaggtgtatgtatctgcaaaggctataggaattcgcctaagaatcttgattttctccaatacgaggcgttgaagatttggaaagttaacattggtagcctcccagagttgtgtctctgtgtcatcaagtagaaggaactttagctgcttgaactcatcttcctcctttaatttccatacctcacctctgaatgcatgacatctaagtttgagtagttggagatttggtaacttggcaagatttgccatgtcttcccagggaagccaacttccagatagggtcaatctctttagcgatattgggaaacaacatttagccagagagagttcccttcatcaaaggaacactctaatactcggagtttattcaagtagagcaggctccaacatgtttcctctaatgctttgtatttttccccgatatcatagatacgtaatttctttagatgaggaaggccaagaaatacctcttttgtacagctagcaagacagagactggaaagctcctgcagatgttgcagacccaactcgtctaccacatatgggttgggcaaataagtgctaccatgtagacggagatgcctcagctgcttcatattccagatatggttaggtaaagttaaaattccacgccactccagattgtgatgaacaaaactaaaggtttgcaggttatgcatatattcaagtgattcagtaaaatgattgtctatgtgaatctcaagatagctgaatctaaggtcatgcgacgcctgaagatgaaatgatacctaggaatggcagccaacaccctcaaagctttgaattccaatggttttcctattgttttatgaggttccttgaaaagatacaagcaacgcaaaaattttgctgacttggtaaagttttcccctgaaatgcgtgtatgcaaaacccagctttcttgtacaaagttggcattataagaaagcattgcttatcaatttgttgcaacgaacaggtcactatcagtcaaaataaaatcattatttg

SEQ ID NO: 152 - DNA, 1013 bp, Artificial Sequence
  Description of Artificial Sequence: Synthetic polynucleotide
  LARi3_c1, target gene is NDG3
  misc_feature (1)..(100): Gateway cloning site sequence
  misc_feature (914)..(1013): Gateway cloning site sequence
caaataatgattttattttgactgatagtgacctgttcgttgcaacacattgatgagcaatgcttttttataatgccaactttgtacaaaaaagcaggctttgtcgctttttgtgatgctgactgggctgcttgtaaagattctcgtcactccgtcagtggtttttttattactcttggaggtgcccctatttcttggaaatcgaagaagcaaatctccatctccttgtcatccgctgaatttgagtatcgatccatgagatgggtgactgctaagatcacttggcttgttcgactccttgctgatttatctactcctccaactttgccggttcctttacactctgacagtctggcggcgattcatatcgcccgcaatcccatcttccacgaacgaactaaacatgtagagttggattgccatttcgttctaataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccagaacgaaatggcaatccaactctacatgtttagttcgttcgtggaagatgggattgcgggcgatatgaatcgccgccagactgtcagagtgtaaaggaaccggcaaagttggaggagtagataaatcagcaaggagtcgaacaagccaagtgatcttagcagtcacccatctcatggatcgatactcaaattcagcggatgacaaggagatggagatttgcttcttcgatttccaagaaataggggcacctccaagagtaataaaaaaaccactgacggagtgacgagaatctttacaagcagcccagtcagcatcacaaaaagcgacaaacccagctttcttgtacaaagttggcattataagaaagcattgcttatcaatttgttgcaacgaacaggtcactatcagtcaaaataaaatcattatttg

SEQ ID NO: 153 - DNA, 1163 bp, Artificial Sequence
  Description of Artificial Sequence: Synthetic polynucleotide
  LARi4_c1, target gene is NDG4
  misc_feature (1)..(100): Gateway cloning site sequence
  misc_feature (1064)..(1163): Gateway cloning site sequence
caaataatgattttattttgactgatagtgacctgttcgttgcaacacattgatgagcaatgcttttttataatgccaactttgtacaaaaaagcaggctccattgtctagaatagatttttcttattcacttcttctacaagataaaaatcaaagggagatatatgcaagatcacagttcaatgctgatgcttcctcattcatggtaggagttcaaggtaaggctccacagaaaaacaacaatcagtcacaacaaaagtcatggactaattcacaaaaggttaataacacacagcagaaacctaagggaaggaaagcaaaatttaatcctaatatgaactatacatattgcatgagaattgggcatgtcagggtagattgttataggctaaatgggtttccagatgatttccaattcaccatatcaacacaggtcaaggctaatgctatagttaaaggacaagacaatgacaatggaagcactcaaagcaatgatggaacaccttaataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccaaggtgttccatcattgctttgagtgcttccattgtcattgtcttgtcctttaactatagcattagccttgacctgtgttgatatggtgaattggaaatcatctggaaacccatttagcctataacaatctaccctgacatgcccaattctcatgcaatatgtatagttcatattaggattaaattttgctttccttcccttaggtttctgctgtgtgttattaaccttttgtgaattagtccatgacttttgttgtgactgattgttgtttttctgtggagccttaccttgaactcctaccatgaatgaggaagcatcagcattgaactgtgatcttgcatatatctccctttgatttttatcttgtagaagaagtgaataagaaaaatctattctagacaatggacccagctttcttgtacaaagttggcattataagaaagcattgcttatcaatttgttgcaacgaacaggtcactatcagtcaaaataaaatcattatttg

SEQ ID NO: 154 - DNA, 2474 bp, Artificial Sequence
  Description of Artificial Sequence: Synthetic polynucleotide
  LARi5_c1, target gene is NDG5
  misc_feature (1)..(100): Gateway cloning site sequence
  misc_feature (2375)..(2474): Gateway cloning site sequence
caaataatgattttattttgactgatagtgacctgttcgttgcaacacattgatgagcaatgcttttttataatgccaactttgtacaaaaaagcaggctatggaaatcgacttgaacattcaagagttgctagtgatcgatgattcagatttgcttatgcaccaggtacaaggagagtgggccaccaagaattccaagatattgccatatctgcaccatgtgcaggaattaagaaagaggttcatgaagatagaatttcgacatgtgcccagaattcagaatgagtttgtcgatgcagtagccaccttgtcatctatgatacaacatccatataaaaattatattgatcccatcccagtgaagatccataatcagtcggcatattgcgctcatgttgaagaagaaatagatggaaagccttggttccatgacatcaagaagtatttgtcaaagggagaatatcttgagcacgcaaaccacactcagaaatgcacactccagagattttacaatcacttcttccacggcggaggaaatttgtacaggagaactcctgatttgggtttcctaagatgtgtcgatgcaaaggaagcttctaagctacttgaggatgtacatgccgggacttgtggcctgcacatgaatggtttcgtcttggctaagaagatacttagggtcggttacttttggatgaccatggaaacggattgcatccatgtgccaaggccaaatttatcagaacataatgtccagagctttcaactaaagggtcaaactaaggcaatttacaccagggtgctgacaggaggagcacccatacttgcaaaaattgatggagcaatttggccaaaaccaattaattcagacgcaatcaagagatacgatgcttggattatttacatttttctcatctaattcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaattagatgagaaaaatgtaaataatccaagcatcgtatctcttgattgcgtctgaattaattggttttggccaaattgctccatcaatttttgcaagtatgggtgctcctcctgtcagcaccctggtgtaaattgccttagtttgaccctttagttgaaagctctggacattatgttctgataaatttggccttggcacatggatgcaatccgtttccatggtcatccaaaagtaaccgaccctaagtatcttcttagccaagacgaaaccattcatgtgcaggccacaagtcccggcatgtacatcctcaagtagcttagaagcttcctttgcatcgacacatcttaggaaacccaaatcaggagttctcctgtacaaatttcctccgccgtggaagaagtgattgtaaaatctctggagtgtgcatttctgagtgtggtttgcgtgctcaagatattctccctttgacaaatacttcttgatgtcatggaaccaaggctttccatctatttcttcttcaacatgagcgcaatatgccgactgattatggatcttcactgggatgggatcaatataatttttatatggatgttgtatcatagatgacaaggtggctactgcatcgacaaactcattctgaattctgggcacatgtcgaaattctatcttcatgaacctctttcttaattcctgcacatggtgcagatatggcaatatcttggaattcttggtggcccactctccttgtacctggtgcataagcaaatctgaatcatcgatcactagcaactcttgaatgttcaagtcgatttccatacccagctttcttgtacaaagttggcattataagaaagcattgcttatcaatttgttgcaacgaacaggtcactatcagtcaaaataaaatcattatttg

SEQ ID NO: 155 - DNA, 1175 bp, Artificial Sequence
  Description of Artificial Sequence: Synthetic polynucleotide
  LARi6_c1, target gene is NDG6
  misc_feature (1)..(100): Gateway cloning site sequence
  misc_feature (1076)..(1175): Gateway cloning site sequence
caaataatgattttattttgactgatagtgacctgttcgttgcaacacattgatgagcaatgcttttttataatgccaactttgtacaaaaaagcaggctactgggaatagctgaggaaattcatcggttgaaggccatgaatgttatcctggaagatcagcaagcccaaggggttcccatgtcgaatgatgaagtggcttgtttgacacaggagaatgctaatctcagggcgcaagttgagaacttgaaggcggaactgctcaacgagcaaaagtcggcaaacaccttaatagacctcgttctccaggcattttctgctgctaccaatccttttactcctagtgccctaaagtacccctttagtgaccagttttctggatatgtttcttatgtttttgtttcattgttgatgagtcaattggacacaactagaaatgaagtgactggcgtcactgtttctgccgtactgcactgtcctcccactcattctctaacaaaacaaagtactcataataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccatgagtactttgttttgttagagaatgagtgggaggacagtgcagtacggcagaaacagtgacgccagtcacttcatttctagttgtgtccaattgactcatcaacaatgaaacaaaaacataagaaacatatccagaaaactggtcactaaaggggtactttagggcactaggagtaaaaggattggtagcagcagaaaatgcctggagaacgaggtctattaaggtgtttgccgacttttgctcgttgagcagttccgccttcaagttctcaacttgcgccctgagattagcattctcctgtgtcaaacaagccacttcatcattcgacatgggaaccccttgggcttgctgatcttccaggataacattcatggccttcaaccgatgaatttcctcagctattcccagtacccagctttcttgtacaaagttggcattataagaaagcattgcttatcaatttgttgcaacgaacaggtcactatcagtcaaaataaaatcattatttg

SEQ ID NO: 156 - DNA, 2000 bp, Artificial Sequence
  Description of Artificial Sequence: Synthetic polynucleotide
  LARi7_c1, target gene is NDG7
  misc_feature (1)..(100): Gateway cloning site sequence
  misc_feature (1901)..(2000): Gateway cloning site sequence
caaataatgattttattttgactgatagtgacctgttcgttgcaacacattgatgagcaatgcttttttataatgccaactttgtacaaaaaagcaggcttaactttggtgggcctaactcaggtcccagagggttttattgccaccctagttcttcaggacgccctggttcaattggtgggccttatggagagagtcacccgaatatgttttcttcctgtagcaccagccacttctctggctggaggaggggctcagactccttctacacgcactccggagttcaccaagctcttcacttctacttttgccggtgcatttactgaggatccccaggattatctagaaagcttccacgaggttctgagaaacatgggtattattgagaccaatggggttgattttgctacatttcgcttgtctggatccgccaagacttggttcaacgatttagctcgccatgctctcatcatacttcccaccgagagagagagggtgagaaggtttattgatggtcttattctgccaattcgtcttcagatggccaaggagggcgggagcgagatcacatttcaggaggcggtcaatgtggcccgcatagttgagatggttatgtcatatggaggtggtcataggtcggataagaggccccgtcattcaggaagattctgtggtattgttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaacaataccacagaatcttcctgaatgacggggcctcttatccgacctatgaccacctccatatgacataaccatctcaactatgcgggccacattgaccgcctcctgaaatgtgatctcgctcccgccctccttggccatctgaagacgaattggcagaataagaccatcaataaaccttctcaccctctctctctcggtgggaagtatgatgagagcatggcgagctaaatcgttgaaccaagtcttggcggatccagacaagcgaaatgtagcaaaatcaaccccattggtctcaataatacccatgtttctcagaacctcgtggaagctttctagataatcctggggatcctcagtaaatgcaccggcaaaagtagaagtgaagagcttggtgaactccggagtgcgtgtagaaggagtctgagcccctcctccagccagagaagtggctggtgctacaggaagaaaacatattcgggtgactctctccataaggcccaccaattgaaccagggcgtcctgaagaactagggtggcaataaaaccctctgggacctgagttaggcccaccaaagttaacccagctttcttgtacaaagttggcattataagaaagcattgcttatcaatttgttgcaacgaacaggtcactatcagtcaaaataaaatcattatttg

SEQ ID NO: 157 - DNA, 2138 bp, Artificial Sequence
  Description of Artificial Sequence: Synthetic polynucleotide
  LARi8_c1, target gene is NDG8
  misc_feature (1)..(100): Gateway cloning site sequence
  misc_feature (2039)..(2138): Gateway cloning site sequence
caaataatgattttattttgactgatagtgacctgttcgttgcaacacattgatgagcaatgcttttttataatgccaactttgtacaaaaaagcaggctatggtgaagacttctaaaatggctccccaaaaagtcacttcttcttctcaaccgaccaccaaaattgatgaaaccactcctgatgtggtcgacctggagaggtacgctgctgatgtggttaccgatgaaccggctatcgaacctcccttaaaaatgttcattcccgagggttgtttggtcgccgacgactttaagctcggggctgcatcaggagagaagaagaagaagaagaaaagaaaggctttgggttccccgagctcagagaagaaaaaaccgaagagaagattggcctataagccaaaggatagctccagctctcgagcaccagactcagacttgctctactggctcagggaagagcatgaggaggatgatctttttacggcctacgaaccgacctcccccaaagagcgggcgatagccgaggaggagacaacaaaggcctgtctttctcaggttcgggagaccgatgtagaaacgagggctcagccttctcgagacgctggctctgctccacccagcatcaaagaaatttctgggtcaccttctttcaccgaatctatgttggacaaagctcgagcggagaaggagagatataacgaaggggcctatggtgtggacgacccccttcgttgcctttttgaaggtttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaaaccttcaaaaaggcaacgaagggggtcgtccacaccataggccccttcgttatatctctccttctccgctcgagctttgtccaacatagattcggtgaaagaaggtgacccagaaatttctttgatgctgggtggagcagagccagcgtctcgagaaggctgagccctcgtttctacatcggtctcccgaacctgagaaagacaggcctttgttgtctcctcctcggctatcgcccgctctttgggggaggtcggttcgtaggccgtaaaaagatcatcctcctcatgctcttccctgagccagtagagcaagtctgagtctggtgctcgagagctggagctatcctttggcttataggccaatcttctcttcggttttttcttctctgagctcggggaacccaaagcctttcttttcttcttcttcttcttctctcctgatgcagccccgagcttaaagtcgtcggcgaccaaacaaccctcgggaatgaacatttttaagggaggttcgatagccggttcatcggtaaccacatcagcagcgtacctctccaggtcgaccacatcaggagtggtttcatcaattttggtggtcggttgagaagaagaagtgactttttggggagccattttagaagtcttcaccatacccagctttcttgtacaaagttggcattataagaaagcattgcttatcaatttgttgcaacgaacaggtcactatcagtcaaaataaaatcattatttg

SEQ ID NO: 158 - DNA, 2648 bp, Artificial Sequence
  Description of Artificial Sequence: Synthetic polynucleotide
  LARi9_c1, target gene is NDG9
  misc_feature (1)..(100): Gateway cloning site sequence
  misc_feature (2549)..(2648): Gateway cloning site sequence
caaataatgattttattttgactgatagtgacctgttcgttgcaacacattgatgagcaatgcttttttataatgccaactttgtacaaaaaagcaggctatgcaatattctgatcagcagtcctacagtgcaccaccagctcctatcagtgcactgctgctccagagttttcggggtggttattcaggtcgccagggtcagtctcagtttcctcagccacaacacttaggtggatgttttgagtgtggtgagtatggttatattaggaggacttgtccgaggttagtgggtactcagtcgcagcagcagggtttccgcgctatggttggggcaccaggttttccacagaccacccagccagctagaggttctagatgtggaggtagaggatttagaggtggagctcagaccgctagagccaagcccgaggctgaggctttagatgtagttattacaggtacggttcttgtttgtgatagagatgctttagtgttatttgatccagggtctacgtactcgtatgtgtcatcttattttgcaccgtatctggacatgcctagtgattcattgagtgttcctgtatatgtgtctacaccggtgggtgattctattatggtagatcgagtccatcgctcttttatagttgtgattgagggtcttgagactcgtgtagatctgttgcttctggacatggtcgatttctatgttatattggggatggactggttatcaccttaccacgctatcttagactatcatgccaagactgtgaccttagccttatcgggtttacctcgtttagagtggagaggtactcctagtcattctacccgtagtatgggcaatcttgcttatattccgggcggtgagagaccgcttgctttggatgttcgggatttggccaatcaattcatgaggttggatgtctctgagcccagccatgtgctagcttgcacagccgcttgttcttctttattggagcgtatccgtaatcggcagtatttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaaatactgccgattacggatacgctccaataaagaagaacaagcggctgtgcaagctagcacatggctgggctcagagacatccaacctcatgaattgattggccaaatcccgaacatccaaagcaagcggtctctcaccgcccggaatataagcaagattgcccatactacgggtagaatgactaggagtacctctccactctaaacgaggtaaacccgataaggctaaggtcacagtcttggcatgatagtctaagatagcgtggtaaggtgataaccagtccatccccaatataacatagaaatcgaccatgtccagaagcaacagatctacacgagtctcaagaccctcaatcacaactataaaagagcgatggactcgatctaccataatagaatcacccaccggtgtagacacatatacaggaacactcaatgaatcactaggcatgtccagatacggtgcaaaataagatgacacatacgagtacgtagaccctggatcaaataacactaaagcatctctatcacaaacaagaaccgtacctgtaataactacatctaaagcctcagcctcgggcttggctctagcggtctgagctccacctctaaatcctctacctccacatctagaacctctagctggctgggtggtctgtggaaaacctggtgccccaaccatagcgcggaaaccctgctgctgcgactgagtacccactaacctcggacaagtcctcctaatataaccatactcaccacactcaaaacatccacctaagtgttgtggctgaggaaactgagactgaccctggcgacctgaataaccaccccgaaaactctggagcagcagtgcactgataggagctggtggtgcactgtaggactgctgatcagaatattgcatacccagctttcttgtacaaagttggcattataagaaagcattgcttatcaatttgttgcaacgaacaggtcactatcagtcaaaataaaatcattatttg

SEQ ID NO: 159 - DNA, 923 bp, Artificial Sequence
  Description of Artificial Sequence: Synthetic polynucleotide
  LARi10_c1, target gene is NDG10
  misc_feature (1)..(100): Gateway cloning site sequence
  misc_feature (824)..(923): Gateway cloning site sequence
caaataatgattttattttgactgatagtgacctgttcgttgcaacacattgatgagcaatgcttttttataatgccaactttgtacaaaaaagcaggctatgcggaggagtagaagaacaagcaatctcttccctcttgatcctgaaattgaaagatcacttcatagagagaggaaggagttggaagctagatacaaaacagaaagagagttgggcattttagttcaaccacagccaatagtgatggcaggtaatggagggcgttcggtgatagaagctcgaaggccaaatcttgctaatatgactcaggctattgttaagcctgatatcactgattactttgagcttaaacagtacacggtacagctaattcagtccactaggtaataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccacctagtggactgaattagctgtaccgtgtactgtttaagctcaaagtaatcagtgatatcaggcttaacaatagcctgagtcatattagcaagatttggccttcgagcttctatcaccgaacgccctccattacctgccatcactattggctgtggttgaactaaaatgcccaactctctttctgttttgtatctagcttccaactccttcctctctctatgaagtgatctttcaatttcaggatcaagagggaagagattgcttgttcttctactcctccgcatacccagctttcttgtacaaagttggcattataagaaagcattgcttatcaatttgttgcaacgaacaggtcactatcagtcaaaataaaatcattatttg

SEQ ID NO: 160 - DNA, 1559 bp, Artificial Sequence
  Description of Artificial Sequence: Synthetic polynucleotide
  LARi11_c1, target gene is NDG11
  misc_feature (1)..(100): Gateway cloning site sequence
  misc_feature (1460)..(1559): Gateway cloning site sequence
caaataatgattttattttgactgatagtgacctgttcgttgcaacacattgatgagcaatgcttttttataatgccaactttgtacaaaaaagcaggcttaggcaaaacatcaagaacataaggaaggccataaaagtggctgacaaagacattgacatttcggggacccaagcatcagtgaacatttcttctaggtcgtctgagggctcaccagcgggtagtagggatgaatactctaccactcccacagcttcattatctgaagagggtgttgtaggagatgaggaagaagtaggtggtgacgatgaagtagaagaaggaggtgaaccacaagagtggtggccggtgagaaagttgatcccggagcggagtttcattgatagtgacttgctacctcacaaccccaacatgaggagacagtttaggatgagagttggctgggaccatttccttgataagtgtgaggattccaacgaacacttggtcaaagaattttacagcaatgtagcccacatcaaaaagggctccaaagtgaccaaggttcaaaattggaaggtgttgtttgatgggaagtatataaatgaatacctgagcttcaatgagaggacgagaccttatacatggcaaatttggaaatgggagaggagccggttggaccctaccactcatgacaacgcctttcctctccatcgggctgtatttaataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccaaatacagcccgatggagaggaaaggcgttgtcatgagtggtagggtccaaccggctcctctcccatttccaaatttgccatgtataaggtctcgtcctctcattgaagctcaggtattcatttatatacttcccatcaaacaacaccttccaattttgaaccttggtcactttggagccctttttgatgtgggctacattgctgtaaaattctttgaccaagtgttcgttggaatcctcacacttatcaaggaaatggtcccagccaactctcatcctaaactgtctcctcatgttggggttgtgaggtagcaagtcactatcaatgaaactccgctccgggatcaactttctcaccggccaccactcttgtggttcacctccttcttctacttcatcgtcaccacctacttcttcctcatctcctacaacaccctcttcagataatgaagctgtgggagtggtagagtattcatccctactacccgctggtgagccctcagacgacctagaagaaatgttcactgatgcttgggtccccgaaatgtcaatgtctttgtcagccacttttatggccttccttatgttcttgatgttttgcctaacccagctttcttgtacaaagttggcattataagaaagcattgcttatcaatttgttgcaacgaacaggtcactatcagtcaaaataaaatcattatttg

SEQ ID NO: 161 - DNA, 2348 bp, Artificial Sequence
  Description of Artificial Sequence: Synthetic polynucleotide
  LARi12_c1, target gene is NDG12
  misc_feature (1)..(100): Gateway cloning site sequence
  misc_feature (2249)..(2348): Gateway cloning site sequence
caaataatgattttattttgactgatagtgacctgttcgttgcaacacattgatgagcaatgcttttttataatgccaactttgtacaaaaaagcaggctaaatgcagattctgatgcacagttggctttccacaatacctcaatcagaaatttggaggttcagataggccaaatctctcagtccttgaatacacgccctaagggtgctctaccaagtgatatagtagtaaacccaaagggtgagaacaatcatgttatggcagtaactacaaggagtggacgaggcggtgatgtgaatgcctctaaacaaaagcaagttttgagtgatgatattgagttgcaagaagatgaagttcctttggttgtagaaaatgtgatagatgacaatatgaatgaagaagtgatgattgatattcaagatgccgaggtggaaactcaaaatgacgtgaacccgtctagggaacacgtaatagatatgtcggagctggtggtgcctaaagccaagtatcaatttgattcctactcggttttcaaaattttgtgtattgggcaacctaggccgacttccatgagattacaaatggcggatagaacgatgaagagatcattggatattatcgatgatgtccttatccgggtggacaaatttatcttgccagctgattttgtgatcttggactgtgaggtggattatgaagttcctatcatattggggagatctttccttgctaccgggaaggccttagttcatgtggaagtaggggacctcacctttcgggtgggtgatgaaaaagtggtctttcatgtttacaagtcaatgaaacagcccaacagtaccaaagtgtgctctttttcaatcattcattttttgcccttaatttgcgccgaacccgctcggaacactttagctccgcccctgcctgccatgtttgttgttggtatcatgtaaaattttagcatgtaactcaacaccacaagtcaatgagacaacgaatgcagtaacccagctagggctatgcatcagtcgggtcggatcggatcagatcgaatttaacacatttcgaattgtaaattcggattccgatttttataaaatgcaatccgaatccaatccaaattaaattggatcggattggattttaaagtttgaatcgggtaaatatttcggattttcgaatcagatagtatgccttattaaggctactaacaatctaatcggctactacactttataaggcttaaattgaaaggcaacaaatgtcttttatagcaatagacaaaacaaagctccatagcaaaataaaataaactaaaattccaaacaaatgttatctcggctgggaatcaagccccaactcagagctgtgggccaggttgctttgctttatcggatcaatcagtatgcggtgggcaagctctttcccaagtcgctgagctgtttaacagagggaaggaaaaagaaatgacaaaacaaaaactacaaaggaaaaagaaaaagagcacactttggtactgttgggctgtttcattgacttgtaaacatgaaagaccactttttcatcacccacccgaaaggtgaggtcccctacttccacatgaactaaggccttcccggtagcaaggaaagatctccccaatatgataggaacttcataatccacctcacagtccaagatcacaaaatcagctggcaagataaatttgtccacccggataaggacatcatcgataatatccaatgatctcttcatcgttctatccgccatttgtaatctcatggaagtcggcctaggttgcccaatacacaaaattttgaaaaccgagtaggaatcaaattgatacttggctttaggcaccaccagctccgacatatctattacgtgttccctagacgggttcacgtcattttgagtttccacctcggcatcttgaatatcaatcatcacttcttcattcatattgtcatctatcacattttctacaaccaaaggaacttcatcttcttgcaactcaatatcatcactcaaaacttgcttttgtttagaggcattcacatcaccgcctcgtccactccttgtagttactgccataacatgattgttctcaccctttgggtttactactatatcacttggtagagcacccttagggcgtgtattcaaggactgagagatttggcctatctgaacctccaaatttctgattgaggtattgtggaaagccaactgtgcatcagaatctgcatttacccagctttcttgtacaaagttggcattataagaaagcattgcttatcaatttgttgcaacgaacaggtcactatcagtcaaaataaaatcattatttg

SEQ ID NO: 162 - DNA, 1505 bp, Artificial Sequence
  Description of Artificial Sequence: Synthetic polynucleotide
  LARi13_c1, target gene is NDG13
  misc_feature (1)..(100): Gateway cloning site sequence
  misc_feature (1406)..(1505): Gateway cloning site sequence
caaataatgattttattttgactgatagtgacctgttcgttgcaacacattgatgagcaatgcttttttataatgccaactttgtacaaaaaagcaggctctcagcctagagcagcagcaccagcggcggagcctcaggttgagtttgatgatgaggttacgacccaggaagttccggtgggcctagctcatgtctcagaggggttcattgctaccccagtactccaagatgctctgatggctccccagtttcagactctaacaactcagccagttggagcagttcagccggatgtggtagctcagaccggtgatagagcagctatgtctgtcgatgccttgtggagattggacaggttcaccaagctcttcactaccacttttagcggtgcatctttggaggatccccaggattatttggacagatgtcatgaggttctcaggaacatggggatattggagaccaatgggatcgactttgctactttttgcttatctggattcgccaagacttgtacgagaccaggtttattgatttggcccgtcatgatctacttatactccccattgagagagagagtgaggaggttcattgagggactcattcagcctattcgacttcagatggatgaggagacagggagtgagatttctttccaggaggtagccaatgtggtaataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccaccacattggctacctcctggaaagaaatctcactccctgtctcctcatccatctgaagtcgaataggctgaatgagtccctcaatgaacctcctcactctctctctcaatggggagtataagtagatcatgacgggccaaatcaataaacctggtctcgtacaagtcttggcgaatccagataagcaaaaagtagcaaagtcgatcccattggtctccaatatccccatgttcctgagaacctcatgacatctgtccaaataatcctggggatcctccaaagatgcaccgctaaaagtggtagtgaagagcttggtgaacctgtccaatctccacaaggcatcgacagacatagctgctctatcaccggtctgagctaccacatccggctgaactgctccaactggctgagttgttagagtctgaaactggggagccatcagagcatcttggagtactggggtagcaatgaacccctctgagacatgagctaggcccaccggaacttcctgggtcgtaacctcatcatcaaactcaacctgaggctccgccgctggtgctgctgctctaggctgagacccagctttcttgtacaaagttggcattataagaaagcattgcttatcaatttgttgcaacgaacaggtcactatcagtcaaaataaaatcattatttg

SEQ ID NO: 163 - DNA, 1373 bp, Artificial Sequence
  Description of Artificial Sequence: Synthetic polynucleotide
  LARi14_c1, target gene is NDG14
  misc_feature (1)..(100): Gateway cloning site sequence
  misc_feature (1274)..(1373): Gateway cloning site sequence
caaataatgattttattttgactgatagtgacctgttcgttgcaacacattgatgagcaatgcttttttataatgccaactttgtacaaaaaagcaggctatcgagttactctggcgcagatttatccatcgtttcggcgaatggtaatgataatgaggttcttcgtggagaaggttgggctcgaattcacgtttaatcacctcgttagactataccggccatttcattatcgaggcctgctaactctgaggtgccgtttgtccacgccctttgttgtcgatgatgaagaagacaaggaccgagagtgggccagttggtttattcaggctcaaactgctgacattatcccaacagggcttttgccatttcctgaagggtggaatcatgcaccaacttcgtggatgccgggcaaagtccttgaccttcccgtctgggtccataagttggcgacccattcgacttgcgacgagcgcaggtggcgagctgtatttcgtaccaaatggggagtgaaataccaagggcggttgtttgggatgagacagtgttcttccgaagaggagaaagagtcgtcagcctccaagccgagggaggatggtgataagggggatctaataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccagatcccccttatcaccatcctccctcggcttggaggctgacgactctttctcctcttcggaagaacactgtctcatcccaaacaaccgcccttggtatttcactccccatttggtacgaaatacagctcgccacctgcgctcgtcgcaagtcgaatgggtcgccaacttatggacccagacgggaaggtcaaggactttgcccggcatccacgaagttggtgcatgattccacccttcaggaaatggcaaaagccctgttgggataatgtcagcagtttgagcctgaataaaccaactggcccactctcggtccttgtcttcttcatcatcgacaacaaagggcgtggacaaacggcacctcagagttagcaggcctcgataatgaaatggccggtatagtctaacgaggtgattaaacgtgaattcgagcccaaccttctccacgaagaacctcattatcattaccattcgccgaaacgatggataaatctgcgccagagtaactcgatacccagctttcttgtacaaagttggcattataagaaagcattgcttatcaatttgttgcaacgaacaggtcactatcagtcaaaataaaatcattatttg

SEQ ID NO: 164 - DNA, 1385 bp, Artificial Sequence
  Description of Artificial Sequence: Synthetic polynucleotide
  LARi15_c1, target gene is NDG15
  misc_feature (1)..(100): Gateway cloning site sequence
  misc_feature (1286)..(1385): Gateway cloning site sequence
caaataatgattttattttgactgatagtgacctgttcgttgcaacacattgatgagcaatgcttttttataatgccaactttgtacaaaaaagcaggctggagaagttacaggtgcaaggatggaaggacatggtctttcagatgatggaaggatacaatgactataagaagctcaaatggacaagcctagagaatctccctactgcccttgccagtactagaaaattttgtgacaatgaggaggaaattgagcccaaggctatttacaaaaatgagatgaagccacccaacaaagtgttgctccaatttgtaaacaaatgtgtgctgccaagggttctaaatggaactaagacttatgtcataccctatggttttattctcacgattgttcttgcacatttaaaggtacccatcaagaaatgggaagttggtacaaacaaggatcattttggggctaacactttgactgcttgtaactatgaggctcaaatcactcccaaaaaacctggttcatccaaaaaggtaccagtgaatagcaaagtgcgagttttggtgcaagaaagtagggcaaaggatgctgagcctgataggctaaagaagaggttggctgaaattaataagatcttcaacacctacaccatttttttaatcactactacccattgcattgaacaaacttccaagttcttcttagcttcagattaagaaagtaccctttcttggctttgttgatgtggtaccattgtccattgtcttgtgtgtttccaatttcagccaacctcttctttagcctatcaggctcagcatcctttgccctactttcttgcaccaaaactcgcactttgctattcactggtacctttttggatgaaccaggttttttgggagtgatttgagcctcatagttacaagcagtcaaagtgttagccccaaaatgatccttgtttgtaccaacttcccatttcttgatgggtacctttaaatgtgcaagaacaatcgtgagaataaaaccatagggtatgacataagtcttagttccatttagaacccttggcagcacacatttgtttacaaattggagcaacactttgttgggtggcttcatctcatttttgtaaatagccttgggctcaatttcctcctcattgtcacaaaattttctagtactggcaagggcagtagggagattctctaggcttgtccatttgagcttcttatagtcattgtatccttccatcatctgaaagaccatgtccttccatccttgcacctgtaacttctccacccagctttcttgtacaaagttggcattataagaaagcattgcttatcaatttgttgcaacgaacaggtcactatcagtcaaaataaaatcattatttg

The invention claimed is:

1. A tobacco plant, or part thereof, comprising a first polymorphism in SEQ ID NO: 131 and a second polymorphism in SEQ ID NO: 137, wherein said tobacco plant comprises nicotine at a level below 25% of the nicotine level of a control plant when grown in similar growth conditions, wherein said tobacco plant is capable of producing leaves that, when cured, have a USDA grade index value of at least about 65% of the USDA grade index value of leaves of said control plant when grown and cured in similar conditions, wherein said control plant shares an essentially identical genetic background with said tobacco plant except said first and second polymorphisms, wherein said first polymorphism comprises an A nucleotide at the polymorphic site of SEQ ID NO:131, and wherein said second polymorphism comprises a C nucleotide at the polymorphic site of SEQ ID NO: 137.

2. The tobacco plant, or part thereof, of claim 1, wherein said tobacco plant is capable of producing leaves that, when cured, have a USDA grade index value of 50 or more.

3. The tobacco plant, or part thereof, of claim 1, wherein said tobacco plant comprises nicotine at a level below 15% of the nicotine level of said control plant when grown in similar growth conditions.

4. The tobacco plant, or part thereof, of claim 1, wherein said tobacco plant comprises a nicotine level less than 2.0%.

5. Cured tobacco material from the tobacco plant, or part thereof, comprising a first polymorphism in SEQ ID NO:131 and a second polymorphism in SEQ ID NO:137, wherein said tobacco plant comprises nicotine at a level below 25% of the nicotine level of a control plant when grown in similar growth conditions, wherein said tobacco plant is capable of producing leaves that, when cured, have a USDA grade index value of at least about 65% of the USDA grade index value of leaves of said control plant when grown and cured in similar conditions, wherein said control plant shares an essentially identical genetic background with said tobacco plant except said first and second polymorphisms, wherein said first polymorphism comprises an A nucleotide at the polymorphic site of SEQ ID NO: 131, and wherein said second polymorphism comprises a C nucleotide at the polymorphic site of SEQ ID NO: 137; wherein said cured tobacco material comprises said first polymorphism and said second polymorphism.

6. The cured tobacco material of claim 5, wherein said cured tobacco material comprises a lower level of nicotine compared to cured tobacco material from said control tobacco plant.

7. The cured tobacco material of claim 5, wherein said tobacco plant comprises nicotine at a level between 0.2% and 0.6%.

8. The cured tobacco material of claim 5, wherein said cured tobacco material is made by a curing process selected from the group consisting of flue curing, air curing, fire curing, and sun curing.

9. A tobacco product comprising the cured tobacco material of claim 5.

10. The tobacco product of claim 9, wherein said tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.

11. The tobacco product of claim 9, wherein said tobacco product is a smokeless tobacco product.

12. The tobacco plant, or part thereof, of claim 1, wherein said tobacco plant is not a flue-cured tobacco.

13. The tobacco plant, or part thereof, of claim 1, wherein said tobacco plant is a flue-cured tobacco.

14. The tobacco plant, or part thereof, of claim 1, wherein said tobacco plant is a burley tobacco.

15. The tobacco plant, or part thereof, of claim 1, wherein said tobacco plant is an oriental tobacco.

16. The tobacco plant, or part thereof, of claim 1, wherein said tobacco plant is an air-cured tobacco.

17. The tobacco plant, or part thereof, of claim 1, wherein said tobacco plant is a fire-cured tobacco.

18. The tobacco plant, or part thereof, of claim 1, wherein said tobacco plant comprises nicotine at a level below 8% of the nicotine level of said control plant when grown in similar growth conditions.

19. The tobacco plant, or part thereof, of claim 1, wherein said first polymorphism comprises an A nucleotide at the polymorphic site of SEQ ID NO: 131 and a G nucleotide at the polymorphic site of SEQ ID NO: 136.

20. The tobacco plant, or part thereof, of claim 1, wherein said second polymorphism comprises a C nucleotide at the polymorphic site of SEQ ID NO: 137 and a C nucleotide at the polymorphic site of SEQ ID NO: 142.

* * * * *